United States Patent 11,752,178 (METHODS FOR THE ISOLATION OF MICROBES WITH ENHANCED PERSISTANCE AND COMPOSITIONS WITH SUCH MICROBES) - sequence listing, part 2

SEQ ID NO: 6 - DNA, 2313752 bp, Bifidobacterium pseudocatenulatum
gtggccgacacgacaactgaccctctcgagcaggctcggggagtctggtccgacgcgctggcgttgttgcaccagaatccggcgctgtccatccgagataaaagctggctggaaaacgtttttcccgaaggcatgtggggtcctaccattgtcttatgcgtgccaagcgcggccgcacagcagacgttgcagaacgaattgaaccagcccctgctggaagccttgcgggaagccgccgaacaggatattttccccgcattcaagattgtggaaaagaaggaaccggcccaacctgccgtcgaggaatacccccacttctcccccgcgccacatgcggaggaaaccacgcaggggcagctgccgattccggttgtcatgccgccggagcgccacaacaacttccaacgcggccaaaacaggcctttgctggatcctaagacccatttgaataagaacgccacgttcgacaccttcgttcctggcgattccaatcgtttcgcacgtaccgtcgcgttggccgtcgcggaaggttccggtcacgatttcaacccgctttgtatttacggcggatcaggattgggtaaaacccacttgctgaacgccatcggcaattacgcactggtcaaggatcccacgctgaaagtccgttatgtgaccagtgaggaattcaccaacgaattcatcgaagcgttgggtgacaccaaccagaattccggtcaaatcaaggaattcaaccgtcgctaccgcgaagtcgacgtgctgctcatcgacgatattcaatttctgagcggcaaggacgcgacgcttgaacagttcttccatacattcaataccctgcatcaggcgaacaagcgcattgtgatcgcatccgatgtgcctccgaaggatctgcagggattcaacgaacgtttgatctcccgtttcgaatccggcctgaccgttgacgtcaagccgccggatctggagacgcgcatcgccattctgcgcatgatcgcccacggcaccaacgttcaggacgatgtgctcaacctcatcgcggagcggttcaccgagaatattcgcgagctggaaggcgcgctgaaccgcgtgaccgccatggcatcgctgagcggccagccggtgacccgcgcgttggcggaacagacgttgcaggactttttctcgaccgatgtggagatcaagcccaccgacatcatcacccaggtggccaagtacttctacattacgttcgatgacattgtcggacgttcacgtacgaagaagatcgcgctggcgcgtcagatcgccatgtatttggtgcgtgagctcaccagcatgagcctgaacgacatcggccaggtgtttggcggcaaggaccacaccacggtgatgcatgcatacacccgcatcagcgacgagatgcaggaaaagcaggagatctacaactacgtgacggaactgaccctgcagctcaagcagcgttccggcgaaaaataacgttttctatgcgactttgcgcgtttgcatgtgttttcgtgcgtctcaaaaaaacgattttaggcgttttctgcctttctcaggcgattttcacaagccaagtatgagtatcagtaaattctttatcagctgttttaccgaccatcctgacacgccggcctgtggaagatttttattgaagttatccacatggttatacacaaatcaatgatttctcggtggaaaacccgttggaaacgccagaatcgccggtggatgaattgtggactatccacatggttttgtggataactttttcaaagcgacgaggctgtggataacccgatgatttgtccacacttcgtccaaaagttatccacaagcaatgagatgttgcgagccattgcaaaacgtggggtctgagcacttacccacattatccacaggccttattatgacgaatgtaggttgttataagaaattcatcatcgtcgtcataagtggggaattccccacgcttcgtcaaacgccgacagtctcgctagaatgacttatggaccgaacgaaacgaggaaactagccatgaaagttgaagtcaattcccaagcgctggcagacgcagtagcctggaccactcgcgtgatcgacgctcgtcctgcatcccccattttggcaggcattcgcttggaggccatcgacggcaccctccagctttccgccttcaattacgccatttccgcacgccaccatatcgaagcaggcgttgatgaaagcggatccattctggtgctcggcaagctgctggcagatatcaccaagtcgcttcccgccgcgaaaacctacctgtccactgacggatccacactgaccatcacgtcgggcaagtccaccttcaccatgcagctcatgccggataacgaatatccggatctgccggtggttcccgccaaactggggcaggtggacgcccaaaccttcgcacaggccgtcgcccaggcgtccgtcgccgtttcccgcgaggagaaccgtccggtactgaccggcattcgtgtgcagttccaaggcaacaaggtgatcatgagctccaccgaccgattccgcttgtcgcgttcgagcttcacctggacgccggaaaacccggacatcaacaccaccgcactcgtgcgcggcgcactgttgcgcgatgtggcccgttccttggacgagcatcaaaacatcgtcgtggatttcgatccggagaatccgtcgctgctgggctttgagaacgccggacgcgtatccacctcgcagctgatcgacggcgaattccccgcggtggaccgcctgtacgctgacgaatacccgattcatgcggtcatcaacaagcaggatctcatcagcgccatcaagcgcgtgtccctcgtggccgaacgcaacgctccgatccgcatggccttcaccagccaggaactcacgctgaccgcaggctcggtggatgaagcccaagccaaggagatcctcgacatcgacatggatggcgaagacatcaccgtggccttcaatcccgcctacctgatcgaaggcctgagcgccatcagcgagccgttcgtacgcatgaagatgaccaccgcggtcaagccggtggaattcaacggccagcaggaatcgaattccgaagaatccatggactaccgctacctgctcgtgccgatgcgcttcaacagctgaactaagctgacctacacgaaaacgcggatacatcgcaaaaaatagggctgaacatggctgttattgccagttcagcccatttgcatgattaattgcgattatttacgtaagaaattcgcactatctcaaggatcttgcatgtatatttcccgactggcactcgaccactaccgatcgtgggaacattgcgtgctcgatttcaaaccgggaatcaacattctgcaaggtgccaacggactcggcaaaaccaatatcgtggaagccatcgaagtgctttccacaggatccagccatcgcgcgtcatcatcactgccattaatcgaaaaagggtgcacgtcggccaccatccgagccaacgtggaagacggtgaaacgcagcacacctacgaggcgaccatcgtggcacggggtgctaaccgagcgcgcattgacggcggaaaatctcaatatatgagggatctcatcgggcgcacgccctccgtctcctttacccccgaagatcaacgtctggtagcaggggatcccgcaacccgacgcaacttcatcaaccaggccgcgtctctgctgctcccccactatgcgcagaccctgcaacagttcacgcacgtggcgaaacagcgcacggcactgctcaaacaactcggcgacggcacgaatctcgacccgcaatacggccagcaggcggtcttaagcgggctggaaatctggacggggcaattcatcgacctcggcatgcagctgacgcgggaccgcaacaacgtgatctcacgcttggaagagccttttgcgcggatctacgcgtctttggcgggagatgacgaacgggcggcgctcgcctacgagccgtccttcgacgaagtgatgctgttcgacgatccggccgcggagatcagccgccatttccaacgcatctaccccggcgaagtggcgcgtgggcagaatctgatcggtccgcatcgcgacgacctgactttgctgctcaacgatatgaacgcacgcgaattcgcgtccaacggtgagatgtggaccatggctttggcgttgaaaatggcgctatatgaggcggtttccgcacattttgaaagcaagccaatcgtgattctcgatgatgtgttcgcacagcttgacgaggcccgtcgtgggcagatcctcgattttgcgatgcggcaggaccaggtgctgatcaccgtcgccgcggcaagcgatattccgcgcatggatgctgggcgctttcacgcggacgcgcatgtgatcgacgtggccgcgttgcgcaggcaatcgcaagatggacagcatgacgatttgacggcgatgatggcgcaacttgtcgcgggacgggaatctgcaacgcaatcgtctgcagcgcaacagtcggtgaatcgacaggagcagcgctgatgccgaatcctccaatctgcgaaacattgcatctcgaccaacgcaagttgcccgccgaagtattcgaacgtatcagccgacgtgccggccgatataaggaacgtgaggaacgtgcgcggcaggcgtgggagaatttcggcaaacccggacgcgacccgcagacggtcggcaatattttcaacgtgatcgcaacgcaaggttcttggacgccgcatctgaaaatcgcgcagatgcagaatcattgggatcaggtggtcggcgtcgaaaacgcgcgccactcctaccccgtcgacctgcgcgacggcattctgacgatccgatgcgacagccccgcatggaccaccaccttgacgtacatgattccgctgctgaccgacaccattcgccgtaggctcgaggggctgaccatcaacgaggtgcgcgtcaccggcccgcaacaacagggattcagccgaggacgaatgacacgaaggccgcgatattagcgcgacaccacgtgctatcagacgttcgttgaaggcgcttcgtcgaagaattccccctgcgacgcttccaagcgggccgttcgcaacggtcgaatgttgttttccgaaagcgaaaaaacaggggtaaacggctggatttcaaggataaatgcctctggcgctctgtccccctccatgagtagaatatcaagcagtgtatgtaaacgcctagaaggggcctttatttgcgttctaggtggtatcacctgcgtgaatgaccctcattggcgggaaaaatgcaggaaggaatctctgtggcagaccttgatgcggattcgctgaacgaatcagctgaaaacacgcaggaagatcagatccagaacgatcagctcgaagatgcgcagctcgatgacaccttggctccggagcattacgacgcttccgatctgagggttctggaaggccttgaggcggtgcgaatccgcccgggcatgtacatcggctccaccggcccccgaggcttgcaccacctggtgtacgagatcgtcgacaactccgtcgatgaggcgctggcaggctacgcttcgcacatcgaagtgacgattctgccggacggcggcgtgcgcgtggtggatgacggccgaggcattccggtcgacgaagtgccgggcgaaggcgtttccggcgtggaaaccgtgatgaccaagctgcatgccggcggcaagttcggtggcggcggctatgcggtttccggcggtctgcacggcgtgggcatctccgtggtgaacgcgctgtcgacccgcgtcaacatcgaagtgcgccgacagggcttccactggacccagacctacatcgaccagaagccgaccgcacgtcttgccaagggcgagccgatgggcgaagacgagtccaccggcacttccgtgaccttctgggcagacggcgcgatcttcgaaaccaccacctacgatttcgagaccctgcgcaaccgcttccagcagatggcgttcctcaacaaggggctgaaactgtccctgaccgatttgcgcgaaccggatcaggccggagacgaagtcgcgggcgaaagcgacgacaatgccgaaccgaagcatcagacggtcacctaccaatacaacgacggcatcaaggattatgtcgattacttggtgaagtcccgcaaggcaacccccgtcgaaccggacgtgatcgatttcgaagcggaagacctgaaaatcggcatttccgcggaaatcgccatgcaatggaccaccgcatactccgaagcggtgcacaccttcgccaacaccatctccaccaccgaaggcggtacccacgaagaaggcttccgcgccgcgctgacctcgctggtcaaccgttacgcccgcgagaagaacatcctcaaggacaaggatgagaacctctccggcgacgacgtgcgcgaaggcctgaccgcagtggtgtcggtgaaactcaccaccccgcagttcgaaggccagaccaagaccaagctcggcaattccgaagcgaaaaccttcgtacagcgtgtgatgaccgacaagctcggcgactggttcgattcgcatcctagcgaggccaagaacatcatccagaaggccattgaagcctcccgtgcgcgtcttgcagccaagaaggcacgtgagaatacccgccgtaagtcaatcttcgaatctgcgggcatgccagacaaactgaaggattgccagtccaacaatcctgaagaatgcgaactgttcatcgtggagggcgactccgcaggcggctccgcaattcagggacgcaacccgatcacgcaggccatcctgccgttgcgaggcaaaatccttaacaccgagcgtgcaagcctcgaccgcatgatgaagtccgaaaccatcgaatcgctgatcaccgcggtcggcggcggctatggcgaggatttcgacctgaacaaagtccgctaccacaaggtcatcatcatggccgatgccgatgtggatggcgcgcatatcgcaaccctgaatctgacgctgttcttccgctacatgcgcccgatgatcaccgctggttacgtgtatgtggccatgccgccgctgtaccgactcaagtggaccaaaggcgcgcacgacttcgtgtacaccgacgccgaacgcgaccgcgtgctcgccgaaggcaagtccgccggccgtcagctgccgaagggcgaaggcatccagcgttacaagggtctgggtgaaatgagctaccaggaactgtgggaaaccaccatggatcctgaccaccgcattctgaagcaggtgcagatcgaagacgcggccgcagccgacgaaaccttctccatgctcatgggagacgaagtcgaacctcgccgtctgttcatccagcgcaacgcccgcaacgtcagctggatcgacgcgtagggatttcaaggacttcaggcaaggtttcataaggatttagaaggacttagaagttggcagacgaaaacaacagcaacgaagacggccagttcgtgcctgacggctccatggagccgttgagcccgcaggaggccgacaacaccgattacggcctgatggtgggcgaacgcatccagaagaaggatctgcagcaggaaatgcgcgattcctacctggcgtacgccatgtccgtgatcgtggaccgtgcgctcccggacgtgcgcgacggcatgaagccggtgcatcgccgtgtgatctacgcgatgtacgacggcggctaccgccccgaccgcggctactccaagtgcgcccgcgtggtcggcgaagtgatgggtaagtaccatccgcacggcgattccgcgatctacgacacgttggtgcgtatggcacagtcgtggtctatgcgctacacgctggtcgacggccagggcaacttcggctcccccggcgacgatccggccgcggcaatgcgttacaccgaatgccgtatggctccgctcgccatggaaatggttcgcgacatcgacaaagacaccgtcgatttcctgccgaactacgatggcaagacacaggagccgaccgtgcttccggcacgattcccgaacctgttgtgcaacggttcgtccggtatcgccgtcggtatggccaccaacattcctccgcacaacatgcgcgaggtggccgaaggcgtgcattgggcgctcgaccacccggacgcaagccgcgaagagctgctcgaaaacctgatccgcatcatcaagggaccggacttccctactggcgcaacgattctcggacataagggcatcgaacaggcctaccgtaccggccgtggtctgatcaccatgcgcgcggtggtgaacaccgaagagatcaagggtcgcatgtgcctcgtgatcaccgagctgccgtaccaggtgaaccctgaccgactggtcgtctccatccgcgaagcggtgcgcgacggcaagatccagggcatcgccgacatgcgcgacgaaacctccggtcgtaccggtcagcgtctcgtgctcgtgctcaagcgcgacgccgtgccgaaggtcgtgctcaacaacctgtacaagcactcccagctgcagcagaccttcggcgccaacatgctggcgctggtcgacggtgtgccgcgcacgctgtctttggatgccttcatccgccattgggtgggccaccagctggaagtcatcgcacgccgtaccgcatacctcaagcgtgaggcggaggaacgcgaccacattctgcagggctatctgaaggccctcgacatgatcgacgaggtcatcgcgctcattcgtgcttccgaatccgcggaaaccgcgcgcacgggccttatggacctgctggacgtggatgaagtgcaggccgacgccattctggccatgcagctgcgccgactggccgcattggaacgtcagaagatcctcgacgagcacaacgaactgatgcgtcgcatcgccgactacaacgacattctcgccaagccagagcgccagcgcaagatcgtgggcgacgagcttgacgaaatcgtgtccaagtatggcgacgaacgtcgaaccaagatcctgccgtactccggcgaaatgaacgtcgaagatctgatcgcggaagaaaacgtggtcgtaaccgttacacactccggtttcatcaagcgtaccaaggccgacgaataccgtgcgcagcatcgcggcggcaagggcatcaagggcgccaagctgcgcgaggacgacgtggtggaccacttcttcctcaccagcacgcacaactggctgctgttcttcaccaacaagggacgcgtgtaccgcctgaaggcgtacgagctgccggagggatcgcgcgattccaagggacagcatgtggccaacctgctgcagttcgggccggacgagacgatccagaccgtgctgtcgattccgaactacgaagtggccaagtatctggtgctcgccacccgttccggcaaggtcaagaagaccgcgctcgccgaatacgattccccgcgtcagggcggcctgatcgcagtgcgccttatgaccggcgagaacggcgagaacgccgacgagctgatcggtgccgcactgtgcaacgccgaggatgacatcattcttgtgtcgaagctgggcatgagcctgaagttccaggccaacgacgagcagctgcgcccgatgggccgtcagaccgcaggcgtgcagggcatgaagttccgcgaaggcgacgagctgctggccatggacgtggtctggggcgattccgacaaggatctgttcgtggtcaccaacgagggcttcgccaagcgcaccgccatcagcgaataccgtttgcaaggccgtaacggctttggcgtcaaggccgtgcagctcgccgaaggccgtggctccctcgtgggcgcggtgatcgttgaggaagatgaccagatcatggccatcatgaagtccggcaaggtcatccgttccaacgtcgacgaggtcaagcgcaccggccgcaccacccaaggtgtgacgttcgccaagccggacaagaacgacgagatcatctccatcgcacgcaacgaggagaaggatgacgaatccgcggaatctggcgaatctgtggaaaaaacggaatccgcggaacatgggacgaacgcaaccgtgaacgagggtgcttcggcatcgtctgaagccgctactgaagccaacgctggcaacggcgatggcgagaatgtagaggcatgaagacaagacaggcaatcgtctgcgaaaactggtagcctcagctaagaactgggcacaatcttgcaaggagcaacgatgagcgagaacatcgaaggacagcaaatgccggaggttgggcaggcaccgcgcgtggcacgttccgcttccagccagccgctgattggtgcggatcaggttcaggcgcacgagggtgcctcctccgcttccggcggtgtgaaggtccgtgagaagcgtcgcggcggcgctccgcgtgcacgccgtatgagcctgtctctgacgcgtatcgatgcatggtcggccgccaaggtggcgttcatgctttccatcgcgggaggcatcattcagattgtcgcggtggctttgctgtggggcatgctgaacgtggtcggcgtgttcgaccaagttacgcagattgtgtcttccactggcttggacgctggcggattcgacctgaccaacgtgttctcgttgggcactgtgctgagcgccgtcaccatcttctccattgtggaagtggtgctgatcaccgtgctcgtggtgattttcacgctgctgtacaacgtggtgagcaccctcgtcggtggcatccacgtcacgcttggagatgattaatagcgcagtgcgctattaatggcagcgagcggcgatagcgtccgcgagcgtcgcatgcaatgctgaaatagcgcagtgcgccgtcagtagcggcgatagcaaactcaaacgcaacaagacggtctgtgtcgtgattcccatcacgacacagaccgtcttcgtattttctagaccagtctgtctcttaccgtacgccaaaccctatctgcctctcccctgcctgcaatctgcccatatctgccctatatatggcagattttgccttccgacctgtaccatctcgcttatatatggcaggtcaacttgcgaaaaagccagttcgggggtatattttgggtcatttttcctaccaaatctgccatatataagcgagatagcggagctgcgcgagaggaagttgcggttatagctgaaactattgcgatttttagagatagtttcagttataaccggaactatcgtgattttgagtgattgtttcaaatgtaactgcaactagattgggtgcgctgaagtacgtgttgaaatacgaaaagagggcctgtctggaatgaaaccagacaggccctcaatgtatttcgatgagccagccgtattggctagattggctaaaacggctagatcagagcacgccctgggcgaccatggcgttggcgaccttcacgaagccggcagcgttggcgccgagcatcagatcaccctcgtggccgtattccttggcggcttccagagagttggcgacgatgttctccatgatggacttgagcttgccgtcaacctcttcaaaagtccaggaaaggcggtaggagttctggctcatctcaaggccggaaaccgccacgccacccgcgttcgcggccttggcggggccatagagcacgttgttggcctggtagacggcgattgcctccggagtggaaggcatgttggcgccttcgcacaccacggtgcagccgttggcgacgagagccttggcggattcctcgtcgatctcgttctgggtggcgcacggcagggcgatatcgcacggaacggtccacacgcccttgcagccctcgtgatattcggagcccggcacacgctcggcgtattccttgatgcggccgcggtggcccagcttgatgtccttgaccacgtcgagctgaatgccgttcggatcgtagatgtagccgttggaatcggaggcggtcacaaccttcgcgccgagggcctgagccttctcggtggcgaagatggccacgttgccggagccggagatgaccacggtcttgccttcgaaggaatcgttgcgcagcacgcgcattgcctcggcggtgtaatagcacaggccgtaaccggtggcttcggtacgagccagggagccgccgaattcgaggcccttgccggtcagcacgccggaatactcgtcgcggatgcgcttgtactggccgaacaggtagccgatctcgcggccgcccacgttgatatcaccggccgggacgtcggtgaactggccgatgtgacggcacagttccgtcatgaaggcctggcagaaacgcatgacttcggcgtcggacttgcccttcgggtcgaagtcggatccgcccttgccgccgcccatcggcaggctggtcagggagttcttcaggatctgctcgaagccgaggaacttgatgacgccctcgttcacgctcgggtggaagcgcagaccgcccttgtacgggccgatcgcggagttgaactggatgcggtaaccgcggttgacctgcaccttgccctcatcgtcggtccatgcgacgcggaacttcaccacgcgctccggctcgacgatgcgctcaagcacgcccgccttctcatattccggatgcttcgcaaccaccggctcgaggctttcgaaaacctcgcgaacggcctgcaggaactccggctggtcgccgtcgcgcttctcgacctgcgcgtacacgcgcttgacgtactcgtcagtgagcatattcttccccttcgggatagttgggttaccaatagacggtctcattctatgtgcacgaatatggacggcacaagaccttgttcaggatttggagacgctttttgcgagtgctggttctgaacctgcttctttttacgggattgccgtgccttgtgttgcctataggatggaaatgcggaaagcgtgggagagagtacgtccgcaataacatctcacgatctcacataatgggagaatcatcatgattgaaggatttaagaaattcattgcacgcggcaacatgatcgacatggcggtcggtgtcgtcatgggcggtgccgtcaccacagtggttaactctattgtcaacaatgtgattaatccgttcatcgccatgattttcggcaaaccgaatatggatggtctgctggcaatcacattcaataatgcgacggtttcgttcggcgcggtacttggcgcgatattgaatttcctgattatcgcggcggccgtgtatttctgcattctcgtgccgatcaacaaattccgtgacgtgaccgaggcgttgctcgccaaaaccaagcttgcggaagaacggagcaaagccgaggaggaagctgccaaagagccggaaatctccaccgaagagcagacgatcctgctgttgcagcaaatccgcgacgaacttgccaggcagaatgcacggaatacacagaacgtgccgaacgattccgacactgttgccggtgcagtcgcagtgcggtagtcatcgcaagcgatcgtaataatcaataattcaaggacgtttcaagcggtgacgcaagccccgcctgagacggccttttgcaatggtctttcagcggggtgattcttccatgcgctggaataatacggactctggaaggtgcctcagcgggtcatatgttccagtgactggagggatctggactgtgaggtgcctggctgcgtctagttttctccagtgactggaggttttgggatgctgggaggcttgttggtgggaggattcctccactcggtggaggtttttggactgtgaggtgcctggctgcgtccggttttctccagtgactggaggaattgggatgctggtttggatttcggatttgggtatgaaaaaagggtttccggaaatcactggaaaccctatctgtggagctaaggggattcgaacccctgaccctctccatgccatggagatgcgctaccagctgcgccatagccccgtggagctagccgggttcgaaccggcgaccctctgcttgcaaagcagatgcgctaccagctgcgctatagccccatagttgaaaaaaagcggccgcgccgctcttaatcaccgtgggcccgggaggacttgaacctccgacctcatccttatcagggatgcgctctaaccacctgagctacgggcccgttcctgctgcactgttaagcacaacgaattgaaataatacgcgaatttcagagaaagtcaatacaaggtgtgtcttcggcgtgtcgtgacataatgcagacatgccgaacaatcatcgtagccagcgtaacaatagtgggagagccagcaggggagtgcgcaaccgtaatcgcacgctatccgaagaaaccacgcaaatcgctggaatgacggtgaccatcgtgcgtaaagccatcaaaaacatgtacctgcgcatcaaaccgccgaacgcgcaaatcgtcatctccgcaccttctcgcatgtcgcaagcggcaatcgcacgatttgtgacggaacgcaaaccatggatcgaacgtgcgcgacgcaccatgctgcaagccaaggatgaacagatccgtcaaagcgatttcaatggtttggaccgtgtgaatggttcgcatggtccggataatctgaatggcctggaaaattcgggcggcgtgggcgatcgaaacaatccaggcgatcccaatagcttgaataatccgcgcgttttcgtgtggaacgacgcggcgaaggaacgggccgtatgggccatcaatgcgcaactgccggtgctgcttgcgaaatggtcgccgattatcgggcggaagccgacgcatgtcacgttacgcatcatgacgtcgcgatgggggtcatgcacgccgaaaaccggccgcatccgactcaacctgcaacttggtcttatggatcccagattcctggaatacgtgcttgtgcacgaaatgacgcacctgtgggaaaacgggcacggagaggactttcagcggcgtatgagcgcatatttgccgcaatggaggcaattgcggcgggagctgaaccgtcatgttgtgttgtgatgctcgcgatgctgttgcgttcgctgtcacgctgccatgctgcgatgagcttgcgtagggcgatgttgttgcgttgcctgtgatgttgaaatacttgcgatatcacgccactgccgtcacattgcgcggattgcaatgactagccacggcttacgcacgtttgataacgacgtataggtgattcgtatagctttttgttcataagatgtacagaacgcttaacatccgcgatttgcaagcctacaatcgtgacgactgaaacgtttgcgtgcaaacagtccacgcagaaagatcgaataagtgagggaggggtcgattgtggctgtattgagaaaagtcggcattatcggcatcggacacgtgggcgcgcatgtcgcaaatgccgtgctttccgcaggactggccgaagaactgaagctgtgcgacatcaacgagcaaaaagtagtcagcgaatgtcaggatttaagtgacacgttgggtttctatccgcataactgcgtgatcggcaactacggcacgcaatacgagcagctagccgactgcgacgtggtaatcaacgctgccggcgacgtgaaaaccagcgccaaagatcgtgacggcgaactgttcgtcaccaccgacattgcacgcacctggatctcccgactgttcaatgcaggcttccacggtgtgatcatcaccatctcaaatccgtgcgatgtggtcgcaaccgaaatctggcacatcaccggctacgatccgcgcaaaataatcggcaccggaaccgcgttggattccgcacgactgcgcaacgccatcgcgaaacgcgtcaacgtggatcagaaatcaatcggcgcatacatgctgggggagcatggcaattcgcagttcgcctattggtcgaacgtgaacatcgcaggcaagccgcttgatcaactcgcacaagacgatccgcaacgattcgccctcgacaaggacgaaaccgagcaggacgcccgtcgaggcggataccgcgtgtacgccggcaaagagtgcacggaatacgctattgcagccactgcggcacgccttacgcaggctgtgctctgcgatgaacactatgcgaccgcctgctccacgctgcttaccggcgaacaaggcgaaagcggcaattacgccagcctgccgtgcatcatcggagcgaacggcgttgaagaagtcctcagtcccacactcaccgaaagcgaacaggccaaattccatgcgtcctgcgagcatatccgcgccaatatcgcgcagcttgcatggtggaacgacgaatgccatcccatgctgcgcggctgaatctgcaataactcagcggatttaataacagagcagacttgcgattactgatgttgattgtgtaaaaaatcagcatttacataatcgcaagtctgttttattttcattttattttcgttttatttttgattatttcgtagctttcgcagcatcgacgtcaacagtatgcttgcggatttccaacgtttcgatacgacggccgtccacttgcgtgacggtcatgtcataaccgtcgtcggaaggcagcacgtcgccgatttcgcccatctttccagtatgcgccaggaaatagccggcaaccgtctcgtacggaccgtcttccagctcaataccggtcaaatcggcgaaatcctcaatcgtcatgccgccttcgatcgtggcgacgccattgacgaacgtggtacgttccgtgcgttcgccgcctttctcttccggcagatcatattcgtcgcgaatatcgccgaccagttcctccgtcatatcttccaacgtgacgatgccgtcggtaccgccatattcgtcgatgaccaccgccagatgaatgccgcgcttacgtagcagctcaaggcttggcagcagtttcgacgtgcccggcagcgaaatgccctcgcgcgtcacgtcggcaaccgtcttcgcctcgggatcgcgaatgtcaagcaggtcgcgcacatgcacgaaaccaagcacatcgtcgaaatccttgccggtcaccggatagcgggaatacggcatttctctcacatatgcggccgccttctcaatcggcatatcgccatccaaaaaaaccacgtcggcacgcgggcgcatcacttcggccacaatcgtttcggacgcgtcgaacacgtcgtcgagaatcgtgcgttcgtccttgctcaagttcgtattggtgttgacgagtacgcgcagctcttcgtcggacacttcgctgtcggtttcgttcgggtcgaaaccaagcaagcgcacgataatgttcgtgttcttgccgatcagccaaataatcggcttgcacaccttcgcaaacacatgaatcgcaggtaccacggcacgcgcgatctgctcgttgcgttgcatggcgatacgcttcggcaccaactccgaaatcacgatcgaacagtacgaaatgatcaacgtcagcacaatggtggtcaggggagcggccacactcgtcggcacgccccaactttcaacgatcggcacaatataaggcgaaatcgacgattcgccgaacgatgcggaaaggaaaccgctcaacgtcacgccgatctgcacggtcgacaaaaacgtgttcggatctcgcgcgatctgtgcgacgcgcttgccgcgggcatcctcctgttccatctggtcgatctgcgatccacgcaggctgaccaacgccagttcggtgccggcgaacaccgatccgagcaacagaaaaacgaaaatcaggagaatgttcaaacctagagacatggttccactctatcggggcggtatgtcaaagtgtctgtatctcctgattttcttggattttctcaattattcttagattgcttagcttcggattgttcttttttggatctctgttttgcaaatctccgttttccgaattgtaatccgtttcagaagctaagaacctcgactttgccggagtccagctggtaccttgcgccgacgatcatgagtttgtcggatgccagcgcctgctggatcgcttcggattgttccaccaagagttcgatggtgcgcgcgatgtgcacgcgttcgaaatcctcgctggattccaattccgactcgtgcgcctgccagattgagaaaccgacggtgcgcatcatgagcgaatccgaagcgcagatgcgttcgtcgatgtcggcaatgctgtcggcggccatcagcgaatcctcggcatcggcggtcagtttgtgcagtaacgcctcgtaatccttggaagcttgcttgatcgcaccgcaattctggtggccgagcaccaccagcaaacgtacgccgagcacggtcaccgcgtattctagggacgcaatcacggcttcgtcgatgatttgaccggccgtgcgaaccgtgaacaggtcgccaagaccggaatcgaaaataatatccgggcttactcgcgcgtcggagcagctcagtatggccgcttccggtgcgtgtgtgtccacaagtgcctcgcgtgcttcagcgccacgattcggatgttccggtttgccctccgcaaacctgcgattacctgccagcatgcggctccaaacgccgcttgccgtgccttcgacctcgtcttggtctacaaacagttcgtctgccattgactccacccctcattgttcaggctagccaacatcatacgttttggtctgaccgttcgctgggaaatagagcgatatctcgcttatgtatggcagatttcgtgttctgtccggtgatatttcgcttatgtatgacagtcccaaaggtgaaaaaccggaaagatgtacccccgaagtgggtttttcgcatgatggcctgccatatataagcgagaaggctcatgacaaggctccgattctgccatatataaggcagatataggtatgaaaaagggtccccgatcggcagtgcgaacggggaccctgaaagaaactggctacaatcagccggtgttctgcaagcctgctgcgacacccgacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggagaaataagcatacataatcctagcagggcaagtgctgtgagatatatgtactgcactgttctccttattttaggtagtcggagatgcaagggtatggtccttgtttatttattccgttgcttgaatctttgaagaaatcgatactctcaaatgtaatccctttatattgcttcacggtaattactttaaaatgaaggttaattctgtcttctttcttgtacttgttggtgatatttccattaaatttccattcaatatattcgttgtctaataaaaagaagagtgatgtattgttttcattgggattgaattgaattttatctatgatatcttcaaaaataatatcatctcctgtattgtagtcgcgaagataatcgactgatataccacttttttcgtcataaaattgattgttaagttgtttgatgtcaagggttggggcttttgttgttcttggttgatctgggttggcgttgtatcggaacgtggtgccatcgttagccaggtagtcgattagattggtatttgggacgtcgatgatcgttggaagacttcttccattgccgtaatattggcggtaataacactgccaatttttcccgctgtcatcttcggtgaaacgagcgtcccatgttccggtgccatcgctgcttgatctggtgtatgagacatactggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgccaccaatttacagcaaaggctggagtggtcataactgtgcataggcaaactgagataattgtggagaataaaaaaactcttctggatttcataatttcctccatgtgaaaatttaatctcaatcgacaatgattaagatattaagagtattctaatggaaaatgagtaggggtgcactctagggtgtgattttctagtgaaaatagcaaaggttctctctcgtggaagttgcaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgccgagaatataagtctgaccgaaccagttgtataagcccacgatggctgtcggtgtcgcggcgtgggtaaacgcggacaggcaccgggttacgtcggatgattgggggtctgtcgctcggcctgcgtgcctgttttgtgcgctgtcgccggccaggctagggccgcgcgacgcgagcggggaggcccgcgccgtttatcggcacggaacctccccgctcgcatcattcaggcggtcagccgaagatcagcccgtgttctgcaggcctgctgcgacaccggacacggtgcacaggatcaggtaggtgtagttctccttctgtccgtgcgtgagctcttccttgtccacgcgcttgcgtagcgagccgagggcgagcacctgagtggcggacagcgcatccacgtacggcgagcggatgcggatggcctggccgagcacgtggcggtgctgcagaggccacttgtcgcctacgatctcgagcacccacttgcgggtgagctccatctcgtcgaggaccttcttgttgaggtcttcacggtctccgagggcaaggtacatcttggcgatgcgctcgtcagtcttggccagcgacatttcgatgttgtcgatgaacgtggagaacagaggccattcctcatacgcttgacgcaaggtgttcaaatcgccgaactgttcgcacgcggtgcccaggccgtaccatgcggccagattgatgcgtgcctgcgcccaggagaagatccacggaatggtacgcagatcgtcgagggacttggctccaaggccacgtttggccggacgggagccgatcggcagcaggccgatttcggtcagcggcgtgacggtggagaaccacggtgcgaagccgtcggtgttcagcaggtcgaggaagcggttatgcgcggcctcgtcgagcttgttggccatgtcggcgtacttggcggtcatgtccgtattgcgcttctccacgcttggagcggactgcagcagcgttgcagccgcaacggactcgacgtggcggatggccagtgccgggttgccgtagcgtgcgaagatgacctcgccctgctcagtgagcttgaagcggcactttacggagccgaccggctgtgcgagtacggcacggttagccgggccgccgccgcggccgacggcaccaccgcggccatggaacagggtcagatcgatgtcatgcgattccgcccacttggcgatgcgttcctgtgcggaatgcagggccagggttgcggaggtcgggccagcgtccttcgaggagtcggagtagccgagcatgacttccatcttgccgccggtggccttcagacgagcctggacctccggaatcttgatcatttcctcgagtacgtctaccgagttctgcagatcctcaagctgttcgaacagcgggatcacgtcgatggttggaacatccttgggatgggagaacgccagacggttcagctcgtacacgtccctgatgttttgggcgctcttggtgaaggagatgatgtaacgacgggcggccttgatgccgttgcgcttctggatggaaccaagggcgcggaaggtgtcgagcacctcgtgggtcatcggctgcagttcgccacgctcaccgtgcagaccatgttcgcggatatcctccagcgctcgggaatgcacgacggagtgctggcggaactccatctcgaccatatggaagccaaaggtctctgcctgccagatgaggtcctgcagcgggccgtaggcggaacgtttggcgttggcttcggcgagggagcgctgcacgaccttcaggtcggcgatgtaatcctcgcaggagtggtacatgagatcagcatcgcggtcgatggtggccttcagacgatcggccatgaccagcatgacggcacggtgcagctccttggtggagatcagtgcggccttgtcggtcaggcgctcgctcatttccttctgatggttccacaggctcttgagctcggcactcggcggagtggtctcagcttccatcgtcaggttcttgccaacgcggcgggtctcgatttgcaacgcgcccagcacgtggtcgctgaacttgcgggctacctgacggctcaccttggcggtgacattcgggttgccgtcacggtcggagccgatccagcttcccgggtggaagaacgccgggcataccggcggcacgaggccagccttatctccgaggatccaatcgtcgaaacgacggtacacctgtggaatggtatagaacaacgtattgtcgaaaatatcgagaatggtttcagattcctcaaccggagtcggcttcttcagtgcgatcggagaggtgcggaacagcgcgtcaatctcgttgaagagtcgacgggagttttccttcttgtctgaaccgccaagcagcttgtgcgttgcgagcagctgggagatgcgacggattttgccttccacggctttgcggcgggcttcagtcggatgcgcggtgaacaccggatggaactcgagctggtcgagcagttccttggctttggccggacccatttcgttaatgagctggtggtaggcgcaggtcatttcgttcactgggtcgacggcttgggtgtcatctacggcggcctcacggctgtgcagcacggagacacggtagttctcctcgcataggttggccagatggaagtaggtggtgaaggcgcgggccagcagttgtgcctcatgcacatccgttttatcgatgatgtcgacgaccttctgcaggtcatcctgattcggattcgtatccgtcagaatgccggagaagcgttcggcgctagcgttcagtgcgtgttcgcgcacttcatcgaacttggccagcagcttttcatcgaattcgccgagcacctcgcgaagaatctgcaaacacagatccatttcctctttgagggaagcgggaagatcgcgctcctcggggcctttggtgccggtgccggacgagacgatagctgcgtcggcaggcgtgatctgttcgttttctattgtcatcagacctccttctccaaaccatcgggttgcccggtctgtcggtccttcgcggcacctccgcgattgttttggccgtctgttgcgagcccacagccctaagttcggtcggtaatgcacgaccattgtatgcgcggcaaatcgacagtttggttacggaaataccgaaaatgtccgcatcgtggtccagtggtgtccacaaggtgaaatcgacggaaatttcgaaaatcctccgaccagcccacacgttagacctgaacttgtgagcgcacaatacgaacatgaacatgagacgaatttcgatagcgcggaaaaaagcgcttcggccgtcagcaaattccatacacactccattccgctcgatatggaagatatcgaacgggattgggacaagccggtcgctgaagcgggaatcgcagcaaaagccagcgtgatcgtacgcgtcggcatgctcgatctcggcgcgggcaccggaagcttccgcgtacgcgaaatgatgcaccgcatcgcctatccgctgggcgtgcacgtgcgcgccgacgtgaacctcaccgacatcgaagcctcctgcaccgacggcaaagaccgtatcaccgaagtcgtcgacctgccaaccaccggcgtcaacacggaacgcatttggctgctcgaacacttcgctgactggttcaacgtgaacctcggcaaaggatcgatgtaccacagccaatccgacgtgtccgaaggacttatgcagcatctcgacaagcgtgatgcgtcgcaggtgtcggctgacctgtcgaagcgtcttcgcgaacgtcagaaagccgaacagaatcaggagggatctgacgatcccgtgctcgacgcgcttgaaatggtgacggaacgcgccgaagtgaccgataccaccgcgcagccgttgcacttgcgtgacatcgaagcggcaagcgagcagcataatcgcggtgaacgtgaagccgaacgtgaaaccaagcgtgaaactgccggtacggccaacgttacgtcaagcgaatcgaccacgaaaaaagcgcgcaaaaatcgcaatcacaagccgccaaaaggtcaatacgccgaacatttcgaccacgtcggaaaagaagcggaccaatcgcaaggcatcaccgttcgccaagcccacgaacgactcgacatgatcgaacgacgcaaacccctgtattcgccggcgttcgcgggattcgcctcggcctgcgcctgcgcatccttcgtgttcctgcttggtggcggtcccttcgatatgatcggcgcgttcatcggcgcgggacttggtcactggctgcgccgccgcctgttcgcccaccatctcaaccagttcttcgtgacgttcgtatgcgtggccgtcgcggcactcgcctgcacgggcaccctgcgattgattggtattttcgagcccgtcgcattgcagcatgatacggcttacatcggtgccatgctgtttgtgattcctggattcccgctgattacgggtggacttgatatggcgaaaattgattttccgtcaggtattcagcgcgttgcgtacgtgttgtgcattattttgatggcgacgctcgcaggctggatggtcgcttcgatcgtgcatttgaatccggaaggattcgagccgttgggactcaatccggttgtcaattgcctgttgcgtttcgtgttcgcattcatcggcgtctggggcttctccaccatgttcaactcgccgcagcgcatgtgccttgtcgccgccaccattggcgccattactgacaccttgcgtttggaaatcgttgacatgggcgttcccgccgaagccggcgcattcatcggcgcactgctcgcaggcctgcttgcctccgcatggcgttctgcggttcatcgcagctggctcgctccgcatctcggctacccgcgcatctgcctgaccgtgccgtccatcgtgatcatggttcccggtttgtacatgtatcaagccatgttccacctcggccaattcgacaccttgaacgccctcgactgggctttccgcgcgttcatggtgattatctgtctgccgatcggcctagccatggctcgcgttatcaccgataagtcttggagatacgatatttgatccgtttcggcatttgggcgcgtaaatgagataaatgcgattgtcgcaatgttcgaccggtacattgggacaatcgcatattttttcagaagagattcgaaagaaattcgtttcgacagagatttgaagaaagagattcgaaagaaattcggctagcaatctaagaagagagaattcatggttaccaaagatttttgggtgctgctggcgatggtcatctattttgtggccatgctcaccatcggcttcatctactccaagcggtccaattcctccactcgtcagtatttcgcgggtggtcgaggcgttggtccatggctgacggcattgagcgccgaagcctccgatatgagcggctggctgctcatgggactgccgggcgtcgcctacttcaccggtgccgccgacccgctgtggacggccctcggcctggctctcggcacctacctcaactggaagctcgtcgcacgccgtttgcgccgctactccgtggtggcaggtgacgcgatcaccattccggacttcttctccaaacgattccatgacaaacgcaatatcgtctccaccatcgcggcgctgatcatcctcgtatttttctgtgtgtatgtcggtagctgcttcgtgacggtcggcaaacttttctcgaccctgttcggctgggactaccacctgaccatggtgatcggcgctgccatcgtgttcgcctacaccgtgatcggaggctatctttccgtggtcgtgaccgacttcatccaaggcttgctcatgttcttcgcgctggcagtggtgttcatcggttccgtcgcatccgtcggcggcgtcgacaacaccgtcgccttcctcaaaggcattccaggcttccttgacggcacgcaaatggccacgccgattctgaacgatgccggcgagcagattgtcaaggctggccaggccatgttcggcgcgcctaccgaatacggcgtgatcaccatgatttccatgcttgcgtggggtcttggctatttcggcatgccgcaggtgctcgtgcgattcctgtcgatccgcagttccgaagagatcaagaagtctcgcatcatcgccaccacgtggtgtgtggtgtcgctggcgtgcggcgtgtgcatcggtttggttggccgtgcgatgatgccgacgcagttcgtcacgcagtccgctgcggagaacattttcatcgtggtttcgcaggctctgctgccgagcttcatgtgcggcatcgtggtgtcgggcattttcgccgcgtccatgagttcgtcgtcgtcatacctgattatcggcgcttccgcggtcggtgagaatattttccgcggattgctctatcgcaaggccaccgatcgtcaggtgatgatggttgcgcgcatcacattgctggttatgttcattttcggcattgtggttgcgttcgatcagaattcgtcgattttccaggttgtttcgtatgcatgggccggtttgggcgcttcgttcggtccgctgatgctctgctcgctgtattggcgtcgtaccaataaattcggtgcgattgcgggcatgctttccggtactgcgaccgtgctgatctggcataatttcatcaagccgcttggtggtgtcttcgctatttacgagctgcttccggcgttcatcatctcgctgctgttcattgtggtggtgtcgctgctgactccggctcccgatgctgaagtgctgcacgagttcgatcattatcttgatgatcccgatgaccgcaaggtggatgacgatttggtcgcagcggaaatcgcttccggcgaaaagcgcgcgaaaatctaatcaaacataatgtggcacatgccactcaaacgcaacaaaggccggattgtgcaatacgcaatccggcctttgtcgatgctgaaacgctgtttaaagcgtgattatggtgtttctggagctttagtagcgcatgcccatggcgtcgcgcacctgctccaacgtttcgttggcgatggcgttggccttcttgttgccttcggcgagcacgtcgcgcacgtaatccatatccttggcgagttcctcgcgacgggcgcgatgcggctcaaggaagctgttcaccgattcgatcacatacgccttcagcgcgcccgcaccggaatcgccgatctcctcggcgatctccttcggatcgcgaccggtgaccaaaccggcggtcgtcagcagtgcggaaacctgcggacgtgcgatcggatcgaacgtgatgcggcgctcggaatcggtcggactcttcttgatgagcttggcggtctcctgcgctgtggcgcccaacatgatggaattgccgtacgacttgctcatcttgcggccatccaagcctggaatctccggcgcttcagacagaatcgcggccggctcggggaacaccggatgcttcttggcgtagcgttcgttgaaacgacgcgcgatggtgcgcgtgatctcgacatgcggcaggttatccttgccgatcggtaccacattggccttgcagaacagaatgtcgcatgcctgatgcaccggataagtcagcagcaggccggtcagcgcatggccggaagcttccatttccgacttcaccgtaggattgcgatgcagctcggcctcagtcaccaatgacaggaacggcagcatcagctggttctccgcaggaacggcggaatgcgtgaaaatcatggtcttttccggatcgatgccggcagccatgtagtcaagcaccaagttgagcacattgtcttcgatgtgcgcggtcgtgtcacgatcggtgatcacctgataatcggcgatgatgatattcgaattcacgccgcgattctgcatggcgacgcgctcacgaatcgaaccaaaataatggccgagatgcagacgtccggtcggacggtcgccggtcagcatggtgaacttgcccggattctgttcgattgcggcgagcgttgcgtcggaacgcttcttcgctgcgaggaagctcgcgctcatttcattgccgacagcggtgatctgctgctcctgggtttcgtccgtcatacgtgtccttttcttaagaaaatcagcgattttatcgtaaaagtctgagccgacaacgaaatatggcacagcaagtggtactctcttgtttgatgaattgatagcacagtaatcctcagggggtcagatgggccgcggacgtcagaaagccaaacagcagaaaatagcccgaaagctcaagtacctgaccaccgacaccgattatgatgagctcgccaaggagctcggtgcccaggagcctggttcgggttcttttgatcctttcgccgatatcgaagcaaaatattctcacgatgcggacgctgaagatgagatttctgaagatgctcaggagtccgcgcaaaccgacgccgaggatgacctcgacgagtatgcaaagtgggccgcagaggcggcggcgaaggccacgagcggagagttcccggcagccaagtccgccgcgccgaagccacacaagcccatcccgatgccgatgcccagcgcactgaagccgaagaagcaggactgatcggcatatcaggtactttgtgaaaccgcgatgcggatatgcctgccaggtgtatccacatcgcggttttgctatgcgtttttgcgcctgtgacggtcttctcgcagcctgtcacaccaacggcagcaagctactcaaatcgtcgcgttcgccaacggccgtgatgcgtcctgcctccttctcctcagcccagctggtgatgcccgtggcgagtctcatccacacgtccggttccagttcgatcacgtccggcggtgtgagattatgcggatcggatgccggtccgtcgagaatcttgatggcaccccacggcgcgacacgaacttccacgcccgccccgggcgcttttttctccagcagatgcagcgagtagcgcaccgccatcgcccacagttggcgtggcaatcgtggagagaattccagacggaaatcgcgggccgcgtcggtatttgcgggaatattgtcggcgatcatgcgatgagacgtttgcagccattgtgcaaatgcgtcatgccccttatgcagatcttgttctcgaataacagccatacgtgttattttgccgtttgcgagcgactatgatggggtgttgcagacaacgtagtcacaactgaataggggtgtgaagagagggaaaatacctgcgattcttgacagcgttcgcaatgttgttgcatgtcgtttgcatgttgctcgcaacgtttttgcagccggtttgcattatttctgcaaacgaatgcttgcttgtaattgcttgaaatttcatctttttatgattacgtagtatgctatgtatgagaacgtatgcatgatgttacttagtgttcatgcggccgctaatgcaaggacgctggggtaaggcataatgttcctggagagtaatccgtcaaagggagtcgattaatgactgaaattaccgcaccgaagtccgcggtcaccgcggagcagttcgcagacgagatccgcgagcagctgaagtacacccagggcgtcaccgtcgagcaggccaagccggccgacgtgtacgtcgccgcgtccgccgcagtgcgccgccacctcatggattcctggttcaagacccagtccgacatggtcaacggcaacaccaaggcagtcggctacctgtccgcagaattcctgatgggcaagcagctgcgcaacgcgctgctcaacgccggtctgaccgagcagttcgacgccgcggtcaaggaactcggcttctccgtgcaggacgtcgtcgacgccgagcacgagccgggcctcggcaacggtggcctcggccgtctggccgcctgcttcatcgattcgctcgcctcgctgggcgtgccggcattcggttatggcattcagtacaagtacggcatcttcgagcagaagttcgatgaaaacggcaagcagatcgaaaccccggactactggctgaccaatgaagagccgtggggacacatcgattacaaccgcgaccagaaggtttccttcggcggcgaagtcgttgaggaagatggcaagaaggtatggaagccggcttggtccgtgcgtgcggtgccggtcgactacatggttccgggctacgcctccggccgtgtgaacaccctgcgtctgtggaccgccaagagctacgacgagttcgacctgctcaccttcaacaagtccgagtaccttgacgccgtcaagccgcaggttgaagctgagaacatctccaagatcctgtatccggaagattccaccccgcagggcaaggcactgcgtctcgagcagcagtacttcttcgtgtccgcctccatccacgacgccatccgcgtcttctacccgggtcaggacaagccggatctgaccaccttcgcggacaagatcaccttccagctcaacgacacccacccggtcatcggcattccggagctcatgcgcgtcctcatggacgagtacggctacgattgggacaccgcctggaccgtcaccaacaagaccttcaactacacctgccacaccctgcttccggaagccctggaagtgtggccgtccaagctcatcggcgaactcctgccgcgtcacctcgaaatcatcgagaagatccaggaccagttcgcagccgagctcaaggccaagtgcgtcgacgaagccaccatcaaggacatggccatctacaccggcgactccgtgcgcatggcctacctggccacctacggcggctcccatgtcaacggcgttgccgagctgcactcccagctgctcaaggacgtcaccctgaagaacttctccgacgtgtatccggacaagttcaccaacgtgaccaacggcgtgacccctcgccgcttcgtcaagctcgccaacccgcgtctgtccgacctcatcaccgaaggcctcggcaccgacaagtgggtgagcgacctcgaactgctcaagggcctcgaaccgctcgcagccgatgacgaattcgtcaagaagttcgccgccgtcaagcaggccaacaaggttgacttctccaactacgccaagcgcgaatacggcttcgacatcgacccgaacaccatgatcaacaccatggtcaagcgtctgcacgaatacaagcgtcaggcactgaagatcctcgccgtgatcgcacgctacgccgacatcaagtccggcaggatcgccgccgacgatgtcatgccgcgcaccatcgtgttcggcgccaaggccgctccgggctactacctcgccaagcagaccatccagctgatcaacaacgtcgcccgcgtcatcaacaacgacccggatgtcaagggcaagctgaacgtctacttcccgtggaactacaacgtgcgtctcgcacagcacctcatcccggcaaccgacctcgacgagcagatctcccaggccggcaaggaagcctccggtaccggcaacatgaagttcgctctcaacggcgccatgaccgtcggcaccctcgacggtgccaacgtcgaaatccgtgagcgcgtcggcgctgagaacttcttcctcttcggcatgaccgtcgacgaggtggatgccctctatgccgaaggctacgatccgaagaagtactacgaggccgatcctcgtctcaaagccgccatcgacatggtcgcggacggcaccttctccaacggcgacaagaccgtgtacgaagaccttgtccacgattggctcaccaaggactggttcatgaccctcgccgacttcggcgcctacaccgccatccagtcggaaatcgaggccctctacgcccagccgctcgaatggaaccgcaaggccctcatcaacgtggcgaactcgggctacttcagctccgaccgctcgatggaggattacctcgagcgcatctggatgaccggtccgctcaagtaatgacggagcgttatctgcgttgtggaaggcttgacgtatcttcgtacgctttcgccttccacgccttgtgatactgcgctcgtcattactttcgcttcgcacgggccatatgtgacgtgaattatcgcgtgatgtatgactcgtagcgttagatagggcgtgatgacgaagggacgattccgttttggaatcgtcccttttcgttttccagggcaaaacaaaaagccctgcgcgtggggcgcagggcttgaaagaaagagaaatcaggcagcttctggggtggcgggagcgacttcggcttcgccatcctcggcatccttggtcaggccaagatcgacaggagacgagctgttctcccatggctcctcccacggatcgtaatccggattctgctgcttgtacacatacagaccgacgacaccggcaagcaaagctccgaagagcagtgcgaagaacttccaaccgttagaagacttgttctccatgacggatcctttcccaaatatcggcgaacattggctgacctgctcgttcaagccaactctgttcactatattaattccttgaatgtgttgattgggtggatttacgcgccggggattcacaagaatgcaatcatttgcaatgatttcgcagattcgcggattcgcacgttccagtagggttgaaacatggcttatcaacgtttcagtctgtttcccgattccccgtcgttcaaagacttcttctctgcacgttccatgcgataccgttggcgtaacggcgatcctgtgatcaccgttacgatcatggcgatatgcgtcgcggtctggattgtcgaaacactattgaaaatcgtctggccgaccggctgcaacgcattcgtcggctcaggcgtattcatgcccgcgctggcgactcaccgcccatggaccttcattacgtcaatgttcctgcaccagccggcctccctatggcacattcttttcaacatgctgaccttgtggtgcgtcgggcctgtattggaacgcatgatggggcatctgccatatctcgcgttatacgtgctgtcaggactcggtggaagcgccggcatgatggtctgggcactgttctcgcaagacggttggctgacatccgcatacggcgcttccggcgcgctattcggcctgttcgcggcaattctggtggtataccagcgcattggcatcgacattcgatccatgctgatctggatgctcatcaacttcctgatgccaatcatcacgccgaacatcgcatggcaggcgcatgtcggcggattcatcatcggaggagtgttcgcctggctgttggtttccggtctgcatgcgttgcgcggcaaaagcctgcagcagcgcacgctgatgtacggcgtaatcatgttggccgtgattattgcgattgtcgtcgcatgcaatatgagcaatccacttcgcgcaaacccccttcttggcatgttcttctagttggcaggcaggagaaaaaacagatttgaggaatcgcagacacacacttatccacaaatgtggataagtgtgtggataagtgagggttgagctgtgggtaagtcggggataactcggtgcattatccacaaggatattcacaaaacggtggattccccggcttttcaacggtggaaaatgtggataacccgactgtgcatagtggaaaaatggggaaaaacaccatcctatatattgtggacggccataaaactgcctacaagatatagacgctatccacattcgtccacaataatccacgacttatccacatcgtgtgaaaccagaaaatccccagaatgacgacgaatcaacacaacgaaatcaggtacgtcaccaatgacaatcatgaatgacgagacgcgcgaattcgtggcgatgcatcgtaacgaggacgtgcgcgaactggcgttgaaggccaaacgtgtggaagggctcgacctgccgttggcgctcgaccagattgccggatggcagatcgcacgcaaaaaactgccacaatgggcctcctgcgagggaatcgtataccctccgcacatttccatggaacagtgctcatcgcagttcacagcccaatacaagtcagaagtcgcacaaacactgcttgcgccggccgcaaccgtgcgcgccagagtgtccgattctggagaatcggacaaccaaaccacgaaaagtgagccacagttgtccgattctgccgaatcggtcatgcaaacggcaaaaagtgcgttccagttgtccgattctccagaatcggacacgcaagagatgaaaatgggcgcgtggatgtccgattcgccagaatcggacacattggtggcgagaagggcgatggtggatctgacgggcgggttcggcgtggacttctcgtatctggcgcgcggattcagccaagccacttatgtggaacggcagcggcatctgtgcgatctggccgaacacaatatggccgcactgggactcgaccaggcgcgcatcgtgtgcggcgacggcgtggaatacctcaggcagatgggtccggtggacttcatctaccttgatccggcccgccgcgacgagcatggatcgcgcacttacgcgatcgaggattgcacgccgaacgtgttcgaattgcgtgacctgttgctctccaaatcgcagtacacgctggtcaagctttcgccgatgttggattggcgcaaggcggtcgccgatttcgacgggaccgtacgcgaagtgcatatcgtggccaccggcaacgaatgcaaggaactgttgctggtattgggtcagcaggtgcatgaggaaccatccgcgccgcgcgtgttctgcgtgaacgacaatcagcggatcgactatgattccgccgcatatacgcagggcctgcgcattggcggcaaaccgctgccggaggtgaaaaactacttgtatgagccgaatgcgtcgattatgaaggccggttgcttcgatctggtggaggaacgattcggtgtgacgcaggtcggtccaagcagtcaccttttcgtgtcggcaacgccggttgccgattttcccggcagaggattcgcgattgaagcgatcggcggcatgaataaaaaggatataaaacgactgctgaatggcacgaaacaggccaatatcgcggtacgtaacttcccgcttaccgcaccgcagctacgcaagaaattgaagcttgccgacggtggtccggtctatctgttcggcactaccatgcaaggctgcgatcatgtgctgctgcgcacgtcgaaaatctgaaaaacaaaccggaatcgaaaaaagaaacaggcgaaccgggattggcaaggcagtcgcgaaagaccgcgtacgtttgcgaaagagcgtgaaacctacgaagaaaacctacgaaaagattgcgagataatcgtaaaagggcatgcgaaaagggcgtctgaccgcacgttgtacagacgccctcaaatcgcaggaaaggcgaaactacgctttagcgccaccacatggtcatgatgaatccgatcatgatgatcgcgaatgcgatggccagattccacgcgccgatgttcggaatcgggtagtcggaagtcaggtagtagacgaccgcccagatcagaccgatgatcatcagcgcgcagaacagcggcacgaaccagcgtggattggacttggtgcccttgatggtttcctccacgcggcgggtgttctccgcctgacggttcatcatgcgctgcatctgcgggctcagggagtccttatcggcggtagcgttcagcaccgcttcgacgcgatccatcggaatgtcgtgatcgtcatcgtcgtcggaatcagcggattcgtcagaagtggaatcgacggtggtttcctcagcggcatcctgaacggtttcgttgctctcttcaacggcagcggtgtcgtccgtggactgcagatcgttctgatcgtccgcggtggtttcgtgcagctcttcgtcagccatcagcatagtctcctttaataggctaaaagtcataatagtgggtagactcgaaagcggcgaactcacagcgcaaaactgttcataatcagagcaaatgcttaatgggaatcaggaaggtccgcatggcgaagcacaccggcaagcacaccgcgaaacggtcgaaagcggccggagtggcggcattccttgtgctcatgttctccggattcctgctcgccacgaatctgcgcgtgaaccgttccgtcgtggtgaccaacgacaccgccgaactcgtggaacaacgcgtgaaaaaagtcaactccctgcagacggaagtcgacgcgctcagctcccgcgtgaacgatctgagcaaaaccctgaacagccaggacgacgccgaccagcaagacagcgaaagcgccggcaacggcaccatgctgcccgcggtggaaggccccggactcgtggtgacgctcgacgattcgccactctgggaaaacatggtcgattccagcggctccacctccaacatcaacgattacgtggtgcaccagcaagacgtcgaagccgtggtgaacgcgctttgggcgggcggcgcggaatccatgatgatcatggatcagcgtgtgctgttcaattccgcagtgcgctgttccggcaacgtgctgcttttgcagggcaaaaagtattcgccgccattcaccatttccgcgatcggcccggtcgagacaatgaaaaaggcgctcgacaattcgcaggaagtgaccatataccggcagtacgtcagcgcgttcggcttgggatggcaggtcgacgaaaaagaaaaactccatttcgacgcgaccgacgcattgcaacagccgctgcaatacgcgcaggcgatgaacaacgaaacagacggatcgcagcaaacggacgaaacgcaggaatcgcaagaggggaagtaaccgatgaagcacgtggcaccaaagcagcgtcgcaaaagcgtggtctggacgatacttggcatcctcgccgaactcatgctgaccgcggcggccgtctgcgcgctctacatcgcatggcaaatgtggtggacgggcgtgcaggccgaacacaaccaaatcgaaacacgccaatccgtatcatggtccgaccccggccaatccgacagcgtcaccattgcgcaagcgcaggaaggcgacccgccaacgcaaccgcaaagcgcacaggaaggcgagctcatcgcccaggtctacattccgcgattcggcagccaatggcagcgcaacctcgttgaaggcacctctctcaccgaactcaacaagcacggactcggccactacaaggattcgcaaatgcctggccaagtcggcaatttcgccttcgcagggcaccgcaacggctacggacagccactcggcgacgtcgacaaactgcaggaaggcgacccgatcatcgtgcgcacgcaggattactggtacgtctaccactacgccagctacaaaatcgtgctgccgaccgacatcgaagtggtcgccgccaaccccgaaaaccccggcgcgacgccaaccaaacgcatgctgaccatgaccacatgcgaaccgaaatactccacgccgacacaccgctggatcagctacgcggaattctcatactgggcgaaggtgtccgacggcatcccccaggagctcgcctccaccgactccaacggcaaagtcaaattcgtcaacaacgaaaaatcgtcgatcgtcgcatccgtcagctcactcaaaccgtggattctcggcgcgctcgccgcatatgcgatcatcttcctttccgcgctggtggcatggcgttggccgtatctcgccgacgtgcgcgcaggacgccgcgaaaagccggaattcagcttgtacggcggattgatgcgattgcagccgggtgtgcttccgattcgacttgtgctcatggcgttgctgattttcgcggcggccgcatcgtgctttgaatggctgttcccgtgggctgcgacgaatattccggcattgcaggaaatgtcgaattacacggccatataaagctgtattcaggtgccttccggcggtctgccggaaggcttgctggcagttttgctggcagacgtgaaagcgattgctgcgattgctgcgatctgcgattatcacgattgctgcgattgctgcgtgagacgcgcgccgcgtcacgacatgttgcgcacgtacactgctatgcaaacgcaaatattcgcgcaacgtaagtattcgaagcattcgaacgccgacattccgacgttgataggagcatgatgaccgattccgcacgcattttggtcgtggacaactacgattcgttcgtttacacgattgtcggctatttgaagacgttgggtgccgcggtgacggtggtgcgcaacgatgcgatcgatccgggcgaagccgatgtgatcgacgaatacgacggcgtgcttatttctcccggcccgggcgctccggccgattccggtgccagcgaaggcatgattcgcctgtgcgcggagcagtccaagcccatgttcggcgtgtgcctcggcatgcaggcgctggccgaagtgttcggcgcgaccgtaagccacgcgccgaccatcatgcacggcaaaaccagcttggtggagcatatcgacgatgagatcttcgaaggcgtcgccaatccgatgaccgccacccgctaccattcgctggccgtggagcccgattccgtgccggaagagctggtggtgaccgcgtggacgcaggtcgaccacatcgtgcagggcatcaagcattgcagcaagccgatgtatgcggtgcagttccaccccgaatccgtgatgacgcaggacggctaccgtctgcttgcgaactggctgaaggtgtgcggccaggagaacgccgtggaacgttccaagggattgcagcccaaggtcgcggcctaaggtcgcagcaagaagacgtgggaagtgcgaaaacgcatggtacaagcgatggtacaagcgtggaaacgtaagtcgcgcaatctcaatcgcaagaaaatacaaaatcgtaagaaaacacgaatcgcaaaagaacataagaccgtaatgaggaaggcccagctggcatttcagctgggccttccttgtgaatgatggcggttatctcgaccgatcagttgccttcgggagtgttgttgcctccgtcggtgttgccgccattgccgccgttgccgccgttgttgccgttgttgccgccattattggtgctggacgacttcgtggtcaacgtgatcgtggctccgctgtcggactgggtgccggcggtcggtgacatgcctgtgaccgtgccatcctccgggccggaaaccgtgacctggaaaccgtagctttccaacaggctcttggcgcccgcatagcccatgccgaccacgctgggcacgctgatctgctgcttgccggtagacacccaaatcgtgaccgcggtaccggcctcgaccgtgcttccaacacccggctcgacgcgggtgacggcgccggaagcgatagaatcggaatattcgctttcgatggtgatctgcgtcagaccggcctgcttcagctgctcgataaccgtgtctttcggctgtccgatcagattgtcgggaatcttggtcatgccggacgaaatgtacagcgtgatgatcgtgcccttggtctgctttgaatgggcggcaggatccgtgcttaccaccttgtctttttcgatggaggcattgtcgaccgtgcgcacgttacccaccttgaagccggcggcctcaagaatggatttcgcgtcatcctggctcttgttcgacacatccggaacggcgaccgactgagggccggtggagaaccacacggaaaccgtggagcccttggcgaccttcttgccgcccgccggattctgcttggtgatggtgcccttcggctcgcttgaatcggaatcctctcgggcatcgagcttcagacccttggccgcgagctgctcttcgacgcgcgcctcggaaatattcgccgtggcggtgaaatcaggaacttccaccatgtcggcggtggagtcgctcttgttcagcatgaagaacacacccagaatgaccagcagcgccaccagaccgcccaccacggagccgatgatgatctgcttcttcttacgcgccttagcggcctcggcacgctgttccgcgcgggtttttgtggatacgccgttctgtgggttcggcacggcctcgaactggcccgtaacgggattgaacgcctgcgtcgcggcggtttcaccggcaggagtcatggccacggtgttcgcgtccatttcggcctgtttgcgtgccttcatattggtcagatcggtcaacggattgaacgcggccgccatcggcacgccgccgttcatgaacgtcagcaaatcgttcttgaattcggaagccgtggcgtaacggttctgacgatccttcgccatcgccttcgcgcaaatcgaatcccacatcttcggcaagccgggaacgaccgaacttgggggagtggcgacctccgaaacatgctggtaggcgatcgcaaccgcggaatcgccggtaaacggcggccttccggtaagcatttcatacagcacgcaacctgcggaatacaggtcggaacgcatgtcgacgctttcgccgcgtgcctgctcgggagacaggtattgcgcggttccgaccacaccctgcgactgcgtcatcgtggcggcggaatcgtcgagcgcgcgggcgatgccgaagtccatgaccttgaccacgccctgctcggaaatcatgatgttgccgggcttgatgtcgcggtggatgatgcccatgcgatgcgaatactcaagcgcgttgagcacgcccatcatcacctgttcggcgtcgcgctggctcagagcgccattcactttgagaatgtcgcgcaaggtctggcccttgacatattccatcaccagatacggcagatgttcggtctggccggtttccgtggcgacgacctcttcgcccgaatcgtagatgttcacgatattcggattgttcatctgcgccacggaatgggcttcgcgacggaaacgctcaaggaagatcttgtcgttggcgaagtcggcgcgcatgatcttgaccgcgacggtacgcccaaggcgcgtatcgagcgccacgtgcacttcggccatgccgccacggccgaccagttggccgagctggtaacgtccaccagccaaagaggtaggcatgttgatgttcatccctgttccttcccatcagtgctcaaggagatatgaggtctgctgaccacgcgtcgcggaagtcttccgcctgtaggcaccaccatcgtgtcagccaattgtgtctgctggtcgagcagacggcgttcgatgcgggacaacgtgcgcgacaccgtcaacgcgtccttcggacggtcaagcgggtctttggacagcatcgacatgacgaattcacgcagctgcacgtcgacggagtctggcagcggcggaaccggattgttgacatgtgctgcggcgatgtcgactggcgtggcacccgtgaacggacgatgcccgcacaggccctcgtaggcgacgatgccaagcgaatagatatcggattgaggcgtggcatgctggccctgcgcctgctccggggaaatgtactgtgcggtgcccaccaccatgccgtcctgcgtgatctgctcctgattggtggagtaggagacgccgaaatcggtgattttcacctcgccggaatcggacaccatgatgttcgcaggcttcacgtcgcggtggatcacgccatgcgaatgcgcgacgaacaggccacgcgcggtctggatgagaatcggcagcagacgggtcggctccatcgggccgttctgctcgtggaacaggtcggccagcgacttgctgggcacgtactccataacgaggaagccgatgccgtcatgttcgtaatattcgaacaacgcagcgatattcgggtgtgcaagattggcggaattatgcgcttccgcacgcaggcgaagcagcttggcctcctgcgtgacgcccaagtcgccgcgcaacgccttaatggccacgggacgacccaactggatatcatagcctttccatacttcgcccatgccaccctgggccagacgggcatccaacctgtagcgtcggtggatgagctgtccttcaatcagtttcactctgccagcgcctcctgcatcatcgccttcataatcggacccgccgcgaacgagccatacaaatccacattgtgcaccaccacggcaacagcgatcttcggatcgtccgccggggcgaagccgaccacccagccgtcgatggacgtattgccgtcaccgatctgcgcggtgccggttttcgcagccacctgcacgccgtcgatggccagattcgggttctccttggtgaccaccgcctccatcatctgcgtgagcttgttggcggtgcccgaactgaacgcgcggctcatcacctgcggcttggtctgcgaaataacagacaggtcggaggaacgcacgcgatccaccagcgtcggctgcatgaccttgcccccgttcgccacggtggccgccaccagcgcgttctgcagcggagtcaccacggtgtctccttggccgatggacgccaaagcgagcttgtcgtcggtcgtgtcggtcgggaacttcgacgccacgctcatccacggcgtgcccgtggaatcggatccgtcaaccgtgatcggactgtcgaaaccaagcttcttggccatggacgacaccttgtcatcgcctaaagccacgcccagctgggcgaacgcggtgttcgacgaatacgccatcgcgtcttccaacgtgatcttgccgtccgaaccgtcggcctgcgacaccgcgttcgtcaactgtgtgaccgtgcccggaagcgtgtagctcgatccggccggaatctcggtgtcggtctggtattcgccagtttccagcgcggccgccgccaccaccgttttgaacgtggatcccggaggatacagctgcgaggtggcacggttgagcatcggattcgactcgtcttgcgaaagcgtggaataattgccgttcgcttcggacgtgtcgtggctcgccagctggttcgggtcgtagcttggcgtgcttgccatggcgagaatacgaccggttttcacttcgatggccacggccgcgccgtcattgttggcaagaccgttgtaggcggcctgctggattttcggatcaatggacgtttcgatggtcgcgcccttgttttcctggccggtgaacagcgatttgaaccgctgccataccagctggtcggattggcccgacagcagcgagctacgcgacgcttcgataccgttccagccgcgttggctgatcgagaagaagccggtgaccggcgcgtacagttcgccggcggtataggaacgctggtaggagaacgcgtcgttcgaagggtcggatttggcgatgacggagccgtccgaagcgaggatcgcaccgcgcggagcgccatactcgtggtagagggcgcgggtgttgcgcgggtcgttgttgagctggttcgcgcgaatcgccgtgatgatggtggtggacatgcccaggatgacgaacagcgccaccacgatggtgaagagttggcggagtgacttattcatgcttggctcccctctgacatgctgtccgatacgttcggagtgcccgatgggggagcgggtggtacgactggcgtgcctgaaaccggcgtctccgtggagatgatttcagtggcctgcgcggaggcctgcgcggaggccacgcttctgcgggcgcggctctgcttgcgggcgcgcagcgcctgcatcgcctcatattggaacgtgtcgctatcgatatcggattcgggtttgttcgccgagttggaaatcaccactaggagtgctgccaacatgtaattcgctatgagtgaggatccgccggcggccatgtacggaagagtcaaacccgtaagtgggatgactaacgtgatgcctcccaccacggtgaacacctggaaggccatggtgaacacgaggcccgatgcgagaagcttgccgaacccatccttgattttcatcgcagtgatcatcccggcggcgatgatgagcagatagagcatcagaatggccatcagaccggtgaggcccagctcttcgccaagtgccgcgtagatgtagtcggagttggcgatcggagtgagcgacgggtgaccttgcccaaggccggtgcccatcaagccgcctgatgccaggccgaaaatacccgtgacgagctggtaggatccgccgtactccttgttgtactgcgccgagtcgaacgggtgcagccaggcgtcgacgcgcgcgccgacatggctgaaaatattggccgcggcgaacgcgcccacggcgaacgcgatgaaaccaatcacaatccaactggtgcgccccgtggccacgtacaacatggacacgaacatggcgaagaacatcaacgacgtgcccaaatcatgctgcacgaccagcacgcccatcgacacgatccacaccacgatgataggcccaagatccttgatgcgcggcagctgcaggcccagcaccttcttgccaccgaccgccagctgatcgcggtggtcatacaggtaggaggcgaagaaaaacgcgaggaacagcttcgcgaactcgcttggctggaacgatcccaaaccgggaatcttcacccaaatgcgcgcgccatactgttcggaaccgatcaccggaagcatcggtgacagcagcaacaccaaaccgatcaccatgctgacgtacgagaaccgcctcagcacacggtaatccttcatgaagatcaccagcagattcgccaaaaccagcgctatcgacagccaaagcaactgtttgaacgcgacggacgtgttcgaatcctggtcgatgcgggcgatcatcatgatgccggtgccagtcagcaccatcacacaacacatgatcgcctggttggcatacggctggaaacgcagcggcaatccccaggaagtcaggaacaatgcgccgacaaaagcgagcatccacaaataattctgcggaaaaccgccggtggtgcgttcgaacatctggaagaacgcgacgccgcaaatcagcatgctgaacagcagcaggccgaattgcttcagacgggttgccatcatgactggtcaccgcctgacttgtttgccgaagcgtcgtccgatttgtctgatttgcccgacgacttgtcggaagtcgtaccagaggatttgttgtcggattcgccgtttgccttgtcttgttccttctgcgcggcttcgtcctgctgttgcttcagctgctttttgatcagtcgcgtatgcgttttcgcctcgccgtacgtgtcgaaggaaatgccctgcgcaagctgttcctgccagcttggcggcagttcgctcgtcttcatatgggtgtcggtgacggcgtgcgacagctggaagccgaacaggcttgtcggcacgccttggaaaatcgccacttcgccgttgtcgtcgccgatgtagtacttggtttggctccaacggtaggttgcgaacgcgccgcccgccagtcccagcagtaccacgatggtgacgatgatggcgatcacacggttgcgtcgggtgcgcgtgcgcttcgttttgcgctgctcgatatgctcgttgcggatggctttggcgacttccggatcgttcggatcggcggaaatgcggccgtcgtccttctgtacgacggggatttcaccggtgtcgggattggtgcggtcgccgttctcctcgcgtaccgtggacggttgcgccacgcgctgttccggaggattgtcgtcctcgttgggattcttgccgttgcgcagtgcggcggcacgggcggccggcgacttcttgccctcgcgcagtgcgggagcggatgcgaccggctcgttgatgatgtcggcgatcggctcaaggcttgcgctggccgcgccgccaaccaatggcgtctgatgcggcagatcgaacgcgtccgcgtcaagggcgagcgtcgcgtcggcgatgaccgcggtgacgttgtcggtgctgccggcacgaagcgccatcgaaaccagctgttgcgcgcactcctcctgatcggagcaggcggacagcacctcctgcaatgtggaatcctcaagcacgccgcacaaaccgtcggagcagagcagccagcggtcggccggatgtgccttgcgtatggcgatgtccggactcgaatcgatatcgaaatcacccagaacgcgcatcacgacgttgcgctgcggatggttgcgcgcctcggcctcgctgatgcggccggtgtcgatcagatgctgcacgtagctgtggtcggacgtcatgcggatcagacggccgtcatgcagcagatatgcgcgggaatcgccgatatgcgccaaaacccaatatccggccaccaatgcgaccgacgtgacggtggtgcccatgcccgcgagacgacgttcgcgcttcgctttgccaacgatcgcgtcatgcgcggccataaccgaggtttccatcatgtgggcgataatctggacatcgccctgcacgttgtcttgctcgatatgcgccaatgaacggatggcgatggtggaggcggtgtcgcctcccgcatggcctcccatgccatcgcagatggcgatcagatgctcgccggcgaacgcggaatcctggttgttggaacgtacggtacccacatcggaaacgacggtggaatacatgaacagcggttgtgaagcgggagaagtcggcaaacgggtcacctcaattcaaaggtggttgcgccaatgcgtacgggaacgcgcgatccgagaatcatcggagcgttcagacgctgctggttgaccacagtgccgttggtggaacccaggtcttcgatggcccacttgccggtggcgggatccgtatagacgcgcgcatggtgggacgagacgaattcgtcgtccagaaccacggtgttcgaagcggaacggccaagcgtgatggtgttgccggacaaagggacggaactgccggcaagggggccatcgatgatgaccagcaaggtgggtttggcgcttgatgtggcgctgacgactggtgccgggacggccacgggcgcgggcgcttcgacggccttgcgcgcgcgacgctccttacggcgatgagcccgcgacttgcgcgggctgagcgtttccacatccctgtacagcgaacgcaccgtacaggccacgaagatccagagcagtacgaggaagccgtacttgaggatcgcgaaagtaagttcagtgagcatagaggcaactcccgaggttggggttggttactcctgatcctgcgaagaggcccaatacaggattcgggtgcggccgatggtgatcgtgttgccgtcgagcaacgtggccgcctcgacatgatggccttcgacatacatgccgttggtggagcccagatcgcgtgcgatgacggtgttgccgttgtcggtgatgtcgatctgcatgtggcggcgggagatgcccggatcgtcgatcacgatatcgcagtcggatccgcggccgatgatggtcttgctttccgtgagcagatactggtgttcgccgatttccagcatcgggcagtcttcggtctgcgcgtcggtggtgacgggcacggtattgccttgcacggattcgctcgtcagcttgaaattgctcttggtgaggtcaaggtcctcttcgaagatcaccacgaccggaccgacgaacgcgtaatgctggtccttcgcgtactgggtgaggttgtcggccagctcattggccaacgcttccgcgccccattcgacgatgttgttgaaatccggcgtgctcagcttgaaacggtactcattcggcgccacggtacggtctcgcgtgacgggcatggcctctttgtcaatctcacgttccagagcgctggaaaggtcgacgggctgcaggtccttggacccgaacttggcgaaaaccccgttgacggcgccttccacgcttttctcaaatcggtcgagaacactcatgcttgtccctttctatcctcacccatcctacgcggtagagcgccgagcgccaattcgtaagtcctttaattgcaaaaaattcatgcataaatccatccccagcatcatttagggggtatttatccgcgaatatgactaccttcgcccccgatttccacgatgcacgaattcacggaaagtggaattgggatggtgctaggttgggagcatgacagatgcgattcgacagttcccccgtaaaaaagcacgtaccttgcgattttcctgcggcgctccgcgttcggcgcgcgtgattgcagacggctcccgcgcgctgttcctgcgttccgacggtccggaagacaccgtcacctcgctgtggatgagcgtgatcgacgaagacggcaacatcggtgagattccgctcgccgatccgcgcgtattgcttgccgacgccgacgcggaagacgttccggcggaagagaaggcgcgacgcgaacgtgcgcgcgaaggcggatccggcatcgtctcgtattgcgtcgacggtgccggcaaccgcgtgaccttcaccatcaacgggcagcttttcctcaccgaccttacggcgggcgcgacgcgagccatcacgatagaggaagatgaactcaaaccggtgctgaacccgcgcatcagtcccgacggacggcacatcatgtacaccaccggcacgtatctggtggacgtggatcttgccaacgatgaagaaaccggcgacgcgatttcggtggtcgcctcggcaccgcagaacggcgaatggaaaatcggattggcggaattcgccgcaggcgaagaaatggaccgctacgacggcttctggtggtcacccgactccaaatacgtgctcttcgaaacctacgacgaatcccccgaaccgatctggcatctgtcggaccccgcgaatccaaccaatccggcgcaagccaaccgctatccgcaagcgttgaccgccaatgccgacgtgcggctgaccctgctggaactcggctacgacagcgacaactgctgctacggggcaatcgccaacgaagtgcagtgggaccatgaatcctacgaatatctggccgccgtaagctggagtgaaggccacgatccgatcatccttgtgcaagaccgcctccagcagcacgatcaggtgctcgccatccatgtaggcgagccgatcgccaccatgcgtgacgcggaaaacggcttcaccgacgacaatggcgacgaggtcgaaaccttctccatcgccattcccgaatacgcggaaggcgaacgccccggcaccacgcgcgtgcttgaggaacacggcaacgactactggctcgacctcatccacggcacccctgcattcactccggatggacgcttgatctgcgcgatgaacgacatggacgtcgatacgaaccgactcaccgttgatggtacgcccttcactccggccggactgcaggtgcgcgaagtgctcgacgtgaccgacgacgacgtgctgtgcgtggtgcagcgcacccctgaaatcctgcctgaaagcgacctgccgttcctctggcagtcgaatgcctccgaccatgacgcccgcagcttcgacgtggtgtcgatccgctatgacggcacatgggaacccctcacctacgcgcccggccagtggagcatgtctcgcgccggcaacggctgcgtggtgaccggacggggcatggacgacgcaaccgtgcaaatgcagcattgcatgaacatcgccacaaccgacgaaaatggtacggacgtggcgtcaatggtggtcgcaccaatcgaaaaccatgccgaaacccccggattcacgccgaacgtgcacttcacccgactcggcgaacgtgagctgtacacggcgatcgtgctgccctcatccgatagtgaatacgcgcacgaagccatcctgccggtactcatgaaaccctacggaggccccggcttccaacaggtcatcgaaagtcaatccttctattgggacgcgcaatggtgggccgaccaaggctacatcgtggtcaccaccgacggacgcggcaccaccggacgcggcccgcaatgggaccgcgccatctacgaaaccatgaaatccgtaacgctcgaagaccagatcgacgccgtgcgcgcgttgccggaagcgttggaagcgctggctggcgagaatgcggcagccaacgttccgcaacccgatctcagccgcgtcgccatgatcggctggtcgtacggcggattcctctccgcgctcgccgtgttggaggcgccggaaacgttcgccgcggcctgcgcgggcgcgcctccgaccgactggacgctgtacgacacgcattacaccgaacgctatctcggccttgactcggccgtgtacgaacgcaacagcatcatcgccgacgcgccgcagcttgatcgcccgctcatgctcatccacgggttcgccgacgacaatgtgacgatcgcgcacagcctgcgcctgagccaggcgctgatggcaaccggacgtaagcacacgttcctgccgctgaccggcatcacgcacatgaccaacgacgagacggttgccgaaaatctgctgatcctgcagcgcgatttccttgcggaagcgttggggtgacggcaccgtgacgacagtgcagtaacggtaacggcaacatcgcaaacgaaagtgctgcaaagcgccgtaggaagacaaaacgcgttcccctgcgattcccggactgccaagcatccgaacgtcgtgggcgaacgcgttcccttctcgaatgccaacataaaacaggcgaaaacgacttcgcaagcgagggggtaccacatttgtgtacccccccccaaaaaaaatctgggcttgaaaaagacggaaatcggtggatcgggctcgtcctaaccctgatccgcagctatggtcaaacctgcacttgttcaagcaaaccgggcgaatcgtcgatgacggtcaccggaatgtacgcaaacaacgtccaactgccgtcctgcgcagacgtggtgagcgtgccctgatacgattcgagctgcttcttgaacgaggcgagcccgtggccgcccggtagttcgtcatcgcgctcgtcagctccagccatgtcctctttcatgggattgatttgcgtgatttcgatggcattcggccggagcatcaccgaaagatcgaccttgcttcccggagcggcatggcgtgcgatattcgcatagatctcgcgcagcagattattggcaagttcggcgattgcttgcgatgcgctcggcttgccgcccgcgcagtgccggatggacgtgatattgaagccaagcttgcgcaagcgacgatcgccgtcatccagtgttgctcgcagcagattggccaacgcttcgccgtcggcgtcgccggggagagtggtggcgtccatattcaattcgtcgatgacgcgatgcacgttcgtcaatgcggaaagaatatattcgttgatttgacgccagtcttcggcatcggctgttgcggttgccgtagttgtggttgcgttggcagggtcagcagcgacgccaggactgctagagttgccaccgatatgccgttgcgctacaaacgtcgccgctgacaaatcgcccgtcaccgcatcgtgaatggcatcggcaatgcgtgcgcggctttccaattcctgcagacgattcttgttctgcgccgcttcgaagcttttctgcgttgttttttcgctccaactcaacgcccgaccaagcagtagcaccatggcatacatgctgaccatggcgacggggttggtatttgggccaggggggtcaatcagcagaatgttaacaacgtaatatgtgagtaacgttgccacgataatggcattagtgctgtatgcgagcatgccataggcgtaaagctgcgcgggaagagaatttcccaaatgcgcgtagggagtaaacagatcgcctatggaggcaatcacgagaatcgccaccgatgtacttttcagaaacagcggagacggtacgagcgccgtaaccagcatcgcaacccatatcacgccaaatatgtcggtaggaggctcgtagcaaacgccgtatatggtccatgcaagcacgatcagcataatggcgaaacggattggatgccacaggttcggatgctgcgtgcgcatacggttgcgccacgcaatgtactgagttgcgggtttagagcgcattggacctcacccacagtgccactgcctgacgcgaggtcttgcagttaagttttcttaaaatactttgcatatgtttgcggatggtggcttcggaaatccccaaatgctcggcgatgtcccggtcaagcatgccctccgcgcacaaggaaataatctgctcctcacgaacggtaagcgcgggagtggtatcagcctccctgctgatacgcagattggccaacgcaggcggctcaaatccctccatcacctcgccattgcacatacgcataataatctgcgccaactggtcggcattctccttaccaaccaacccttgcgcaccagcctcaaccagcttgtcccgataactattgatggaaaaactggttgcaccgagaatcggcatgcgctggcccatcaaacgcaaccgatgacacgtggcggggccttgcaatccctccatcgacatatcgagaatcaataagctgacatggccgttcgcatcctggcagcgctctatggcctcaccgcctgaagtcgccgtccacaccacatacgcggtcggcactttgctggcaatgacggcactgagcgaatccaacgctcgcggatcattgtcgaccagcgcgatgcgatgaatcttaggatgcttttccgacgtggtcattatgcgatcactttcctttcccacacagccattgcagccatgttgggcagttggaatctttggcagcggagatatcaccgttgttgtcaacgggagttgccgccgcgtgcgcatacgttggtgtgccggtgagagacagcgttactaccatcagcagtgaaacgaacttcatacctccatagtatgcgaggatggcgcgcgggggtgacgattcggttgttccggtacgccgttgatgcactgacgcatcgctatacagcgcacatgcttgtgcttggttttgtcttggctttgttcgcctaagatggaatttatgactatcacgctcatcgatgaggcgcgttacgacgccgaaatggacgaaacggtactgcctgcgctgcgtaactgcatgacggaaggctggatggaacctgccaccgttgattgggacgataatatgctgcctaagctggagcatcctggacggttacattactactgctacgacgcgcacaaattcgacgcattacgtgaagacggcgcatcgggcgtattccgcggtgcggtggtgatttcgcacggattcaccgaattcggtcgcaaatacagcgaaatggtgtggtacttcctactggccggctactccgtatgcgtgttcgaacatcgcgggcatggccattccacgcacgacatgagcaacccgagcttggtgtggatcgacgattggcgccggtatgtggccgatttcgccacattcgcgcagaccgtgggacgtgagacggccggtgatggcccgatgtacttgtactgccattccatgggcggcggcatcggcgcggctgtgctggaacgctacccgtcgctgttcgacaaggcggtcctgtccgcgccgatgatcgcgccggtggttggcatgccaacgtggatcgcgcgcattgtggtcggcgtaatctgcgggcttggcttcggcaaatcacgcgtgttcgggcatgccgattttgacggcaatctcaatctcgacgattaccacggggcttccgaagcgcgcatccgctggttccacaagcagcgcttggccgacaaatcatgccagaccaacgcggccacgttcgattgggcaaaccaggcgatggcgctttcccgagccgtgctcaaacccgatatgtgtggagctatcgaatccccggtattgctgtttcaagccggacgcgacgtgtgggtgctcaacggaccacaagatgacttcgtcgaacgcgtgagcgaaggcggcggcttcatcgaaaaagtgcgatacagccagtcattgcacgaaattttctccatgccaaatgccgtgttcggaccatatctcgacaaaatcctcgattttttggcggcgtcgaacgcaagcttggcggaataaatctgttttgcataactgacgtttagtatgcgcactgtgtgcgttacaatcgccgtgaatttgccgtgaaagccgtggagagagagcgaggataggccgtggcaaagcaaacgtcgggacagacgtcgcaatcgcagaaaacttccgaatcgcaaaaaaccgcgaaaaaaaccgcgaaaaaaacggaacatatgctggagcagacgccgaaaagtctactcatcggcactggcatgacactgctgggcggtgccatgtggggtatgaacagcaccgtggccaaactgctgatgcgtgactaccagctggatccgatctggctttcctgcgtacgcgcgctattcgccagcctgatcttcctggtcggatcggccatcaccacaccgcagaaactcgccggagcggtcaaagacgtcaaatcgtatccgaaatatttggtcaccacactgatctgcgtgcttctggtgcaggtctcctacctgatgaccatcgactggacgaactccggaaccgccaccgtattgcagacgctcaacctgatcttcgtgctcgcctgggtatgcctgcgcggcaaacgactgcccctcaagcgtgaattggtcggcgtgcttctggcgttcgcaggcacgttcctcatcgccaccggtggcaacttcgcctcgctgtcgctgccatggcaggggctcgcatggggactggttgacgcggtgagcaccgcggccatgtccatcctgccggtcatgctcatgctcaaatggggcaacatgaccatcaacggcatcacattcctcatgtccggactcatattgtgcccgttcgcgcaaccgtgggcgaacattcccgcactggacgcgcgaggtatgctcctgctgctctataccatcgtatgcggcacgttcctcgcgttctggctctacatggcaggcgtgatgcgcgttggcgcggtgcgtgccaccatgctcggcaccagcgaaccggtcatggccaccgtcaccgcagtggcatgggctggcgaagcgttcaccttcaccgacctgaccggcttcgccatgatcatcattatggtcttcctcgtgcgctaaccattctccacaaactgtccgattctggagaatcggacaactgtagagtgtttggcctagtctggttgtccgtttctccagaatcagacatgcacggcacaagagaaggaagtactacttggcgtacacggagatggctcgcccacgtgcgcggcctgctcggcctcatccaccacggcgatcgcgtaatccgcgtagctgatgtagctctgcccggcggcattgacggtgaactcctcaccggcgagtccgtactccgtgcaatccgccgaaacaaccaatgacagatgaaagggattcggcatcctggagcattcctgccggaaatgttgggagctgctgagtcctactgctgcttggaaaacgaaaaggccggaacctttcggctccggcctttcatcatggtgcgagcggggggagttgaacccccacgagcatacactcactgccacctgaagacagcgcgtctaccattccgccacgctcgcagacagtgagctaatctacaccaaaacccacacaacctcaaatcggcgtgtcgcgccgccattttccgtaggaaaattcaagcggcgcgacgcgaggagggaggaagctctgggagcttccgtacgacggagccatccttaaattccgccattttccataggaaaattcaagcggcgcgacacggctcgtccgattctgacgtttcggacattcgacgaatgttttagggcgcttgcttgtccgattctccagaatcggacaaccgggaggggcggtatgggcattagatgtctgattctggagaaacggacacatggggtggtggatggggcgagacggctgggtgtacgcatgacacgcgcgacacgcatgaaaaaagacgccgacgggtctgttcgtcgacgccttggaacgcggaagtgtggctcagcattcgtttgggcggaaggcccaagtgaaatgcattatccgcgggatccgttggcgtagaagcgggtcagggtttcgtcgcggaattcgttgaaatagccgccgtcgatcgatgcgcggatatcgtccagcagcttcacgaagaaatgctcgttatggatcgtggccaatgtgaaaccgttgaattcgcgggctcgcaacgcatgatccacgtaagcacgcgaataatgcgtgcacgtgtagcaatcgcagccctcttcaagcgggccaaaatcatgcttgaattgcgcgcgcttgatgttgtaacgtccgccgcgcgtgaaaatcgcgccatttcggccgcaacgcgccggagcgacgcaatcgaacgtgtctccaccattctcgacacatgcgaaaatatcgtcgactgcggcgatgccgagcacgtggcgcggtcggctttccggcatcgcatcgcaaatccaagcgcaagtgtcgccgataatgcgcttctcgatcgcgcctccgataccgacgccgtcgaagtccaacgaagcgatctgttcggccgcatgcctgcgcaaatcctcataattcgcgccctgcaccacgccatacagcgcctgatacggcttgccgacgcgctcttcggtaagtctcttatgctcggcaacgcaacgctgcgcccaacggtaggtgcgttccacggaacgctcctggtagccgcgcgtgttcatcagtgtggtcagctcatcgaacgcgaacatgatgtcggcgccgatcttatgttggattcccattgaaatttcggcggaaaaacggtgcagtgagccgttgagcggcgatttgaacgttacaccgtcctcgtccacgaacgcgagacgctccttgccttcggcgatcacgtcgtctgatttcatgccggtcacgtccatggcgagggttttcttgaagcctgcgccgagcgaaagcacttggaaaccgccggaatcggtgaaggtcggaccgttccagttcatgaatttggcaaggccgccggcttcgtcgagcacttgctcgccggggcgttcatacaggtgaaacgcgttggacagcaggcattgcgcgccgaggtccttcatggtttcgggcagaacggctttcatcgcggcctgcgtggccacgggcacgaacgctggagtgtgaatatcgccgtggggggtatggatgatgccggtgcggccgtatcgtgcgccgcctcgtcccttgccgtcggctgcgtcgggaagacgggttttctgctcgaaatagaaggcgtcgcgtcggcccggcttgcctggttccgctccacgcggatgttcgatgagattttcggacactgcggttgccgcgttttgcgtgtcttgcgctgtgtcggtagatgattcggtaaggcttgtcatgcggaatattttatgcgatagcggcgattcttgaaagtgctgcaaagaatgcgatcggtgaaatgaaaacaaggaagatgtggaaagtgcgatgaaggtgccgatcgcattttggtgcgattttcagattcaatggtgatgttgaacgtatttggctgctactttcaacaaacattcaggaaacttccagagcgagtatctttactcatagatagcagttcgagcggcacgattgctgatttgtgaaatgccgcgagacgaataaggagcgaaaatggctgaagagaacgaccagaacgccgtgcagccgcagaatgacgaacaacagaccgtgccgatgccgccggttgatgcggaacagacgcaaacttacgcaggtgagccgtatgctgcagagtcggctaccgaaccgattgacgtgcagggcggtattgaggatcagccgacggccgccatgcctgttgcgaacgatggcgcttcggcggaatccgcggctgcggcgggcgatacgccggattatgcttccgcggcggacgaacgtaccgtggttggcggttccacgcaggatgcgccggcccagcagtaccgtccggcaccggaatatggtgcgtacggtcccgtgccgacgcagccggctgatggcaccgcagccgcgaacgatactgcgaatggtgcgccgaacatacccccgcagccgcaatatggcgcgtacgggcaggctccgcagcagccgcagcggcctcgcaatcctttcttcggaaatccgtatgtgggtggaaatcagcagaacgatcagcagaacgcgcaatcgaataacggcaatccattcatgaagcccgctgcgcaaggcggtgccaacgtgccgccagcagcgccgaatactcccaataacggcaacccgtttgggaatccgaataacggtaatccgttcggtgccccgcagcagaatggcgcagcaaccaagccgaagtccgcttccggcgtgaccgggcatgtgatgaccggcgtggtggcggccctcgtctccgcggcattgtgcctcggcgtcggctacgcggcaatcaccaatggatgggtgaccgtacccacctccagctcactgaccagcgtgaagtccaacacgtccggatccggttcggcgaaagccaaatccggcgaggccgcggactggagcgcggtggcgaaagaagtgtccgattctgtggtgtccattgacgtggcaaccagcgacggcagcgccaaaggctccggtgcaatcatcagcgacaaaggctacattgtcaccaacaaccatgtgatttccggcgcgaagcagattcaagtgacgctcgccaacggcaccatctactcagcgcaaatcgtcggcaccgacaccaccaccgatctggccgtaatcaaactcgacaatccgccgagcaatctgaaagccgcggaatttgccgattccgacaatcttgccgtgggtgaatccgtgatggccatcggcaatccgctcggctacgatgacaccgcaaccgtcggcatcgtttccgcgctcaaccgcccggtgaccgtgtccgatgacaacaacaacgacatcgtcaccaacgccgtgcagattgacgcggccgtcaacccaggtaattccggcggtccgaccttcaatgcggccggccaggtgattggcatcaactcatccatcgcatccaccacaacgtcttccggcaccgccggatccatcggcatcggcttcgccattccgtcgaacctggtaaagcgtgtggctaacgagatcatcgacaacggcaccgtgcagcatgtggcgctcggcgtcaccatcaagagctccacggttgaggcggacggcgtgacccgcggttgcacgcaggtgcagtccgtggtcgacaacagcccggcggccaaggccggagtgaaggccggcgactccatcgtggcgttcaacggcaaggcggtgaacaacaactattcgctgctcggctacgtgcgcgcctccgccatgaacgacaaggtgacattgacggtcgtgcgcgacggcaacaccatggagcttgacgtgacactcgaccaggaggaatcccaaacgaactccgccaacagccagaaccagcggaacaacggcaatgatggccagagccagaacggcaatggcaacggttacggtaatgacggcaatggcaacggaaatggacagagcgacggcaacggcagcaacggctacggtgacggtggcggcctgttcgacccgttcggcctgtggtaaagcgagatgttgatgcggtgcgtgaattgacggacgcaagttgttgcggtgcgcaagtcaagactgttgggctggctaaaacgtttcgcgacatgcgaacggacggaagccacccgataggctgacggcgaagacgcggctggcaccacgaaatcgcaagtacaacgaaaaccgcgaaaatcaacaaaaagcaaaccaaaagaagaatgcaataagggctgtgtgagcaatcgcacagcccttattgctgtattgcggcacaaaaatcgcaaatatttgctatgctgaaaatatctttttacgccgtgtatcgatggctcgcgcgggcgaggcgccgatgggttaacaaggcgtccgatacgagcgtaaggagattctcatgcgtagaatcatcgatatttgctggcgactgtgcaaacaggttccgttactgccgattaccattctgtccgcgattccgttggcattgctgggggagtggaagccgtggggcgaggctgcgtgggattcgtggatttcgcaagtcggcgttgacgggttgagtgcgttcaatccgggcgttgggcagtggattgtgatcgcgttggttgcgtacacgattgtggtgacggtacgcggcatgatcgacgatctgcggcacgggcatgttggcgtcgatctgctggcggtcgtcgcgattgcgtcgacggtcgcagtgcaggaatattgggccgcatgggccgtggtgctgatgatctcgtcaggcgaggcgatcgaggaatttgcgcagtcaaaggccgaaagcaacctgaccgcgctgatcgacgcggcaccgcgaaccgcgcacgtggtcgtgctgcccggtatgcgggggcatgtgcacgcgtcgggcagcgagcatacggccgacgtgaccgccgacggatttcgtactgtcagagtgtccgattctggagaaacggacaaccaagacggtgaaaagcgtgcttttgcgtctgaatctccagaaacggacacaaaaggtgcttcgcaaacgtatgatgcggctggagagcgtttcgaaacggtccccgttgatcaggtacagctcggcgacgtgatcctggtgttgcccggcgaaacggtgccggtcgacggtgagctgctgtcgggcgtggccacgttggacctaagcaacatcaacggcgagcccgttccccgcgaagtatatgcgggcgctcgcgtgatgtccggtgcggtcaatggctccacaacattgaccatgcgcgccacgcaacttgcgcacgattcgcaataccagaagatcctggagctggtctcgtcggcgcaagagtcgcgccccgctgtcgtgaagaccgcggatatgcttgcagtgccgtttaccgtgctttcgcttgcgattgctgggattgcatgggtggtttccggattgccgctgcgatttgcgcaggtgctggttctcgccactccttgcccgctgctgattgccgcgccggttgcgtatgtggctggaacagggcgccttgccaaagcgggaatcctgattaaagcacaggacgtgttggaaaatctaggtcgtgtatcgcatattttcttcgataaaaccggcacgcttaccgtcaagcaaccgcaggtcgtgcgcgtggagaaaccgttcggaacgagttcgccgttcaatgaagaccatattctcatgatggccggtgtggtggaaagttactcggtgcacattctgtcgaaaggtattgcggcggccgggcgcaaggctatggacgacttgtatgcgcgatatgcgtcggggcagcggttatgcgctgagcgtgatttgcctgggcatgggcgcgactatccggtggtgaagaacattgtggaggattcaggtaaaggtgtttccggcgaagtgaacgggcaccgggtgcgtgtggggcgttttgcgtatgcgacggccgacgaatccggattcatgccggtgttgcatatgccgaatgcaacgtatcacgtgtccgattctccagaatcggacaaccagacgggtgaaatgtacgcgaggatgtccgattctccagaaacggacatccaaaggactgaaatgcgtgcgtatgtgtccgattctccagaatcggacactcttggaacgcgaggtggagtgtctggcgagggacggtccacggttgtagccccatccgtgtccgtcgcagccgcgcagactgcatccgcccgcaagcctgaaaccgtcggctcgctgtttgccccgctcgcgcctgacgaaatggccgcatacgtggcgatcgacggcaaactggccgcccgcatcgtgcttcgcgacgtgccccgtgcgaatacgaaacgttccttggcccgtctgcatgagctcggcatcaaggaactgtccatgcttaccggcgacaaggccgcatccgcccgcatcatcgcaaacgaggtcggtatcgatgacgtgcaatccgagctgttccctgaagacaaggttgccgccgttaagaacgccaccgaatccatgcgtcaaaaccagtctatgcccgcccgcatcatacagcgtataaccggcgaatccaagaatcgccaagttaccatgatggtcggcgacggcgtcaacgatgcccccgtacttgcggtcgccgacattggcatggccatgaccgacggcacgtccactgcggcttccgaatccgcgcaggtggtcatcatgaatgatgacatcgcctctgtgccgcgtgccatcgccatcgcacgtcgtacgaagaacgtgatgcttcaggcggtgttgatcggcctcggcctcgccatcatcggcatggtcgcggccgcattcaacttgattcccgtggttgttggcgcattcatgcaggaggtgatcgacgtggtcagcattctgtgggcgctcaccgtgcttttcgaccgcggcgaatccgcctgatttgcgaggagaggtgtcatgcgcggcgctttggggaagcgtttacaacgagcttggcgagatttctccagcgatcgatacgcgcatccacttgccaaagtcgactctggtcacgccttgcgacagcaggaacatgattttcgcatacgtggcttccagcgtcatatcaccggatccgatcgcgccggcgcgagcgatcgcatcgcccgtctcgtaatggccgagcagtacttccgcctgctggcattgcgacgcgatcacaacgggaacgccgtcatgcagcacgtcggcaattacgtcggtcaatcccggttcgtcgctcggcacattgccgacgccgtacgcgcgcaacaataccgcttccggacgcggtgtaagcatcgcttccaatcgcgctgcggaaatgccgggcgccatatcaatcacggcaacatcatgacgggagtaaggttgaggtgacgtccagccgtaaccggccgaagcggcgtcacccgcataccaatgccatggcgtgcccgtacgagccagtggtccgacggaaggcgccgaaaatccttcaaacgcccaactcgacgacttgctcacgcgattgccggcaaacaggtgatgtccaaaaaacagtcccacaccgtggaatcgtccgctcatcgcggcgttcagcgcgcccgtgacattcgcagtggcatccgattcgattttgccgagcggatgttgcgagcccgtgaaaatcaccggcttgccgaaatcggccaatgcgtacgaaagcgcggcgctcgaatagctcatcgtgtcggtgccatgcagcactacgaacgcgtcggcatcatcgtgatgcgcacgcaagtcatcaaccatcgtctgccaattgtcgggcgtcgcgttcgatgagtcgatcagcggatcaagttcggtgaacgtgaacaggcttgcgtccatgtgcgcgtcctccagcaggcggaacagccatccgcgagtgtcggcgcccggaatcagaccgttcggagagtcgatcatgccgatggtaccgccggtatatgtgatgtgaatgcgcattgccaccttcttacgattgcttggtacttgataagtacttgcttgcgattgcgggatgagtgaattccgatattccggattcctgcatcccgcgattgtgcgactacttgcgattgtacgtgcgtctgccgcgctcattgcgtgcgattaatgcagacgcacattgtattcatctggattcagcaatatctggttgaatccagatggcttgcgatttcgactacttgcccggcacttccgtggtttcaagcacgtcaggcacgtcgttgccattgttgtcgagcatttcgtccatcagatcgccgttgatgcggccacgcatgtagaaccagcctgcaaccatggcgatgaccaccactacgaacatggcgagcgtccaacggccggcggcgctggtgagattcgacagcacgacaactgcgaagaagataagcgaaatgtaattcgtgtatggagcgcccggcatgtggtagtcggggcgaatctcctcaccggtcttcaccttcttcaagaacgcaagatgtgtgacgagaatagccgcccatgttccggcaatgccgatgccggccagattcatgacgatctcaaacgcgtcggcaggaagtaccgcattcatcaccacgccgatcaggccaagagcagacgtgatgataatgccgccatacggcacatgatgcttgttcatgcgcgcggcgaacctcggacccgagccggccacagccagtgagcgcagcgtacggccagtggaatacaaaccagcgttcagggaggaaagcgccgcggtgagcaccacaacctgaatcacatctccggcatgcggaatgccaatgccggagaagaacgtgacgaacggagattcgttcgacgagtaagcggtgtatggcagcaccagcgccataagcactacggaacccacgtaaaacacgaaaatacggatgatcatcgaattaatagccttcggcagcaccttttcggcgtccttcgcctcacctgcagccacgccaaccatttcggtaccgccgaacgcgaacactacaccgagggtcagtgcgaacactggagcgataccattcgggaacaggccgccattgtcggtgatgttcgcgacaccggcatgcgcatcgccaaccggagcgcccgtgacaatcgcccaaatcgcaatgaccatgaacgagatgatcgtagccaccttgatagcagcgaaccagaattccgcctcaccgaacatcttcacgctcagcagattcaacacgaacaccaacgccaacgcgcacaaggcaatcagccattgaggcaccccctggaacgccttccaatagtggaaatatacggcgacggcggtgatgtcagccataaccgtgactgaccagtccaggaagaacagccagccggtcacatacgcgcccttctcgcccaggaattcgcgggcatatgaaacgaacgcgcccgacgacggacggcgaatcgcaagctcacccaacgcacgcaccatcaagaacgcgaaaatgccgcacaccgcgtatgcgatcgcaagacccgcgccaccttgcacaagacggccgcccgcacccaaaaacaggccggtgccaatggaaccgccaatcgcaatcatctgaatatgacgcggcttcaaatccttcgcataaccagcatcgcttttatcctgcttctgcgcggacgactgctgcgtcgcgtttgacgatgtattggagttactcatagtagtagttcttttctctgatttcttttattatttttgactgcacgtcgcaattttccggcggaagctgtttcgtgaaagcgggccgtatcaccgccattatcgctacctctgtgtggatgccgcgtacattatatggaccgtccgttaccgaacgttgatattttgcccatagtgcgtcagcagtcacggtccgtgcctttcgttcggtgcaaagatgtccgattctggagaaacgaacattcaaacatgcgttttgttgtcttgcttgtccgtttctggtgaatcggacaagcagatgcatgtttcggtatcccacgtgtccgattctgcagaatcggacatccaaaaacagaaaacgctgcgaatgggacgggcctaaaaatccaaagggcgaaaccagaagaaaacaaggcgaagaagtcgtaagaaagtacgtaagcacccctgttgcaaatgcagggaatgcattaggctagagcgcgtgactgaaactaatgaacttcgtattgctgtaatcggcgccggccctgcaggcgtctactcctccgacattttcctgcgccagttgaagaagctcggcgaggagcttggcctcggtactgccgcgcgcatcgacctgttcgaaaagctgccggtgccgttcggtctggtgcgctacggagtggcccccgaccacccgtccatcaaattcatcgcgtcggcgctcgaaaagacgctcgacaaccccgacatccacctgtattgcgacgtggaattcggcaaggacgtgaccctcgacgagctgcttgagcgttacgatgccgtgctgttcgccaccggtgccgttgaggacaagcctcttggactgccgggtgccgacctggatggcgtgtatggcgcagccaagtttgtggaatggtacgacggttatccgaccggcgctcgcgaatggccgcttgaagctgaggaagtcgccgtgatcggcggcggcaacgtggccatggatgtggcgcgcgaactcatgcgcaatgccgacgatctgaaggaacgcactgacattccagacaatgtgtacgagggcatcaaggcgaacaaggctcgcgtgctgcacctgttcatccgccgcggtgtggcgcaagccaagttctccgtacaggaattgcgtgagatggagaagctgccgggagtgcagctgatcattaacgaagacgatttcgatttggatgaagacacgattgaagaggccggcaaagacaagctgacccgtcagatggtcgaagagctgttcacgattcgtgagatggcggaagacatggaagatgacggtgacgtggattacgagggtaatacggctgatcgcaagtattatgtgcacttcaattccgcgccggtcgaagtgctgggcgaggacggcaaggtcgttggcattcgcgtggagaagaccgaaacgtcggctgacggcaagatgagccgtaccggcgagtttgaagagtatccggtgcaggccgtgtaccatgcgatcggctacaagccggccaccgcgccgggcatcgcgtacgacgagcgtcacgcgcatctggcgaacgcgaacggtgacggacgcatcaccacgaccgcttcggccgaggacggcgcgcaggtgcgtgaacgtctgtatgccaccggttgggcgaagcgtggcccggtcggactgattggctccaccaagtccgacgcgctgctcatcgtcaccaacatgctggaggatctgtccaaggcagccgaaggtggtcgtgtggcggcggaccgcgatccggaatccatcgaccgtctgctggcctcccgtggagtcaagccgatcgacttcgccggttggaagaaggtcgacgcgtacgaacgtgccgacggtgcgaaggaaggtcgcgagcataagaaggtcatcgacccggagcagatgcgcgccctggctcacgcctaaggtgggtgtttgaaacccagtctgataggtttcaggcttctttcatgcgtcttgggtgtccgattctggagaatcggacacccggggagaagctgaacgtgcgaacttccgcaactgcccctagtcctttccgcagcccagtctccagcgcatatccagcaaaaactcagactccgtttctacgctagtgaccatgaacggcaaattgcaggtgcatggccattgcaatggcttgaagacaacgctgttattcgcgttgatgtggggcgtcatcatgctcatttggtgggcgaccggtggcagccagcgcacacttggtatctacattctcatcggacttggctcaacgttcgcatcctactggttttccgacaaactcgcgatcgcatccatgcgtgcgcaggaagtcagcgagcaggaagcgccggtactgtacaaaatcgtgcgcgaactgtcggcaaaggcgggcaagcctatgccacgtatttatatcgccccaaccatgagtcccaatgcgttcgcaacgggacgcaatgaacgtcatgcggcggtctgctgcacacagggcattctgcagatgctcaacgaacgtgagattcgcggcgtgctcggtcatgagcttatgcacgtgtacaatcacgacatcctgacgtctgcaatcgcgtccgcaatggcgacggtcatttcgtatctaggctattcgctcatgtatttcggtggtggcaattcgcgcgatgatcgtaatgactcgtcttctaatggtcttggattgctgggtgtgctgttgagtacgattcttgcgccaattgccgcttcgcttattcagatggcgatttcgcgtacgcgagaatatgatgctgacgaagatggttccatgcttacggaagatccggaggcgctcgcgtccgcattgaataagatttcgaacggcgctgagacgatgccgatgcagaagactgctggtacgcagtcggttgctgcgatgatgattgcgaatccgttttctgcggaaggtttctccaagctgttttctacgcacccgccgacctcggatcgcattgcgcggctgatgcagatggggcaggagatgcgtcagcagggcgtgcagtccggatatttggccggtggctatgccacgagcggcgttgcggcggcggatattcggcaaggcggacgttctgcgatggctggtgccggtggtccgcaatttggaacgcagtatgggcccgggcatgattcgggcggctcggctggcagatattctcgcgactattcgcagcggccgcgcggctgagtctccgtgatattgcggaaaattggtatcgcatgtcggtctgtgtccgcatacgcatccgttgcgtgctaaactgaagtttcgtgcccaaaaggcacagccttgcggatgtagttcatcggtagaacgaaagcttcccaagctttagaggcgggttcgactcccgtcatccgctccattcgaaacccttggaatcgttggaattccaaggttttttctattgccgtaaaagacccgtgaagtcaacttcgcgccgcgcaactgtcggttgcgtcgcaaaatttggttgcgaatcgcaatgcaaccgaaagatggtggcgtggaacgcgacgcttatgacaagctgttgcttggcaatcgccaataatcgcaagtcgaggcgatatggaaactcgacgaaagggcggacatgagtttcaaagagaatctgcagtatctgcgcggttcgcgcaacatgacgcaggaacagctggcaatgctgctgggcgtttcccggcaggcaatttcgaaatgggagtccgagaaggcataccccgaaatggacaagctgctgatgctttgcgacatgttcggcgtgacgttggatgatttggtcatgggcgacgtgcgcgcgtcagcgggctgtgggggtgcgggacgcgtggacttggctgctgatacggatggtgtggccgcgtcggttggggtggctgatgctgctgttggcgcggttccgggggtaatcgggtttgcggcatcgcaggtcgcaggaatgtccgattctggtgaatcggacgtgagggatacgaatccgaatgtttgtgcgtccgtttctggtgaatcggacgcacaaggtgccaaaaccggtgttcaattgtccgtttctgcaggatcggacatgcggggtgggcggcaggtaggctggaatccgtgaatacggatcagaaacttcccgccgaatccgcaggcgaacgccccagtaaccccctatttggccatgccatatcacacgcggcgacactcatcggcctgttcgcaatcgtcctgtggggcttcatggccggcctcgtgcgactcgtttccgaatcgttcggcgccacgctcggctcggcgctcatctacactgtcggcggcatgctcctgctcatcgtgcgacggccgaaaccgattagccaagcgccacgcaagtacctcgtcgcaggcggactcatgttcatcgcatacgaggcgtcgatctcgctgtcgatcggtctggccacaacgaacgcgcaatctgtggaagtcagcctcgtcaattatttgtggccgacgctgctggtactgatgaccgccgccgtgtcgcacaaacgcggctcggtctccgaagcgctgccgggtgcaatcgtagccaccgtcggcgtggcaatggcggtcggcggtgaaaaccttgacgtgcaggaagcggttgccaatatcgccagcaatccattgccgtacgcgctcgcgttcgcaggtgcctttatttgggcgatttacgcgaccgtgacgccatcgatgtccgatggttacgatggtacgacgattttcttctgttgcgttgctgttgtgctgtggattatccatttcgtttcgggcgacggtttgccagctgtagcgcctggcatcggcggctatatttcgctgctcgcatgtgccgcgtcgattgctggcggctacgcgtgctgggggtatggcatgctacatggcagtatggaaacgcttgcgatcggttcgtatgcgacgccgctgttctccactgcttccagcacgctcctattgggcgtgacgttgggcatgccattctggatcggtgtcgcgctggtggtagtcggctcgctgatcaacgtgtggtttgcgcgacgccgctgattgtccgattctggtgaatcggacgtctgaggtgtaatgcgcccatcttggttgtccgtttctcccgaatcggacttccagaccgtgtgccagccgaaaccgatctaaaccggcttaaaccagcccgttcaaatccacctcgtcacatcaccttggtggattccagattgcggctcacccagttgttcaaccggatcaccggcttgcgcaacaccaatcccagcagcagcgaaggaatcaggaacaaggcgagatacaccatgtcaagcaggtactcattgccgtacgatccggccatcgcggcgtgcatggcatcgatggcgtgcgggaacggtaggaacgggtagagcatttggaagaacttcggcagcgtctcgatagggaacgtaccgcccgaaccggcgacctgcatcaccagcagcaccacggccacggccttgccgatatcgccgaacgacacggtcagcgtatatacgatattcgagaacacgagcgcggcaagccaccccacggcaaggaactgcagcgcatgattcgcctgcacgccaaggaaatacatgtcacccaggcaaaccagtgtgccctgcagcaacgcgagcagtgcgaagatcgcgtaccgtccgaaatactcgtggtcgaggcgcagtccccaacgtgaggcgttccccgggccggacgggccggcgacgcgcggcagcgtgtcgcccaagcccagcacatgcgccttctcgcggtccgaaattgtcactttcagcatggcgcacaggatgatcgcacccacccagattgacaggatcgtatagaacggcgccatggctgaaccgtagttcgcgatcgggtacactgagacgcgatgcagtgcgacgggcgcggaaatcagcgtggacagtgtggacgcgttggcggtggccagtgcacgtagttcgtccgattcacccgaatcggacgaactggcgtcgttgtcaccgtcgccaccatcgctgttgccgtcaccggcgttcccgcccgtctccagcttcgtgatcagctccttcaccgtcgctgccgacgagtcgagtttcttcgcgatcgcgccgagcgtggaacgaatggatgtcacattcgtccccacgtcgcccgtcacatcgtccagatcgtcggcggtgccgctcagctgggtgatcatgctgtcggtttgggagatcagcgtgctgactgtggaggcgagcgcgtcgattttcggcttgacgttcgtggcgtaatcgtcgcgcacattgctgatcgactgcttcgcggaggtgatgcggttcaggatctccttgcgggagcgttccgcggctgcggtatcctgcgtgacctgcgtggaagcgtctttcagctgctgcgcgagcttctgcgaatcgcctttggcggcttccagcagcgtgatctctcggtcgatggcttccagcagcgcctgtttcgcggaatcactgtccggtagttgttccaccgattcgtgcatgtggttgaggcttgtgatgtacgtgtcgtacagcgattcgctgctggagacttgttcgctcaacgttgtcaactggctggctgcggtgtctgagtccttgccgagcgcgtcgaacgccttgttcaccttggcagctacttggtcgaacgcgtctgacacctggtcgagcgcggtgttcactgaggaggtgacgttcgcacctgccgaagtgagcgacgtggcacctgatttgccttgcttcaacgcgttctgggcctgtttgcccgccttggtcgccgaggcgagcagtttgcccgtggaatccacgatgtcgttcgccgagccgagcagctgcgaatacgacgttacctgctgcgatgcgccgctcagcgtatccgccatggtggtgagattgccgttgaggttgcgcatgtattcggccatttgcgggctttgcgaatagtgtaggatgcttgaggccaggtcgagtccgacttgcgcgatcgttttggcgaaggttttgtcgattgtgttgaccacggttgtcgcgccctgatcggtgatatgcggggcgatcgggttgattttctcgttcagatagtacttgagctgcgcgtgtttgatgtcgggggagaacagcgtcatcatgtcggcgctgaaacctttcggaattacgatcgccgcatagtattcgccggatttcaccccgtcgattgccttgtcgcttttcacgaactgccagtccagctggtcgttggcgtgcagtgtgctgatgatggtttcgcccacgttgacgcgcaccggtatgagatccgacttgtaacccttgtcgttattggccacggcgaccttcaatgccttggtgttgccgtaggggtcccagctggccgcaatgttgaaccaggcgtacagcgccggcaccaccaccaggcccatcgagacgatcacggcgatcacgttgcgggtggcgtggcacatgtcccgcttgaagatgccccagatcattttcactgttcgttcccctcctcacgcagactcctgccagcatttccgtctgtgtttccagccgcatactcagccgtatactcagccgcatgttcagccgcatgtccggccgcatgtccggccgcatgtccggccgcatgtccggccgcatgtccggccgcatgtccggccgaaccaccatgcgcagccgcatacagcctcgtatgtatggcatgcatcggcttgtaatgcatgcccggccggaatagcaggttctcgtgcaggatcgcgctgcggaactcttccgcactcatcgcttccttgcccagataattcgcataccgttcgcgcagatactccaccacgatgagatacgtgtcgatggcgatgatcgaaatgatccaaccgagcagcatggcgagcttcatgcgcgtgatgaatagcaacagcaggaacacgaacggcagtaccgccagcgcgaggaatccccagcgcaccaggcgcgggtacaggcggaagaaatgaatcgcccgtctgcgggcgagttcggggaactcctcggcgatctgctgcgcggtctcggtgagccgcaacggttccaccgtgccttcgttatgttcggtgatcatcagatcagtgtccgccagacggttgtcgaacaggcggttgaggttcaacgccagcttgcggacgaccaagccgatgaacagcgccacaggcagataccagaacagcgagagcatgtcgatccaataatggttggcatacatgccgccgatcggcccgcgcatcgcgttgatgccgtaggtgaacggtaggaacggtttcagacggcggaagaattccggcatcatctcgatggggtagaggcctgccgcgcccggaatctggatgatcaccagaatcacggcgacggccttgccgatatgccggaacgccacggcgagcgcgtaaatgatgttcacgtagacgaacgaggcgaaaatgccggcgaggatgaacaggaacggatgctcgcattggatgcccagcgcgagatcgccgatcgtggcgatgatcgcctgcagaaatccgaccgtgacgaacagcagccaacggcccatatagccttggcgtggcgtgtacatgcggatcttctcatcgcggtccacttcaagcttgtagatcgcgacgagcacgaatccgccgacccacagcgcaagattcgtgtagaacggcgtgaccgcggaaccatagtttttgaccgggtagaggacctgttcgtccaaatgcaccggctcgcccacgaacgagccgacctcgctcgcgtcaagtccgagcgcttgggaaagctgctggaacatcgccgaactgctcaacgcggccacatcggtgcgcgtggtgttgagctgtttggcgagattggcgagctgtgtctgcgtgccagcaatggtggtgttcgtttgggtcacggtgcgcgacaactggtcgagcagcccgttgccctgttccagcgtgctttgcagcgtggtaagcgtgccggacagcgacccattggccaggctgagtgtatcgagcccggtgttgagattcggcatgaccgtgccggtgatggtcgtgcgtgcgctcgtcatcgacgccgtgccgttcttcgccagcgtggtgacatcgtcgttgaacccgttcgcggtgttcttccccgcgttgatcgcagccgtggtgtcctgatcgaaggcgtcgatgcgctgctgctggaacgtcagctgtttgcgggcttcggcgagctgcgcggaaagatccttatacgtttggctgttcggatccagctggctggcctgcaacgccttctccacgccgtcgagcacggtgccggtggtggtgttgatgcgatgcatggtgctggacacttggtcgagcgcgtcctgcgtggtgttcagtccgctgagcacggtgccggtggcattgctcacgttgacctgcaggccggacagttgcgtgctgccgttgtcgagcgctccgaccagcgtgttcgagaatcgttcggtttgtgtgcgcgtctcgctcagcaagtcggacgccttgccgacggtgtcaagcgagttggtgatttccgaggcgagcgcgatgttggactgtttggccgaatcgatggtggtgagggccttgtcgagcgtggaacgggtgtcgcgcagctgctgttggacggtttcgagctggttgatggtgtcggtcagatcgttgatgacgtcgctttgcgcgcttttcacgctgccggtggtttctcccgctgcctcctttacttccttcgccacggcgtcggccacgctggaaacgaaagtggtgttgatctgctcgtcgatcgtggtcgcgcccgtatcggtgattttcggcgcgatcgcgttcagcttttcgttgatgtagtacgtgatcgacggtcggtcgcctttaccggtgacggtgccgatgagtctggagctgaagtcttccggcagtacgatcgccgcatagtatttgccggattccacgccttcgatggcttgctgcttgggaacgaaatgccagccgagctgatggttcttcttaagctggttgacggtctgctggccagcgtcgagatggccgaccagcgtggaggttgtgcccttgtcctcgttcgccacagcgacttggatgttgcccgtgttcgcgtacgggtcccagttggcgaggatattgcaccatgcgtacagtgatgggatgatagccacacccagcgtgacgacgagcgccacagggttcttcagaatgcgtttcacgtctcgaaggaagatggcgaaaacctggtgcatcaagcctcctcgcgggtattggtcgcaacatctacgtgcggcggcatgcccgtgcgggaacacccggttgggctcttcgtcgcgcgatccggtgaatattctatgacttccgatggaacgatcgcaatggtttcgccatgtttattggtcggtcccgcaagtgtcgggatatgagacgagaacgctcggcatatggccctagtggggcgggcgacctggatatggagcggacggtcgggaaaacggaaaggaaagatggcgaatgttgtcacatgacaagtgggatagggttgggcgataatggaggcatgactattgcaacgccggaacgttatgcgcaaatgctggacgccgcacgccgcggcggttacgcctatcccgcgatcaatgtgaccagcacgcagaccctgaacgccgcactccagggtttcgccgaggcggaatccgatggcatcatccaagtctccgtaggcggcgccgcctacttctccgggcaacgcgtcaacgaccgcgtcaccggctcgcttgccttcgcagccttcgcgcacgaagtcgcggcgaaataccccaacatcaccatcgccctgcacaccgaccactgcgccaaacagtatttggacgaatgggtgcgccccctgctcgatcatgaagtcgaacaggtgaagcacggtcaggaaccgaccttccagtcacacatgtgggacggttccacagtgccgctgggtgaaaacctcgacatcgcagaagaactgctcgacaaatcccaagccgcgcacaccgtgctggaaatcgaaatcggcgcggtcggcggcgaagaagacgggcacagcgccgaaatcaatgacaaactgtattccacgcccgcgcaaggcatcgccgtcgcgcaacgactcggcctcggcgagcgcggacgctacatggccgccttcaccttcggcaacgtgcacggcgcatacaaaccaggcgtggtgaaactgcgccccgaactgctcgacgaaatccagaccacggtcgcgctcgcgattaaggccggcgaaatgcccgaccccgcgcactcgctggatgtcgcttccggtaagccgttcgccctggtgttccacggcggttccggctccgcgccggaggagatcgcgcaggccgtgagctacggcgtggtgaagatgaacatcgacaccgatacgcagtacgcattcagccgtgcggtggccggtcacatgttctccaactatgattcggtgctcaaaatcgatggcgaggtgggcaacaagaagatgtacgacccgcgttcgtgggggcgcgaagcggaaagcgccatggccgcacgcgtggtggaggcttgcaggcagcttggcagcgcgggcaaggcgttgaagtagtgtgatgccgcacgcgccgtgtaatgcatgcggcgtgtgcggcacgatgggtgtgtcgcgttgtatgagacgaaaacgatggaactgactagtttcaacggccgatcggtgcatatccggcagatatccggtagagggcgcagggtagtctttgtaaggccttgggtaaggctttgaggcgaaatcgcatacgcgcggaggtgcaacaacatgcctggaattgttttgatcggtgcccagtggggcgacgaaggtaagggcaaggcgaccgatcttatcggcaccaaggtcgactatgttgcgcgtttcaatggcggcaacaatgcgggccataccgtggtcgttggtgacgaatcgtatgcgctgcacctgctgccctccggcatcatcagcccgaacgtgacccccgtgatcggcaacggcgtcgtcgtcgatcccgaagtgctgttcgaggagatcgacggtcttgaaagccgtggcgtggactgctcccgactgctggtgagcgaagccgcgcacgtgatcgcgccgtaccatcgcacgctcgacaaggtgaccgaacgcttccttggcaagcataagatcggcactaccggccgcggcatcggtccggcctacgcggacaagatcaaccgcgtcggcatccgcgtacacgacctgttcaacgccgaacatctgcatgacaaggtcgaggcgagcctgcatcagaagaatcagatgctcgtcaagctgtacaaccgtcgtccgatcgacgtggacgagactaccgacgagctgctcaagcttggcgaacgtctgaagccgtacgtggccaacacctcgctggtgctcaataaggcacttgacgaaggcaagaccgtgctgttcgaaggcggccaggccaccatgctcgacgtggatcacggcacgtatccgttcgtcacgtcctccaacccgaccgccggcggcgcatgcaccggtaccggtgtcggcccgaccaagatcacccgcgtgatcggcgtttccaaagcatacgtgacccgcgtgggcgaaggtccgttcccgactgagctgtttggcgaggatggcgagtggctgcgtgcgcagggtcatgagtatggtgtgactacgggtcgcccgcggcgttgcggctggttcgatgcggtcgtcaatcgttatgcggctcaggtcaacggcctgaccgacatcgtgctcaccaagcttgacgtgcttaccggcctgaaggaaatcccgttgtgcgtggcctatgatgtcaacggcgaacgccgcgacgatatgcctactgatcagtccgaattcgcggcggcgaaaccaatctacgaatccatgccgggttgggacgaggatatttcccaaatccacgacttcaatgatctgccgaagacctgtcaggattacgtcaagcgtcttgaggaactgtccggatgccgtatctccgtgatcggcaccggcccgcagcgcgaccatatcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcgttggtctggtttcaggattgctggttgtcgtataccgtctcggcatcgaatacggcacggatgcgtcccgttggatatatgcgcggattcgcgagaccccgtggctgattgcgccatgggcggttgccgcggtggcggccgcgctggcgatcgcgtggatggtcggtaaggagccgatggctggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtctggcgcgcagtgcgtgtcccaccgtttgcgcggccgacgtcgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgctaccgccgcatcgctgaccgccgatttcgtctcgaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcacggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagacgctgttcacatccacgagtttcggctcaggtgcgcctggtggtattttcatgccgattcttgcggtcggttcgctggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtccggaacgttgacgcacatgctgccggtcgcggctgtcgctttcatcgcgctgttggtgtccgatctgctgcgcaccaaaccgatctatggggagttgctggagcggtacgtgcgcgcgcaaggcatgcagatggcgatcgcaagccatgtgggcagcggcattatggaactgccattggaaatgggggcgattgcggacggcaagcgggtgcgtgacgtgcgttggccgtctgggtgtttgatcatcggcctgcgtcgcggcgaaagcgagatcgtgccgcgcggtgatacacggctgcgtgccggtgactatctggtggtgctgttcagtggcgaggaggagcgcgaggtgcgacctgcgatgcggcggctgtgtgatgcccggcttgactgagcctggctgaattcggctggactctggatgtccgaatctgcggaatcggacatccagagtgcatacgttggcgctccgtgtaaactcatatgcgttaggaaggcggcaaccgcggcccagctcgttgttgcacggcctatgggcggaacaacgctgtccgcaggaggccagtacagggggagcgcaatggaatcgcaagaacaatcgccgggagacgtggtgactgcgggtgaggactcgcatcccatcacgcagacaatcgacactgttgaggtgacgcatgctggtgcaaccgcgcccgccgctaacaccatggatccgcctacgattcccctggcaccgatgaaacgtatgcaggcgcggttcaatccgctcgccgacggactgatgtatgttgtggtgttcgtcggtggatttgttggagtcggctgtcggcatgcgttggatatgcttctgccgtcggtcagcgggacgccgttcgttgtgggcacgtttgtgtcgaatatggtcgcctgcttcctgttcgcgatgctgaccgaattcatggcgaccgcttcgtggctgcgtcgccgggtgcggcaggttgtcagccgtggcgttgggctcggcttgctcggtgggctttcgacgatgtccggcgtgatgctggaaacgatggaaggtctgcacgagcggcatatcgccagtgcgcttggctatcttgcgggaaattttgcaggcggtttgttcactgccgccgccggcgtggttctgatgcaggcactgctgtcacggagtactcgaaagcgggttcgaggtgcgttttcagctgtttccgtgtccgattctgccgaatcggacacgcagggcgtacgccatgtgaaagtggccgacgtagcgcgttctgccgcgcaggccgcaatggaagccgcgcaggcggcgcagcaggccgcgcaggcggcccagcagattgcacagacgggacaggttccgcgagtcgaaacgccaaccgtgccgccgaccgccagccagcctatgcagacaggccgcgttccgcagattcctccgctggccgttcctcagctgacacagccatcgcagccgttgctgcgcgagccggatactccagacttggggcagctgcccgagccgattcagcagtcgcaaccaatccagcagccccagcagcagtcgcagccgatccggcagccggccaacccgcttccgcccagcttcgagcccaaaccgatcactgcggagatttcgcttgtcgccgacccggctaccggggaggtgcgctgatgatgtggatgatctgtctgttcggcggtctgggagccatggcccgttacgtgctcgacgtgtcaattcaacgaggctggaatcgcgagaatcggagaacgagccgcaacttcccgctatccacgctcgtcatcaacggcgtcgcctcgctatgcgcgggcatcgccatgatgtcctactattcgcaatcggtggatatgggcacggtcatgatgttcgttgtcggatttctcggtggtttctcaacattctccacagcgctcaacgaagtggtttcattgattcgccagcgtcgttttacgctggctctgggctatggaatagcaaccgtcgcggtgcctctcatttgcgtggccaccggtttcggcattgcgctgctcgtcaatccggcgtaattttcacgttacacgggcggtcgctgagtaacgtgaaagaaatctgagcgcaaccgacatcaaggccgccagtccggatgcaacgctggtgattgcattcgactagaccaagctgctgctgaaggatggcaaggatatccagtaccagggccagaccggtatcgggccgttcaataagaacaatgatccgagttctgcgaatattggcgtctacactttcgacaaagacaacaagccggtctttgaccacacgcagtctggtgacgttccgaccgactgatcgcaatgtaggtcatcatcaatacaagaagacggcgcaaagtgagcgtgtatatcgcaagctttgtgccgtctctttcgttgtgcgtaattgtgatgttttgcaagatgttgtgcatgatgtatcttccatcgatgcagtatcgactgcagtgcaaaagtgatccatgaatgtgatttcaagggatcatcaaaaaaacacatgatggaaataaagtgaggggtgcccccgtcaaacgatatacacaccggactgtcgaacaggttcgagagaatgtgaaaataagtataatatctcgcgagaggcgcgtggtaagcacgtgagaatacagcgatggaacagtgataacgggaaaggtgcgatcatggtcggcatgcgcgatgtggcgaagaaggccggggtgtctctgagcaccgtctcgctggtggtgaacggcaacgggtacgtgtctgatgacatgcgcgaccgcgtgcgtaaggccatgcaagccctcaattatgtgccgaacgagcttgcccgcaatctgtatcatgatcgcacgaatctggtcggcgtcatcgtgcctactattcgtcatccgttctttgcgacgtttaccgcacatctgcagcatgcactcgccgcgcaaggattacgcactatgctgtgctctactgcagatgaggcggagggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcaattggatccgaccacgagcagggtgggcgattgattgcgcagatgctgatccgcaatggtgccaagcatgtggtgatgattggcggtccgcgagatcaattcttcgatttggctgcgcgcggagaagtcgaggaaggatcgttcgatttgggaaagaccacgttcccgacggtgcgctactacctcacgttggaacaggaattgacctccgcaggcgtgaaatacgagtatgttgaagctggcgaagtaatggattttgccggctatcatcgtgcggtcagcaatgtgctcgacaaggtgacgaccgacggtgtcgatgccgtagttagttccgatattggtgcgtcgttctgcgtgcgcgaagcgttgagccgcggaatttccattcctgacgagctgcagatcgttgcctacgatggtacgtatttgactgatttggccggcatgaaactgaccgcggtcgcgcaggatttcgcggcgatcgcacagtcggcagccgaccatattgtgcaggcgattgccaatgaggaagtggccgcagctaacgcttcacgcaagaacatccccaagccgttcgagccgaacgtgcttattcccatgacgctggtgccaggcgataccacgcgttgatgctgtgcattggaacgccgggttgcatagaacaccgaatcaaaccggttcgacacgcgcattgccaccttcggactggacaacaacgcccctctcgaggtagcatcgaaccggttcgatacgtacgtgagtacgcaaatccgtacgtacttatgcgcaggcaatgcgcgcaagtacgtgcaacacagtcataaacacatataaacagcaaacaggtagacgcgcacacattgcatccgcgcccatgagccaagggaggtcccatgaaaaacaaagtgcaactcatcacttacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacccgcgtctcggcagctgggatgacgttgctgaactttccaagacccacggcatcatggtcgatgccatcgtcaaccacatgagctgggaatccaagcagttccaagacgtgcttgaaaaaggtgaggaatccgagtattacccgatgtttctgaccatgagctccgtcttcccgaacggcgcgaccgaagaggatctggccggcatttaccgtccgcgcccgggtctgccgttcacccactacaagttcgcgggcaagacccgtctggtatgggtcagcttcactccgcagcaggtggacatcgacacggattccgacaaaggctgggaatacctcatgtccatcttcgatcaaatggccgcgtcccacgtcagctacattcgtctcgacgccgtcggctacggcgctaaggaagctggtaccagctgcttcatgacgccgaaaacgttcaagctcatctcccgcctgcgtgaggagggcatcaagcgcggtctggaaatcctcatcgaagtgcattcctactacaagaagcaggtcgagatcgcgtcgaaggtcgatcgcgtctacgatttcgcccttccgccgctgctgctgcattcgctgaataccggtcatgtcgagccggtcgcgcattggaccgacatccgtccgaacaatgccgtcaccgtacttgacacgcatgatggcatcggcgtgatcgacatcggttccgatcagctggaccgttcgctcaaggggctcgtgccggatgaggatgtcgacaatctcgtcaacgccattcatgcgaacactcacggcgaatcgcaggccgctaccggtgccgccgcatccaatcttgacctgtaccaggtcaacagcacctactattcggcgctgggatgcaacgatcagcactatattgcggctcgcgcagtgcagttcttcctgccaggcgttccgcaggtctactatgttggcgcgcttgccggcaagaacgacatggagttgctgcgcaagactaacaatggccgcgatatcaatcgccattactattccacggctgagatcgacgagaatctgcagcgtccggtggtgaaggcactgaacgcgcttgccaagttccgcaacgagcttgatgcgttcgatggcaccttctcgtacagcgccgacggcgatacgtccatcagcttcacgtgggagggcacgaccactcaggccacgctcacgtttgagccgggccgtggtcttggtgtggagaacaccgcgtccgtcgccacgctcgaatggcgtgatgccgccggtgagcaccgcacggacgatctgatcgccaatccgccggtcgtggcctgattcagcctcgcctgatccggtcgctgcctgaccgcgcataaatccataaatctgtaatcgtccttcctgtcacctctccttcaggaaggacgattcgcattttcgttttttcgagaaatcgtcttatcgggaaaacaattttcccgggaatcagctgaaatcccagcaaaaacgggtaaggtgagcttatgtcaaagatgtcaaagcttttcgatcaagacaacatgtttttcgccattatgggcgtgctgttcgatctgattattctcaacgtgctcacgctgttgtgctgcctgccggtcgtcacggccggcgcatcgttcactgcgatgcacagtgtgctctggcgcatggtccgccatgaggaaacgtatgtggcgcgccagtttttcgactcgttcaagcgcaatctcaagcagtcgctgctgccgtggcttgcgttcctgctggcggcgattgtgctggtggtcgacggcatgctcgcccggtccatggggtcgatgcgcgggccgctgatggcgtgcgtcgcgttcatgggattggtgattattgcgattgcgcagtacttcttcccgctgctttctcgctatgagaatccgacttccgaaacgttgaagaatgcgacgaaacttgcgctcggctttttcccgcgcaccttgtgcatgctggtgattttggccgcgttcgccgtgctgtatgcgcagtttttcatatatatgattccgctgctgattttgatgggcgtcacgttgccgcaatactgttgcgcgtggatctacaactggattttccgccgtatcgacggtgagatcgacgccaaggggcgcaaggtagcgcagtcctgaaattgtttgctcgtaaaggccgttccgcagattgcaagttccgcggaacggcctttacgcgttttcgtcgccttgagtgtccgattctggagaatcggacaactggaacgtacttttgggcgcgtgaatgtccgtttctcccgaatcggacaactacaggtcaaagtggggtgcttgaatgaccgattctggagaatcggacaaccgtgggtctgttttggtgttccggttatccgtttctggtgaatcggacaaccggaacatgttttgaggcgcttggatgtccgattctccagaatcggacacgctgggggcaggattagcaggggaggatggtggcgctgcgggctgggacgtgcagttgggtgccgtcgaagcgtgcggggttgccgatgctcagcagtactgttttctccgctggttcttgcgatatttcctgcgctaagccgccagacagcagtttcacatagtcgctcggcagtgtgcagcttgcgtcggtgtttgacggattgatggcgacgacgatgcgctcgccacctgcttcgcgattaatcttgctgcatgtttcacaaggtgtttcacagctggtttcgtgtgctgttccgctgcgttcgccgtcagttgcgtcgcgttcggcttcgccggcctcggagcttctcgcgtacaccagcggatacgcgtgatcttccgcgtagaggaactcgatgcctccgtcggcctgcagtgcgggatgtgccaggcgtagcgtgttcagtgcgcgtacggtttccagtagcgagtcgctgcgtccggtctgcgaagccacgttcgggcgctcgctgtcggcatcgatcggcagatacagatcatcgggccgggctgcggagaatcctgcgttggttgcgcagctccattgcattggtgtgcgcgatccggtgcgctcgtatccgccttccttggatttgagcccgtgcatgtagcgcatgccgatttcgtcgccgtagtagatgaacgggcagccgggcatggtcagcagaaatgtgaacgcgagcttcatttcatcggtggtcaaggtgtcgcgcatgcggatcatgtcgtgattgcccgacggaatgcagatgtatccaggcgttccggcggtgctggcaagcatggccgtatatgtgtccgcaaacgccttgatgtcgccgctcgcattgccgacattgtcgttattgcaatttggattgtctccgtcgacgactgaattgccgttgctgtcgcacccgctgctgcccgcgccgtcgcattcgctgcgttcgccgtcgtgttccgtttcggcagtttcggcgctgcccgtagcttcggaagatccggccgaaaaatacggattctcgcggaacaggtcaagataatgcgacggcccgaaatgcagcaggaagtccatgtcgaatccggcgtgcagcgcctcttcggggtcaccccattccgatacgagcaccgcttccgggtaggtttcgtccagatgcgctcgcacttgctgccacaagagtttcgtccaatagtggtcggggtcttccttgacgaggctgcctgccatgtccacgcggaagccgtccgctcccaacccgagccagaagtccatgatgtcttggatgagcagccggccctgcaccgcttcgggggagtcggcggcgaactgccagtcttcggtgacggtgccgaatccgtagttgaggcatgcctgcgtggagaagcagttcacggccgccgcgtcgggacgttccgcaatgcctccgaggaatccgcggattgattcgtatggcgagttcagattcggcgattgcgtcatcggtcgccagatgtagcggtcggtccatgcgttgcgttcgtccttgccggattcaagaaaccatggattgtcgaccgcggaatgcccgggtacgaggtcgagcagtacgtgcatgcctagttcgtgcgcgcgctcgaagagccgctgcaggtccgcgttgctgccgtagcgttccgcggctgtgtagtagtcgcgtacgtcgtagccggcatcgtagaacgacgagtcgaagcatgggttgatccagatcgcattgcaccccagatcgtgcacgtattgcagtttgtcgatgatgccttggaagtcaccgatgccgtcgccgttcgagtcgttgaatgattgcggatagatttcataaaagattgcgttgttgagccagcttgccataaatcctcctgttttcgcatctttgctgttggtctaccgatgtatcgcaacgttggaaacgtcggtcactgcttttccgtcattatagcccgtgaagacactttttaggggtgtatggaatgccaatgtttgcaatacgtcaatcgattgacgcgacacgccgacggatggcactgtgcacaaggtttctcgaaccggtttgacaactctcgaaccggtttgatatcctgtataccaaggacggagagattccgacaacgcgagtcggggattcaccttcctttatcacctcattgggcagggctgctcggtgaatagtggatagaaagggattggaaaatgagcaagttctcttcttggaagaaggctggcaccgctattgttgcaacgctgatgaccgttggcatgctgggagcatgcggatcgtcgtccagctccagcggcaccaagatcaccatcttcaactccaaggttgaaatcgaaagccaaatggaagacatggctgcgaagtactccaaggaaaagggtgtggacgttgaggtctactactccaacgacaccgtcgcagcgcatctcgccaccaagtacgcatccaaggatccgtacaccatctccatggtcgacgccaaggacatctactccttggctgaagagcacgccgtcgatctgtccgaccaggattgggtcaaagacaccgactacgccatcagcattaacggcaagacctacggcttcccggtctccatcgaagcccgtggcctgatctacaatgctgacgccatcaagcaggtcaccggtaaggaattcaagcctgagaactacaagacccttgacgagttcaaggatctcatcgacgagctcaaggccggcggcatggaatccccgaccggtgtcatgaaggaagactggtccctcgccgcgcacttcctgccagaagtctacgaggagcaggaagatccggacgccttctgccatgagctcaaggacggcaaggttgacctcagctccaacgccaagtggaactccctgatggacttcttcgacgtgatgaaagacaacaactacgccaagtcctccgccatctccgccgagcgtgaggtgaccgagcagaagctggctgaaggtgaaatcgccttcatgttcggcggcaactgggattggtccgtgctgaaccagtacgattacaccgagaacatgggtctcatgccggttccgcagaacactgatgacggctccaatgagaagctcgtcggcggcggctccaagtacttcttcatcgactcctccgacaacacctccgacgaacagcgccaggccgccaaggacttcctgaactggctcgccgaagataaggcaggccaggagttcatctccactgatgctgctctgatctccccattcaagaacaacgagatcgaagcatccgatccgctgggcaagtccgtgaagtcctacgctgacgccggcaagctgatcgacaactacaactacctgcctgacgaccacttctctgtgctcggcgccgccttccagaagtggctcgcaggtgaagaggaccgtgcaggcctcgctcaggacatccaggactactggaagaccgctaagttcaccggcgcaaccgcctgaacttccaaataatgcaccatgatgcagggtccgccgcttccttcctgcggcggaccttacatccccggcacgtatgggatccatcatgaaacagaataagctttcctataaaatcggccagtttctgatgttcggtggtccggcgacgattcttttcttcgccgtggtgatcctgccgttcttctatggcctctatctgacacttaccagctgggacggcgtttcgacaacgaagccgttcgtcggtctcgaaaactacaaggcggctcttgccgacaccgcatattggcagtcgcttggacgcaccttcatctactccgtcatcgccgtcatcctcaccaacatcgtcgcctttctgctggcctacctcgtgaccagcggcatcaagggccagaacttcttccgtgcgggcttcttcattccgaacctcatcggcggcatcgttctgggctacgtgtggaagttcgtcttcaaccgcgcattcgtggccatcgccgaagtggcgacgcaaacagaccacgcatcgctgctctccacgccaaacggcgcaatgttctgcttgatcctcgtttcggtctggcagtacgcaggctacatgatgctgatttacgtggcaggcttcatgagcgttgaccagagcctgaaggaagcggccatgatcgatggctgcaacaagggcaaggccatgtggcacgtggtcatcccgctgatgcgctcctccttcgtgcagtgcatcttcctgagcaccacccgttgcttcatggtgtacgacctgaacctttcgcttaccaagggcgaaccgttcaaccagtcggtgctcgcggcaatgcacgtctacaaccaggcattcgtttacaagaactatggcaccggtcaggcggaggcgttggtcctcttcatcgtctgcgcagtgatcggcatgctgcaggtgtacttcggcaagaagggtgaggtggcagcataatgaagggtcaaaccagcactcgcaccaaggttctgcatgcactgatgatcgtcgttctgacgattctgctgctgctgttcatcgcaccgttcattctggtcgtgatcaacgtcttcaagaccaaggcggacatcaacaccgctccgctggcactgatcggcaagcacgggttcaccctggagaacttccccagggcaatggacaagatgaacttcgtcaccgtgttcggcaactccgcggtcatcaccatcagcgcaaccatactgaccatcctgttctccgcgatgtgcgcatacgtgatcgtgcgcaacccctcgtggaagttcggcggcatggtgttcgcacttatggtggcctccatggtcattccgttccaggtgctcatggtcccgctcgtgtccgtctacggcggcctgcttgacgtgttgaacagtcgtatcacgctgatcctcatgcacaccggcttctcggtctccctggcggtgttcatgttccacggtgcgatcaagacgaacattccgaacgaacttgaggaagcggccagcatcgacggctgttccaagtggcgcaccttctggacgatcgtgttcccgctgctcaagccgaccgtcgctaccgtcgccatcatcgacgccatggcgttctggaacgactacctgctgccgtccctggtgctgggccgtcgcgaactgtacaccatcccgatcgcaacccagatcttctacggcacctactccaacgatatcggcctgatcatggcggccctgctgctggccatgctgccgatcctcatcctgtacctgttcctgcagcgctacatcgtcgaaggcgtgacctccggcgcagtcaagggctgatcgaacggtacggaatccgcaatcataactgaacagactcacacaaccggtccggatgcgaagcgataatcgcatccgggcttttcttatgcgatatcgattcttatgcgatatcgatattgagattgccatcgcatgtttctgctgtctgacaggacgtattgatatggttgatttcgccgaaagaatcgctcgaatgcactggtgcagtgtgtccgggcgattttcatatgtgctgaatatcgtgtgacatttcgaaacgagcaacgaaatagaagcaagaacgagaagcgacgatacaaaacaggaaaaacaggaatagaaataagagatgactgaagacaatcaacataatgcaggtgagcagcagactccaatgcagccgcagccgctgccgggccaggtgttcgtgcgccccggtatcgatgaccgtcccgattacgaaaaaacgctgaccgaagagaccaaagcggccctgaagcgcttggccgtacagcagaatccgcgcgtgcccgaggcttccaacgagcgtccggaagtgcagcagaccctcatcaacacggaaggcggctccccgctgaccgcgttcgcccatctcgacgccgctgtgccgaacctcgaatcgtcgttccttgacctgcgcgatccgatgaccgcgcccgacggcaccacgcccaccaaaccgcaggtgcatcgtctcaccgccggcttcgcgcttggtgcgctgctgttcaccgcgccgatggccgcgctcaactctgtgctcattccgcagaccatcagccgtctttccggcaccgaccgcgtcaccgatctggcgctgctcagcgtcgtcggcacgttgttgacgttcctgatgaacgcgtggatttccgtcggatccgaccattcgtactgcccgctgggccgccgcaccccgtggatcatcgccggcacggtgctgaccgccacgtcggtggcgattctttccgcatgcgatttcatgccgttggtcatcgtgttctggctgtttacgctgatcggacatgcgatggtatcgatgccgctggcggccgctttcggtgagcgcgtgcctgacaagttccgtgatcgtgcggacgcgtggcgtggcgttggccaagcgttcggccaggtgttgggcattatcgcggccgtttcgattacgtgggctgccgacgattccggttgggatggcaccacgcgtttcgccatgatggtgtttgcgttgtgcctggtggtggctggtgtggctacgttgctggtgttgccgtttgagggttccagcagctatttgcctcgtgagggtgtgaagaagggcgattatttttcgcagtatcgtccgccgaagggcgctccgaagttcttcattgcgtttgccgcgcgcatgtttgccatcgcagccacttccggcattgcgatttaccagtggtatcttgcgcaggatggtttgggtgatgtttcgcaggtcaccatgtttggtttgtccggagcggctgcggttatgtcgatgatggccgttgccgcgttcgtcggctcgctgttggctgcgctgctgcttggccgcatcgcccgcgctttcaaagattcccgtattcccgcgattgccgcctgcttgttatttgtggttgctgtggtgcttccgttgacgccgatcgatagtgctatggcggtcgcgctgtatgcgctgtttgcaggtttcgcgtatgtggtgtatgacggcgtgagccaagggttgaatcttgcgacgttgccggatgtgcgttccgttggtcgttcgttggctgcgttcagtttggcgaatacgttcggttcgttgattggcgctgtcgtttgcgcgattgcgattgcggtgactggcgagtatctgctgattttcgctgttgccgccggttgcatggctgttgcgggcgtgctgacgttgctgctgaaatgatttggatgacctgagataatccgaaaaacgaatatcaaattcaaaattgcgcgtccacatagtgaacctttagtagaaagggtctgtggacgcgcttatctttacggcttagttcgagcggataatccgccgaatacaagactttgcgaaaggaggttcgccacgatgaacggaatggttgcacgcgtactgctgtccgcacgaattattattccgctttcgttggcggactgattcgagcaatgcagcttcaatccctcgccaacggaggcagggtttgaggcgcgcaaaacacacacgttgatggccctgcatgctgcggggtctttttgttgccgcccacaaggcgtaaggcaacgaaatgaagactgcacacaagagaatagaagaaagacgttatcggcgcatgttgggagccggcaacgcatgacagacgtaacaggagtaatccaatgagtgcagtcgaagcagccgctggcaaagcgcaggcaatggtgcgcgattcggtgaaaaccgttatcgccgcttccatggtcggcaccgccattgagttctacgacttctacgcatacggcaccgccgctgcgaactatttcccgaaggtgttcttcggagacaccaccaatccgactgtcgcactgctggccagcctgctgaccttcgccatcgcgttcatcgcacgcccgctcggatccttggtgttcggccatttcggcgaccgcatgggccgcaagaccacgctggtggtttcgctgttgaccatgggcatcgccacgttcctgatcggctgcctgccgacttacagccagtggggcattgtggctgtcgccgcgctgtgcctgtgccgtttcgtgcagggcatcggtctgggcggcgaatggtcgggtgccgctttggtggccaccgagaacgctccggaagacaagcgcgcgctgtatggctccttcccggaattgggcgctccgatcggtttcttcctgtcgaacggtacctacttcctgttggaaacgttcaacgatgacgatgcgatgctggcatggggctggcgtgtgccgttcctgctgtccgcagtgctggtgatcgtcggcctcgtcgtgcgcgtgcagatggaggagaccccgatcttccgcatggcccaggagcagaagaaggtcgtcaagtccccgttgaccgaagtgttcaagaagagctggaaggaagtcatccaagccacgttcctggtggccgtcacctacacgctgttctacacgctggcaacctggtccctcgcttggggcaccaaaaccgtcgagcagggcggcggagaccttggtttcaccaatcgtgaatacctgctcatgctgatgcttgccatctgcgtgttcgccgcgttcatcgtcatttcctgcgtgaacgccgataaattcggccgcaagcgcgtgatcgtcatctcgtcctgctgcctcgtggcattcgcgctgctcttcccgttcctgcttgatccgtcggtcgtcggccagcgtaacttcgccgccaacctgctgttcctatgcatcggcttcgcgttgatgggcaccgcattcggtccgatcggcgcgttcctgccggagctgttcgacgccaacgtgcgttattccggctccggcatcggctacaacctggccgccatcgtcggcgcggcattcgtgccgaccatcgccacttggctgtcccaccactggggtgtgcactccgtcggtctgtacctcggcgtgatggccgtgtgctgccttgttgcggtgctgagctgcaaggagactaaggatgttgatttcaccaagtgatcaatcgccaagtgccgtttgaccggctattcagcgacgtgtcaagatgacatcgacggaagccttactaaaaacgtttgacgcgaatataaccactatgtgaacgtcagcaaccaatataaagaaagcgggactaaaacagttccgcaggagaggcggggtggttcctcggacacaatccggggggagtaatctcctaggaaccatcgcccgctgtgaacaaccgaaacaagaattaaatatcgcgagtttgttcgggaatgcaagtcccgaatcgctataaaaagaaaaataaaggagcgcctattatggcagcaactatctggtacgagaaggatgccgatctgtccgtgttcgatggcaagaaggtggccatcctcggttacggttcccagggtcacgcccacgcgctgaacctgcgcgattccggtgtggatgtcgtcgtcggcctgcgtcctacctctaagtccgtggaatacgccaaggagcagggcctcgaggtcaagcctgttgccgaggccgttgccgaagccgacgttgtgatgatcctgctgcctgaccagtaccaggccgccgtgtacaagaaggacgttgagccgaacctgaagccgggcgctgctctggctttcgctcacggcttcaacatccactacggctacatcaagccgtccgaggatcatccggtgttcatggtcgccccgaagggcccgggccacatcgttcgtcgtgagtacgccgccggccgtggcgttccggtcgttgtggctgtggagcaggatccggatggcaagacctggccgctgtgcctggcttacgccaaggctctgggcgctctgcgcgcaggcgccatcaagaccaccttcaccgaggagaccgaaaccgatctgttcggtgagcaggacgtgctcatgggtggcatcaaccacctgtgcgatatgggcttcgatgtgctgaccgaggctggctaccagccggagatcgcctacttcgaggtgttccacgagctgaagatgctggtggatctggccaacgagggtggtctgaacaaggctcgctggagctgctccgacaccgctcagtacggcgattacacctccaccgtcatcactgaagagaccaagaagcgcatgcagtaccagctcaagcgcattcaggacggctccttcgccaaggagttcatggatgatcaggccgcgggcgctccgaagttcaaggagctgcaggaagagtacagccacccgcacctggagaccgttggtccgaagctgcgcgccatgttctcttggaacaaccagacggacgccgatgccgatatggccgagtccttcaacggcaagatcgctcgtacccaggttcagtgatttcgctgtagcggctgcatgttaagggccgatgaataacgtagtagcgcaatacacgcgaaacgtgttggaagccaccgtctcaccgcggtggcttcttttttgttgctgtgttgttttatgactgggatatttcgtatgcgggatcgcagtactgattgtcgggagagccgcacggctaggcggtggcccactttgtggactcaatgcttatttaggaagggacgggagtaggatagaccccagtttgcaggacaaaatccatgcacaaaaacacgcgaattcatctgcgaatggtagaaacccgagcgccgggaggcgttcaccccactacataaaaaggagtgccaagtacaatggctgcacaaatctggtacgagaacgacggcgatctctcggtcctcgaaggtaagaaggttgccatcatcggttacggttcccagggtcatgctcacgctctgaacctgcgcgattccggtgtggacgtcgtcgttggcctgcgtccgacctccaagtccgtcgagcacgccaaggagcagggtctggaagtcaagtccgttccggaagctgctgctgaggccgatatcatcatgattctggctccggatcagtaccagcgcaccatctgggccaatgacatcgagccgaacatcaagccgggtgcagctgttgctttcgctcacggcttcaacatccactacggctacatcaagccgtccgaggatcatccggtgttcatggtcgccccgaagggcccgggccacatcgtgcgtcgtgagtacgccaacggccgtggcgttccggtcgtcgtggccgtggagcaggatccgcgcggcgacgcttgggacatcaccctggcttacgccaaggctctgggcgctctgcgtgcaggcgccatcaagaccaccttcaccgaggagaccgagaccgatctgttcggcgagcagaatgtgctcatgggcggcgtgaacaagcttgttgaaatgggcttcgaggtcctcaccgacgccggctaccagcctgaaatcgcctacttcgaggtctgccacgagttgaagatgctcgtcgacctcatgaacgagggtggtctgaacaaggctcgctggtcctgctccgacaccgcccagtacggcgactacaccaacacctgcatcgacgagcacgtgcgtgagcgcatgcagtaccacctgcagcgcatccaggacggctccttcgccaaggagttcatcgaggaccaggacgctggcgctccgaagttcaaggctctgcaggaagagtacggcaacgtccgcatcgagaccgtcggtccgaagctgcgcgccatgttctcctggaacaacggcaaggatgacgacgctgatatggccaccttcaccggcaagatcgcccgtggctgatgtggctcattcggctaatcgctgagtcttttacaagaccgctgcccttacgggtggcggtcttttttgtatgttctgtcgcatattgttctaggatagatatgtacggtttcttacggtttttctataggaagagatgtcatggtcactgcgactggtcccgcacctggttctgaaatgacaacgtcggctgaacctaccgaagaccgtagcacgtcaggagttctgcacgtcgccgcgattttcgcctcgcatatggtgttgcagcgtaacaagcccatcgccgtgttcggcgcgcttgatgccgattgcgccggacttgaggtttccgcggaaatccgcgatttcgatggttccgtgatcgtgcaggcgcatgcgtacgcctccaaagagatcaagaacggtttttcaccgtggcgcgtcatgctgccggcacagcccgaaggtggcccttacacgttgcgcgtcaccgcaggcaacgatttcatcgaatattatgacgtgcttatcggcgaagtatggctggccggcggtcaaagcaatatggaacttgaattgcgcaacagtgaagacgccgaggaagccctcgataactgtgccgatccgttactgcgcttctacaatgtgccgaaaaccggtgtgatcaatcgcaacgccgaacatgcggcaagctggcaggaatcatcgcctgaaaatagtggcgtaatgagtgcggtagcgtactattttgcgcgaaaactgcgtgatgaacttgattccgaccttccgatcggcattatcgactgctatatcgggggtacgtcgatcagttgctggacgagcgaagatgcactgaattccagcgaatccgggcgcggctatcttgcgcgctatgagcaggcgatcgcaggtaaaacgcaggaacagttcgatttggagtacggcgaatggcagtcgcgttctgatacgtggaatgcgtcgatcgcagccgcccgcgaagacgatcctgatgtgacgtgggatacgctgacccaacagtatggcgaatgcccgtggccgccgccgatgacgccgacctcgcagtggcgtccgtcaggcgcgttccatgccatgctggagcgcattgtgccttactccttggcgggattcctatggtatcagggcgaggaagacgagccgtattgcggatcctaccgtgagttgctgggcatgatgattggtgaatggcgtgcgctgtggagcgaaagcctgccgttcctgatcgtgcaattgccgcagtggattgacaagaaggtcgacgagggcgacggcgatccgatgctgtggccggtgttgcgcgaggcccagtgggatgccgcgcagtccatcgacaatgtgttcgccatctgcactatggattgcggcgaatacaacaacattcatccggttgataaacgtacaccgggcgagcgtctaggcaattgtgcgcttcgccaagtgtatggtatgagccgtattccggtgtatgggccgactgtgctgggtttccgctgcgacgaaggcggccgcgtacgcctgttcttccggtacgcgcacggcctgcatttcagcggtactgcgcccgacagttttggtgacgagttcgccaagagcctgccttcgctggtgcgtctgccggaacgttccggtttcgagcttgccggtgccgatggtgtgttccatccggcctacgccgcgattttcgtggattgcgatattgacgatctggtcaacgcaaaggtcaacgtggtcgattacaacgccacggaattcggtattccgatcaacagccgcagtatcggcacgattacgttggccacgccggaagtgccagcgccggtgatgatgcgctacgcatggcgtagctggggtccggcaccgttgtttaatgacaataatctgcctgctcacccattcaagctggacctgaccgatcacaccgactctgatcacgctgaataatcacgttagatagttgcgttgaacggctgcgtcacatgattgtcgatagttgacgatgaatagcgtgcgattgctgtgcttatagtgtgctgcaatcgcacgctttatattgcgattgaagtcctgctgatcgcacgtcagtcaaatacgaatcaaataccagtcaaataaaaaatcgttgaaaaatcaacgtttctgcgatttatgccaccaaaatcgcagaaacgaatcaaataaaatgcgctgcactgcgagcgcataggctattgccagaggtccgggccgaatgattccaggtatgcggtcagttcggcggccatctgttcgtcttccggaacgcgcggatggccatccgtgccgcaaccattgcgtgaatacaagaaatgttttacgtgaaactcgccctcagtgccgcggccgttgccgtggaagatggcgtggaacttaccgccacagccaagagctacgtgcgcgacctgttctgcatggcagataaggtcgacgcgaaggcttcggtggccgagggcatggtctcgctgcttccgggcgaaagcgtcgtgctgcatatcgccactgccgatgccgcagcgcttgccgctccgggtgcgttcgcagccgccaacgtgccgcgttccgccaacgatccgaagcgcgaatggtgagcttccgcgagtacgccgtctactgaagcggtagaagagtggatagaggactactgaaatttcagttgacgtgttcggttgagtaaaaacataagttgaagcgccgccaaccttaagaaacgaaagtgttgtgaacgctgacttttcaagaggttggtcggcgcttttactgtacgatgtagatgaaccgtttaagttgcgatttaagttaagaagaaggacacggacatgcctattcaaaaaagcaaggtgacgatttttgacgttgccaaggcttcgggagtctctagtagcgccgtttcgtatgcgctcaacggcaagtctggtgtttccgatgtgactcgagacaaagtgttgaaggtcgcacacgaactgggatggaagccgaatggcgcggcacaggcgctggccaaggcgaagacgcagcgcgtgggtctagcgctgggttacgacccgaagctgctttccgtcgaatcctacatgatggaacttatttccggtcttggcgccgagctggaaaaatacgattattctctgctggtacgcatggccgtgggtgaggacgcgaagctttcgatcatcgatgattggattgctactggcaacgtcgacgccatgctgctcgtcaatgtcgagcttggagacccttgcgttgccttgcttgaggagcatgaggagatgccggtgcttgccattgccgatgcctccgtggtcggcaatctgccgagtctgtcaagcgccgacgccgatgccgtgcgccgagcggtgcgatacctgtatgatctcgggcatcgtcagatcgcccgcgtcggcggtcccgaatcgcttgcgcactcgtatattcgcgattccgcctttgcggacgtcgcttccgagctgggcatgcgttatcgttgcctgcacaccgactacacgccggaaaccggtcgcgaggccacgaagcgcctgctggcgttctctgagcatccgacggcgatcatctacgacaatgatgtgatggcgttggctggccttggcgtggcagcttcgcaaggcatcaaagtaccggaggaaatctccatcatgtcgtgggatgattccctcatgtgcaccgcggcgtatccgaacctgaccgccatgggccgtgacgtggtcgataccggtaagcaggccgccggattgctgctcaagctgatcggcggcgagcgtgtggggcatctgatggaagggccgtacgaattgcgtgcccgcgcttcgaccggtcccgctccggcagcggaataagatgcgatgatgagttaatgcgatgatgaattaaaaaattgcgattgcgcatttgctgcgccccgacaagggcaggatgaaagcgagcagcgagccgatcgcggcgatcgccgcaagggttacgccatacaggattgcgacggtgttgccggactgcttcgacaggtaccacaggtcgaacggcgcgagtccccagaacagcccgggaatcgcggattggaaatcaaaatctgaaatctgaaatcgtaatctgaaatcaaaaagcgcccgtgcccctcgcttgaggcatgggcgcattgttgccttacgacttcaggcgcgcttctgtgtgatctgataggcggcgaacagcacgaccagccaaatcacgccggcgaccactgcgatgcgatagcttgcggagaagcacatcagcaccacgaccagcagcatgaacgcgatcaccacatacggcgtcaccttggcgaacggcagcttgaacgcaagtttgtcaagtgcttcctggcccttcaatccctttaaatcattcggaccgtcgccggcggcgacaacgcgacggaacttaatttccgtaatcatgatcatgatccaattaatcgcagcggcaatcgtggcaatcgacatcaaataattgaacgcgaaatcaggccacacgaacaccaccaccacggcgatcgcaatgatgatggccgacgtgatcacacccccgaccggaacgccgcgcttgttcaggcggcccagatacgcgggcgcattgccctgcttcgccaacgaatacagcatgcgcgagttcgcgtacaggccggagttgtacacgctcatcacggcggtcaagcacacgaaattcagaatgccggcggccgcatgcacgcccaccgagtcgaaaatctgcacgaacgggctggaattgccgtcgatcgtgctccacggcaccacggccataatcacgccgagcgcgcagatgtagaacacgagaatacgccagataatgccgttcgtggccttcgggatggtggtgcgcggattttcggtttcgcccgcggtgatgccgatgagctcggtaccgccgaagctgaacatcaccacgaccagcgccatcagcaggccggtccacgtgccgtccgcattgcgagacatcaggccatgcggcaggaatccgccgtcaacggtaaaccagttggcgaacgacgcgcgaatgcccgaagcggtcggcacattcgcgatgatcacatacaaaccgccgaaaatcatggcaagcacggccacgatcttgatgatggcgaaccagaattcaaattcgccgaacttgttcacgcccataagattcagcgccgcgatggccaccaggaacaccgccgccgacacccacttcggaatgttcgggaaccagtaattcacgaacgagccaaccacggccaactccaccatggccacgagcacgtagttgaaccagtaattccagccggaaataaagccggctcgcttcgaccagtactgcgtggcgtaatagctgaacgcgcccgccttcggatcctcgaccgccatttcggacagggcgcgcacgatcaggaaaatcgccagaccgccgatcagataggcgagcagaatggccgggcccgccagctgaatcgactcgctggaaccatagaacaggccggtgccgatcgcgccgcccaatgcgatcaattgaatatgacgattcttcaaagacttgcgcagcgtcggcggaaccggcacatcgtcggtttcgcgcggtttcttcgcaacggttgcgtcgctcatgaatgcttcctcttcttgggtgcctcggcaatattcggcaaattcggcaaaagtttgcgatcttggcgatgttgcgttcggcagtagtggtaggtgacgcgcctatggtttttggtatggcgcgtcttccccgattgtagctgtagcgcgtggattcggtttcatagtgttcaatagttcgatagttcaataaaatgaaggttttgggagcaatggttggtgctgcttgagcgctacgggctggaggtcgtcatggcattcatcaaagacatggtgcgtatgtggttgcatgcgtggaagcgattcatctccatcgcactgatctcgttgctgggcgtcgccgtgcttacgggcatttacgcgggttgccgagacgcttttcttgcgacggatcgttttttcgacacccaaggattgcacgacattcaggtgttgtcgacggccggattgaccgatgacgatattgccgcgctccgtaagatttccggtgtcgcgaaagtgcagggcgaacgttcgcaaaccgtgaccgtcgatctgaacggcaaaaaaaccgtgaccatgcaggagatcggcacgaacggcattgaccagccgtatttgcaaagcggacgcatgccggagaagtccggtgagatcgcggtgacgcgcaaattcatcaaggattccggatataaaaagggcgaccatattacggtgacaccgcaggattcggcgtcttcttctgtgtccgattctgcagaatcggacaatcaaacgggcgaaaacgggtcccagatgtccgattctgcagaatcggacacgcaggatggcaaacgtgccgcacgggtgaccgattctggtgaatcggacaatcaggcaccgagcttccccaccgaactgactattgtgggcgtggtgcttgacccgcaggatctcaccaatccagacggctattcgggtacgaacgcattccgttcctccgccaccagcgactacacgttctttgcgccgtccgacggtgtgaccggcagcatgtacacggccgtcaccattctcgtgaaaggcaccgccgacaaggactcgttcagtgacgtgtacgacgacaccgtcagcgaagtagctgaccgcatcgacggcacggtgcgaaccaatcgccagaaagcgcgtcatcaggaactactcgacgctggaaccaaacaaatcgacgaggcgaaagcgcaaaccgacaaacagttcgccgcagcgcaacagcagatcgacagcaatcgcagccagctcaatcagcaaatcgaccaaatcgtcaatatgcaggcgggcgcggctgcaggatccctcgacgaaacaacccgtgaaacactacgtgaaacggtaattgccgcaagcccgcaattagcggaagccaaagcgcaactcgaccaggcacaatcgaaattggaccagcagaaaaaagacaccgaacggacactgcaatccaagcaaaacgagctggaagacagcattccgcaagtgcgttggtatgtgcaggaccggtcgcaaatcggcggattcagctcgctgaaatctgatctggaatccatccaatcgctgggcaacgcattcccgatcgtgttcttgctcgtggcggtgatgatgagtctgaccgccatggcgcgcatggtcgaagaggatcgcgggctgatcggcacatacacagggctcggctacgggcgtcttgcggtcgcctcacgatacctgttgttcgcgctgttcgcctgcctgatcggcggtggactcggcctgatcgcaggcttccttggcattccggcgttcctgctcgtcgtattgcgaggcttgtatgtgatgccggacgtacgcttggcatacgactggctgtacggaacggccggagtcgcgctgttcgtggtcggcgtgcttgccgcaaccgtgtatgcgtgcgcgcaggaaatgcgacagaagccggccagtctcatgcgtccgaaagcgccgcgtgcaggatcgcgcattctactggagcgtatcaagccgttgtggaatcgcatgagcttcctcggcaaagtcacggcgcgcaacattttccgcttcaaatcgcgtctgatcatgacggtcggcggcgtggccggctgcaccgcgctgattgtgtgcggacttgcgatcaacgacaccgttgccgcattgggcgcgaaacagtatcaggacgtgtatcagtacgatttgatggtggtcgcgaacgatgatgacgctgatgcgatgcggcagaaagtcgcttcggatggtcgcgtcacgtcgagcatggacgtgcgcgttgaatcgggtgatttgaccggcgattcggggagcgaaagcattcagctggttgccgtgcccgacagtgaacgcagcgagttcggcaagatggtcacgttgcagccggtgcgctccagttgggtggatggtgcggccgatacggtaagtctgggcgatgacggcgtgatcgtatcgcagtccgcggcaagcgcgatgggcgtcaaagcgggcggtatggtaacgctgaccaacggtgacgatatgcaggccgaagcgcatgtcagcgcggtgatccgcagtgtgatcggatcggacgtgtatgtgagcgaaacctattatcgccagctgttcgatactgctgcatccggcacgtcttccgcatcttccgcgtccgattctggagaatcggacaatcaaaacggcgaatccggtacctcgaatggcgcatcgtcaaacggccaacaattggtgtggaacgccatgtatgcgaagctcaaaggttcaggcgaatcccaggccgcctatgcggaaaagctggaagacgacgatgcggtcatgaaagccgtgagctgcgcgcacatggcggaaagcttcaaattcgatctgatgggtgcggtggtcgcgctgatcgtggcgctcgcgggcgggctcgcgctcgtggtgttgttcacgctcgccaacaccaacgtgtcagaacgtgaacgcgagatggccacgctcaaggtgctcggattcttcgacaaagaggttcaccactatgtgaaccgtgaaatgatggtgctcaccatgatgggcgtggtgctgggcttgcctctcggccgtttcgtcggcggattgctgacggctgcgttgaatatgcccgcactgtatttcgaagtggaatgcacgccgttgagttatgtgattgcggccggcgcgaccatggctttcgcgctgctcgtgcagttgttcgtgaatccggtgttggatcgtatcgacccgattagttcgctcaaatccgtcgaataggcgcatgtctgaatgtccgattctccagaatcggacaactagacgggtaaaagtgcgttacggttgtccgtttctccagaatcggacaagtaatgcggcgaaagtgccctgtggttgtccgtttctccagaatcggacacttagagtgccggaaaggctcggattcgcgtttcagttcttcggataacggtagttgtgtggcagttgcgtggtgagctgcgggtccaggccgagttccttcaactgccggtcgatttcgcggcgcgcacgtttcacaagttcggctcgatattcatcgccatgtccggcattgctatgtgccgcatcgccatgtcccatcgttcccatcttctccagtgcgtccaatgtttccgccatacgcttgagccggtcctgatggtgcagcagcgcacgcacctgcgcatgttcgtgcacgatcgtccgccaatcggatggtgtgtgtgcaatctcccgaaccgcggtgaccggatgtacgtcggccacctgatatgtgatcgagccaagcagcggcattaggaacaccgtaatcgcgccggctgcgaccagtgttgacgcggtgtcgccttgcatggtgccgaccttcaccgccagtgacgtgacggcgacgatgatcggcagcgcggtcgtgcaatacagcgctacggtgacgcgatgatgcgatgacagcggattctcgcgtttgtcgagcgatagcgcaacatatacgggcaccgcgcgaatcagcatgagcattacgatgaacgcgacgagcagcgcgggtcggcctgccacggcgcgcacgttgatcgcggctcctgacaccacgaaaaacacaggaataaggaatccgtagccgacgccttccagtttcatttccagcgacttgctgccgtcggggatgatgtaacgcaggatgaagcctgcggcgaacgcgccgagcaccgcgtcaagttcgaacagtgcagaaatggtgacaaggaagatgagcaggaatgtggtcagtcgcatgagcgtttgcgatgacgtgttcgcgttttccgtaaggaaacggtacaggcgatggccggttttcagtgctttcgtgggtagcattgcgcacagtagacagatggtaaggaacgcgccgagcacgagcatggtctgccagccggttcgggtggatagcaggatggccatggcaaggattgggccgagttcgccccacgttccgtacgagatgatggcgtcgccgatgggggtgccttcgaggttgcgttccttgagaatcggcatgagtgtgccgagagcggtggtggtaagtgctattaccgtggcgatgccgttgatgccttgctttgcgaagaatggaagcagggtcacgacgagtccggcgagccccaaggtgatgatccatgtgacaaggccgactttgccttgatgcccggcgagtcgttttgggtcgatttcgtagccggcgagcaggaataggaacgccatgccgagctcgctcaagagtttcacggcgtcgttcacctcgattacgcccagtccgtacggaccgagtgcggctccggtgacgagcagcagcacggtttgtggaatgaaccttcctggaatcagctgcgccacaatcgggctgacggccgtcaccgccatgatgatagtcaatgaaacgagctcttgcgtcatgtttctagcctagtgagtctgcatgacggtgttcaaggacgtgatgccccatgatgagccaaagggcactctggggcaaggttaagtttttgtaaattttatgggggggggggtaattctatgagcgttactatctgtgcaaaatggcggaactgttttgttttgaagatggaactccttcttttcattgggggaagggtgggctttattcgagggttttaacgagggtgccaatgggaaagctccgatacgattctgaaccaagctgtttaggcaatatagggggagggaagaatggttgatggaaaattcaccgcaaaggagcgcgcgtatttggccagccttcccgcagtggaaagcgtgagcgcgtcgcatatccggtatgccgacagtttccgcatcgaagtcatgtgcagatacaatgcgggcgaatcgccggccgccatcttccgcgaggcgggtctcgacccgaaactcatcggatacaaacgcattgagcggtgcattgcacgctggaaaaagcaggaggaacgagaccgccgcaacagcaagcgggtggaccgcgacgacctgctcgtcattcggcatcatgatcttatgcgcgatgatgcgcaatcgtcggcaacggaatcgcaggatgcgctttcgaagctcgcccaagcgcaactcatcatcaaccaatgcgacgaattgatcgcgaaacaggcgttgcgcatcgacgaactggaacgtgtgctgcgaaagcttgtcgggtgacggcacggttgcgtgagatggaggaaacggcggaatggcatgacggtcgttggccgtcacccgaagaggctccgatgggtggtcgactttcgttggaaagtcgctttccgtcgttcgaagaggcgattgacgttgccgacgaaatgcgtcaacgacgtcacgctcgcggcaaaacgctggcgatgcgtgcgattgcggcgctgttgattgtcgctgcgatctgtattggcggttttccggcgatgttgcagtatcggtcggcgcgtgatctgtcgggaacgtcggtaagatccgcgcatacggttgcgggctggccgtatccgcaggcggatgacgcgttcgccgcggcccaggactataacaagcggcttgcggaatccggacagccgattttgggtgaggcgaaggatccgttcgctgatgtgcgcggaggatcgcgtgccagtgtgtccgattctggtgaatcggacaatgaagcgggtgaaagtggaccacagttgtccgattctggtgaatcggacaatcagagtggtgcgggtacaggcgcggacgccggttccgcggacgctggttccgcaagcgccagttcggcggacgcggagtaccggagtctgttggattccggcggtggcgtgatgggtacgattcgcattccgaaaatttccgtgagactgccgatctaccatggcacctccgaatcggcgctcgcctcgggcgcgggccacctgtacggcagcagcctgccagtcggcggcaagagcacgcatgcggtgctcaccgggcatcgcggactggtcgaggcggccatgttcacgcggctcgatgaaatgcgtgtcggcgactacttctacatcgaagtgatgggtcgaacgctcggctatcaggtggaccgtatcacggtgatcgagccgaacgacacgtcgcagctgaaaatcgtgcctggtgaggatcgcgtgaccctgatgacctgcacgccgtatggcgtcaacacgcaccgtctgctggtttcggccacacgttccgccattccagatgagattcccgccgaaaacgacgcggtgaaggatgcccgcgcgattggtgcgatcacaggtattgcgactctcgtagtgggcgtgttgttggtttggttgcgacgcaagccgtggcatattcgcaggcatgctgcttggtggccgaagcgtggctgattcggttacatttgcgtgaataatcgcgcttttcgcacgtttttccttttgtgatgtcgggtgattgcgccgtaggaaatgtgttgcagggattttgttgttgcgctgttgccaaaccccgactttcccgcacgtagggtgtgcgcgcgattgtttgatttcctttagttttcagggttgaagcagtgtcggattgctccaggcgagtcagtggcgcgattcgatgagagacgtgaattaaggggatgcatatgagacatgcgcacaacgaggcaaagccgaggggaagctttgttcaacgcatggttgcggcgctcgctgcgattgccatgcttggcggcttgggttacgtcaccacgtcttccgccattgcggaagacgaccagaatccttccggtgacacttccaccttgcagcctgcgaatagtaaaagcattgccaaaatcgaaggtggagacggtgatcagtatgcgttgcatttgactgcgtccggcgatagttcgtcgtccacggttacgaccgcggtgcctgccgatattgtgctggtgcttgacaagtccggcagtatgaaaaacagcaaccgtgacacgaatgcgaaaaacgctgccacggccttggcgagtaagcttctgacggccgcgaatgccgctcttccggctgagcagcaagtacagatggcggtggtgacgttcagcgacagggcgcgaacaacttcgcagttcacgacttcccctggcgctatcggcacggccgtcagtgcgtggccaaatggcggaaccaactgggaagacgccctgaaaacagcgaacgatctgtcgtcgggacgttccggtgtgcagaagcatatcgtcttcctgtctgacggcaatccgaccttcagaatcacatcctattccggatgcttcaagtggagtgggttcggtcagggatgggaaagccatcctgaatacgggacacaggcggagtgcgaggctaacaataagtggttggaccagtcctaccagtggaaaaccgacccggacggctcggacggaaacatccacggcgagggcgatgacgatagctacggctacaactatgcggccgctctgtcggaagccaacgaacgcgggaacgcagccctgtatgtggtgaaggtttcggccgacgccaataagatgagcgacctagccaaagaagcgaacgccgtcaccggcaaggaatacgacggaacgtccgcggaaaatctgacgaaggcattcgaacagatctacaacaccatcaccacaaccgcgaaaatcagagcgtattccatcaccgacaccctgtctcaatgggttgatccggtcgatttcgccgatgtggcaaacggcgccgatatcacgcaatatgtgacggtaaccaacaatggcacaaccgtaagcggatatacggccgtctacaacgtcgacgacaacggcaatcgcacgattaccgtgacattcaacaatgggaacggcatgatcgtcgacaaaaacgaaaccatcgacgtttccttcaaggtaaaaccaagcgacgccgcatatgcggattacgcaagcaagcagcaatacccggacacgggagaagccaataccggcaatgaatccgcaggaaagcaaggatacttctccaatgccggagcgcatctgaactactgcgtggtcacgtccgttaacgaccaggaatcggaatgcacccaacagacgctcgactatgccaaaccggtcgtgcaagtcagacttggccaaatcaccatcaacaaggtgtggtccgacggtgcgagcaagcatgcgagcgacgcggtgacggtccaattgcagcgcacgaagaccggggaagcggccgcacaggctgaaaaagtaggcgatccaatcacgttgaacgcgtcgaataattggacggccacgatcggcagattgcagcccggatacacctacagcgtggctgaaacgtcggaagacagccgctacgcggtctcctaccagtatggcaatgctgcgagcaacgcgaccggcgtggacctcaccaaagccatggtctggcagagtgacggcaacggcggcaacatgacggccacattgaccaacacgttgaagagcgcgacgctatccaatgtgatcaccgtgcagaaaatcctagaggggcgcgactggaaggcaggcgattcgttcgatttcgaactgaccgcagacggcaacgcgccgctgccggccgattgcgcgcaacaggcgcaacagtcgtgcaaggtgacggtcgcctatgatgctgattccccggatagccagcattccgcaacgttcggtgacatcacctacaacgctggaaaagccgactacacgtacaccattacggaaggcaacggcaatatcgcagccctgcactattcgggcgcgaaataccagattgtggtcgccgttaccgaaacgaacggcgcatggacggcttcggtgaaatccgtgacgaaactgctcgacgacaacggcaagaacgtttccgaatcgcagaaaatcggcgatccgatcgcattcaccaatacgtatgtggcggtgtcggcgttgccgttgacgggcggaaccacggatcgtcaatggctgctggttggcggctcgatcggcggactcgcagtactgctggttggcgcggctggcgtctggaacagcaggaagcgtctcgtctgagacggttcctcgggctggactgccctaccaaccttcgcagggcagtccagccgtgcatcacaaattttgtggatccagagcatgttgggcttcggatcccgttagcagaaacaaacacaacatcaacaacacaaggagaggggattctcatgaagatgaggaaacttttcgccggtatcgccgccgctgcgacgttgctgggcggcatggccctgggcgcaaccagcgcacaggccgacggcagcggcactgtcgtcaagagtgatgtgaatttcacattcactgctcaggacgccaagcagctgaccaatcgtaagctggacgcctacaagatcgctgactacgtgcagtacggcactggtagcaatgcaacgtacggtgtgcagactgccggcacggtgacggataactccggcatcaaggctgcgctcgaagctgctgttgcaggcactaataagacggttccgaccgatggcggcgatctgatggcttgggcgctcgccgaaggcgtgctgtctgtggacaattctgcagatggtgcatggaataatagcgcttcccgtaagtttgtggaatcgctgaagaccacgactgacaagcttggtaccgcagaagaggttgatttgggtgctgccgctaatggcacttccgctactgtgacgctccctacaggcctgtacctgtttgtggacgcggattactcggttggcaccaatggagctgccactccgtctatcgcaatcctcgttggctccggtaacgttaaggatggcgtgctgaatccgctcactgaggcaactgtgaccattaagaaccagaccaccactgtgagcaagacggtgagcgctgcaaccgcttccgccggccagacggtgacttacaccattacgagcaaggtgccgcagaacacgcagtactacagcgattacgcctacacctacacggataccccgagcgctggccagaccgtgaatctcaactcccttaaggtgaaggttgctaacgccgaactgaagaaggatacggattacaccgtgaccgggggcgctaatggccaacctttcactgttgccatccgctccatccagacgcagcgcgcaggcgcagagatcgctgtgacctacaatgccactgttaccagtgaggaagccgccggcagcaaggccgtgactaatacggttgtgctctccgacaatggtgctgaagctactgacagcactaccatcaccaacggtcagttctccttcaccaagaccgacgcccagggcaatgctctggccggtgctaagtttgagatcgaaggacagaacggtgcctcgactccgtccactgctactgcgacttccgagtcaaatggaacggtgactttcaagggtcttgcggacggtacttacaaggtcaccgagaccgaggttcctgcaggcttccagccgaatctcaaagctgcatttaccgttaccattacgaacggtaaggccgtcaagtatacaggtgccgatatctggggcttggctccgagcactgaggtctccgataactacacgtacaaggtcaagaacgtgaagaacgtcacccagctgccgcttaccggtgctgcgggcacgaccctcttcaccgtggtggcgctgctcgtggcaggtgccggcgttaccgtcgcactcaagtcgcgccagcgcgtgcgctgatatgcgctcaatcgctgaaacaataagcgaaaaaaacgaaataagcgggcattcgcggaaaccatccgtggatgcccgcttatcgtgcctttccatactttttaggggtgaaggttttgcacggggcaatacgggatcgaagcgggtgaaatccggtaccaaacggcgaaatccggcatgaaaaaggtatccgcaggtggcgagtaggtggcaaaacaggcgtcaaccaaagcaatcatacaggggttgcaggtgggggcatctcacgacaatggcaccctacaatcgcaagcacatccatgaaaacagtggaaaggcgggtgtcatggcacgaggtgggggagcgttcagcgacgaggaaatccaactattgcgcggactgccagcggtcgccaacgtaacgcgcaatcgcatcacctacgccgattcgttcaagcaagtgtgcaccatccgctacttgacaggcgaatcgccaaccaaaatcttccgggaagcgggacttccgccggatctcatcggatacaagcgcatcgaacggtgtgtggatcgttggaaaacgtcggccatcaaatccgtgaccggcagcggcaacatgagcgacagcgagatcatcgcgcaactcgtcaaccggtatgagcatgcgttcgtgatgaggcgcaacctcgatagcatcaccaacaggacgatggaacatattcccgtcaaagcgcaaggcgacgacggcatcgacgtgggaaccgcgagcatcatcatcaaacagcaggcacgccgtatcgacgaactggagcgcgcgaacgccgaactgcgcgggcaaatcgccgccaccgcctgacccagaccatcgttatgctgcgtaagtgtctgattctgcagaatcggacaagcgaggcgcgatttgtgtcggacagttgggcgtatctcacttatatatggcagtcaacctgcggaaatacgcccaaaacgtaccccctaagtggtgttttgccgtgagcaagtgccatatataagcgagaaagtagcggtcaacctcgtgaatctgccatatataggcgagatagggcggcagggggtatgtcgaggcgaaaatacgggaataaggtggtcggatgggcacggttgaccacaaacgggatgcgccagtgccgcaaaatctgcgtacgtgcccaaaaacaaagcttcggcgggcgcaatgtgcggttcgcggggtagggtagtgaacattatgacttccgagaacaccaattccgcgggctcaagcgccgcgcacatcaaatccgtcgaaagcctcgaccagagcaatgaaatggagcgaggcctgaaaaaccgccatgtccagttcatcgccatcggaggcaccataggcaccggcctgttcctaggctccggcaagtcgatcgcactgaccggcccgagcatcattttcgtgtacatcggcgttggcctgatcatgttcctgctgatgcgtgccatcggcgaaatgatgtacagcgaccccagccagcacacgttcatcaatttcatcacgcgctatctcggccgcgggtggggtaagttcgccggctggacgtattggatcgtgctcattctgactggcatgaccgaaatcactgccgtaagcacgtatttcgtaacgttcttcggcacattcggcatagacctgaactcgtggaagtggctgatcgaactgtgcttcctcgtggcgctcactggcatcaatctgattgcggtgaaagtgttcggcgaggcggaattctggttctccatgatcaagatcacgctgatcgtcggcctgatcgtcaccgccatcgtgatgctagtcatcggcttcagctaccctgccacgcatatcgagggcgtggacggcacagtgtcgggcgccacggtgagcctcacgaacatcaccgacggcttccagctcgcgccgaacggctggatgaacttcttcatgagcttccaaatggtgtttttcgcctaccagctcatcgaattcgtgggtgtcacggtgtcggaaacgcagaatccgcgcgaggtgctgccgaaggccgtgaacgagctgatcgtgcgtattctgatcttctacgtgggcgcgctgatcgcgatcatggctattgtgccgtggcgtaatttccacgagaattccgacggctcgttcggttcgccgttcatcatggtattcaaatatgcgggtcttgattgggctgccgcactggtgttcttcgtggtgattacggctgccgcgtcggcgttgaattcgctgatttattcggccggtcgccacttgtatcagctcgcttccgattctgagtcgcctgcgatggctcgtttggctgaagtttccgaacacaaggtgcctgcgaaggcgattgtcgcttcgggttgcatgattctgttctccccgattatcaacgctattccaggcatttccggcgcgttcgtgctgttcgcttcggccgccagcgctgtggtgatttttatttacgtgctgacgatgctcgcccaccgcaagtatcgtcagagcagcgattttctgccagacggtttcgtcatgcccgcttggcaggtgcttgattggattgcgatcgcgttctttgtgctcgtgtatgtcacgttgttcctgtcggcggacacgattggttctgcgatcgccggtctgatttggctggttgcgttcggcggatattgcttgctgcacgaacgattccagaatcgcgatcttaaggaagccttgccgcggtagcgtttgcgggtaacgcaggatacaagtaaggggcgtctgccgaacgtgagtgcatcacatacgttcggcaaatgccccttttcagtatggtctttgcgcgaatccccattatgggattcagcgcactttagccgatgtagtcggcctcgttcgttgggctggacggcacggcatgatcttccgtaaccttgcccaagccagacaaatacgcttcacgaccagcttcgatcgccttcttgaacgcgcgtgccatcagcggaatattgccggcggaagcgatggccgtgtatgccatcaccgcgtccgcgcccatttccatggcttccgcagcctggctcggacggccaataccagcgtcgataatcaccggaacattggaattcttgataatcacttcaatgaaatcgcgtgcacgcagacccttattcgagccgatcatcgcgccgagtggcatcacgcaagccgcaccagcgtcttcaagacgcttcgccgcaatcggatcggggaacatgtacggcatgaccacgaagccttcttttgccagctgtttcgtggctttgatggtttcctcattgtcgggcagcagatacttcgcctcatgctcgatctccaccttcacaaaatccgtctggcacacttcgcgcgcgagacgggcaatacgcaccgcttcctcggcattgcgtgcgccggacgtgttcggcagcatggtgatgcccttcggaatgtagtcgagcagattgttttcggtggtacggcagcgacgcaacgccatggtgacgatttgcgtacccgcgttctcaatggtcgccttgatgaggttcagatcgtagcggccggaaccgagaatgaaacggctcgtgaacttgtgtccgccgaggatcaacggatcggcgtcaccggtggcgatttcgtcatacgcgtgcgcatccggttccggcagcagtgcggtgttcgtggtggtgccgaccagctcgtcgagtgtggcattcggtgccgctgcgaagtctttttccgcggtggtgatcgtgttttcggtgctcatggttaatccttactatgcgattagtgtcgtgtcattcgttgcgatttgcgattgcaacttgcgtttgcgtttgcgtttcgctgtcaggcgtcttcttcgccgagaatcaagcgagtgatcatattggcttcgtggcaggcgaccacacccacgcgcggtgccatcagaccagcgcctggcaccggagcggtttcgccgtcgccgcagaagtagaaattcttcgaaacgcgacgagtattcaccaaattggaactgcggaatcccgccattccagaagcactcaccagcttcttgttcggcagattctcaagtacggcattcaccagcatcgtcttgttttccggcacgtcgaacgcttcgcagataatatcttcattaccgaacagcatcggcacgttctcgtcggtcactttcacggtatcaatggtgatatcgataaaaggattgatctgacgcaagttactgcgcaatgcttccgtcttgtactgcccaagatccttcaaaaaatactgctgacgattcagattcgtcatatccacgcgatcaaaatcaatcaaatgcaggtgaccgacgccaatgcgggtcaacgccactgcaatcgtggatccgaggccgccgcagccgcaaatggccacgtgcgccgcgtcgagcttgtcttgcgtggccgcggtgtggcggtcgagcagggccgcgcggatttcttcgcggctgacgagcgtggtcgggtcgggctggttgtcgaaagcgtgctggcgggcgtcgatctgcgcctgcgatatggatggttcaaaagtcatggttgttctcgtattctcgttttccgttcgtgtgttgtttttgccgggttggttgtgtcttgtatgttcttgcgattgttacgcgtatattgcgccggtcgtaatcgcaagaaattttgaaagtggttcagccgccctgcacgaacgtgacgatttccaacgtatcggtgcccttgagctgcgtctgcgcacgctgggtgcgaggcacgatttcgccgttgagctcgacagccacgcggtcggcgcgcaatcccttgctttcgatgagttcggccacggtgattggcgtggcgatgttctcttccttaccgttgatgatcattgtggttcccttctgcgtctgtcgtgacacatgcttcctgcgctccaaatgtccgtttctgcagaatcggacactcaatgctggtacgaaaaaagggtcgccgaaggaaccgtaccctatgaggtggtgcgcccctccgtgaccctaatcacgcgatattcggttatcgcgaacggaagatgagatacgccttgcggcgcgaacaacccgtctccttacggcggcattacccgcatcaagtcctcggtcgaagctttatgagctccctctcagcctttcggctcccgttcggttgtgcctttatcttcgcgcacgcgcccgacaagcttgcgccggttcacgttgggttagtcttgatgtgaacatgtgcgaatcggctgcgtgcttgcaaggaaggggaagatgatgatgaacggtgagttggcaggatttacgattcctcggctcggcatgggaacgatggctttggcgattgaggggcgtccggatcgcgatactgcgattcgtacgattcacgccggtttggacgcgggtgttcgctatttggatacggcttggtcgtattatctgccgagcgagcctggcactggcactgcgaaagatttggggtacggcgaaaagttggtgcgtgatgcgctcgcttcgtggaatggcccccgagatgaagtgctggtcgccacgaaaactggctatcgacgcaccatggaggtccccgcttttgttgctcctgtgtccgattctggagaatcgggcacacagggtgccggatttggagtacagatgtccgattcaccagaatcggacactcaggggcgggattctgagggatgcggccgtcggcctggcgaggaacgccagcatttgcaggcggcgggcagtcaatacgggtggatggcggattcgcgccccgaaaccatgattcgtgacgccaaggaatccgcgctgcacttgggcgtcgatacgctcgacctgttgtattcgcacggccccgatcccgcggttccttacgaagaccaatgtggcgcgttgaaacagctgctcgacgaaggcgtgatcaaatatgcgggcatctcccgtgtgaataacgagcagatcgatcttgcgcgcagcattatcggcaacggattgatcgccgtgcagaaccagttctcgccatcgcaccctgatcctgagcgtacgatggagcactgcaaggagttggggcttgcattcgtttgttggagtccgctcggcggctttcttgatgcgttcgaccatcgcgcgtacgacctgttccgtgaagtcgcaggcaatcatggctgctcctaccagcgcgtggtgttggcatgggaattgactcgttacggacgtctgttcaccattcctagcgcccgcaatcctcaggagatcaacgattcctttgccgccgccgaattgacgcttacatcggacgaactggcgatgttgaacacgtcagttgacgcccgtcgcggctgagtttcaagcagcccgtacggttggtcgcgcccgatttcgcacaataattgcgattcgggctgcggccattttcgtctctttcgtaatttccgcggctttcgtaccatctcggccttttgcgcaacgcagaatcacccgaaaataacttacgatataaattgtttacactgtaagatattatgacggcgattgcaacgtaaggaggtgccgcgtgggttttgaagaggaactattccacgaattggcgaccagcacatgggataaacgctcgcgtatgcagcaggagatggcgaaaggcgcgaaaggtgaaccctttgcggtgcaggaactgtacaggaagggtccgctgacgccatcgcaactcgccgcttcgatgaaaaccaccaccggacgcgtgtccgcactgttgtccgcactggagaaaaaaggccagatcacgcgcgaatccgaccctgacgatcgccgtgtggtgcatgtggaccttaccgaagccggcagggagcgcgccgaacgtcagcgcgaaagcatgcgcgaggcgatctgctggatcttctcgcaaatgggggagcgccgcgcgcgcgaattcgttgagcttaccgaggaattcaccacgtacatgtcactgtgcatgcccggcaagccgcgtccgaccccagaagaggtcgccaaggcattttcagaaaacacacaggaagttgcataatacttcacactgcaagaaatttacagtataaacaatcgtggttcgagaatcgcaaatcagctaaccgaattaaccaagccaacaaaacgtaagagaaggaaccaagcatgcttcgcattgtgcgatacctctccaaagcggagatagtccagatgctcattgcactggtcagcatcgtcggtcagatctggttcgatctgacgctaccggattacatggccgacatcacgcagctcgtggaaacgccgggcagtgaaatgagtgatatctggatagcgggcggcaaaatgctgctcgtctcgctcggctcggtggcgtgcgcggtcgtcaccggcttcatcgccgcgcgcgtcggcgcgtcgttcagccaacgtctgcgttcgctcgaattcaagaaggtggaaagcttcggaccggcggaaatgaaccgtttctccaccgcatcgctcatcacccgctccacgaacgacatcacgcagatacagatgttcgtgactatgggtctgatgatgctgatcaaagcgccgatcatggccgtgtgggccgtatgcaaaatcgcgaacaaaggccttgaatggacgttcgccactggcgtcgcagtagccgtgctgctggcggtgatcggcgtgatcatgagtttcgtcatgccgaagttcaaggccatgcagcgcctgaccgacaatatcaacctcgtggcgcgcgagaacctcaccggcctgcgcgtggtgcgcgcatacaacgccgaggagtaccaggaagacaagttcaccgaggccaacaaggaactcaccgagacccagctgttcaccaaccgctccatggccatcatgatgccgttgatgaacaccgtcatgaacggtctgatgctggccgtctactggatcggcgcctacctcatcgacgccgccgaagcgctcgacaagctcaccaccttctccaacatggtggtgttctccagctactccatccaggtgattatgagcttcctgctgctgagcatggtgttcgtgctctggccacgcgccgacgtgtccgcgcagcgcgtgctcgaagtcatcgacaccgatccgatggtcgccgacggtgtgaagaccgccggcaagcctggcatggaaggcgaaatcgaattccgcaacgtgagcttcgcctaccccgattcgcgtcaagctatgttggaaggcgtcaatttcacagccaagaagggcgaaacggtcgcattcatcggctcgaccggctccggaaaatcgtctctcgtcaacctcgtgccgcgcttttatgacgcgacgcaaggcgaggttctcgtcgacggcgttgacgtgcgcgactacacgctcaaggcgttgcgcgacaagatcggctacgtgccgcagcagtcgttcctgttcaaaggcacgattgccagcaatgtcgcgtacggagatacggaacgcaacgacgccgacgtgaagacggcatgcgatgtcgcgcaggccacggaattcatcgacaagaaggacaagaaatacgattccggcattgcgcagggtggttccaacgtgtcgggcgggcagaaacagcgcctgtcgattgcacgcgccgtttaccgtcatccggaaatcctgattttcgacgactccttctctgcgcttgatttcaagaccgatcgcgccgtacgcgacgcgctcgaacgggaagcgaagaattccacgaaactcatcgtcgcgcagcgcatcggcaccattatgaacgccgaccgcatcatcgtgctcgacgatggcaaagtcgttggccaaggtacgcaccacgaactgctcgacaactgcgaagtatatcggcagatcgccgaatcgcagttgagcgaagacgagttgaatcgctgaaggggaggaccaacatggcaagaggaccaatgggacgctctcgcggacccgtggaaaagccgaaggatttcggcggtgtgatgagcaaactggcgaaattctgccgtcactacattcctgtgatgattttcgccctgattctgggtgcagccggcacgatctgccagattgtcggaccggacaagctcaaagacatgaccaacgagatcacgaagggactgccggccatggtgcatggcaggccggtcatgcactcgattgatatggatgctgtttcgcgcatcgcatggctgcttgtcgcgctgtatgttgggtacgcgctgctgagctacttgcagagctggttgatggccaacgttacgcagcgcaccgcccaggagctgcgtgaggcgatcagcaagaagattaatcgcctgccgctcaaatatttcgacaagatcagctacggcgatgtgctcagccgcatcaccaacgatgtggacgcgatcggccagacgctcggccagtcggtcggttcgctgatcacttcaatcacgctgttcgtcggcgcgctcatcatgatgttctacaacaacgtgatcatgacgctgtgcgccatcggttccgcgttgcttggcctggtgatcatgggcgtgatcatggtcgcctcgcagaagtacttcacccgacagcagatcgcgttgggagatgtgaacgggcacgttgaggaaatgtacaccggccacaccgtggtcaaggcgtactgcggcgaagaggactccatcgaacagttcgagaaatacaacgatgatctgtacgtctccggctggaagagccagttcctctccggcctgatgatgccgctcatgaacttcatcggcaacttcggttacgtggtcgtgtgcgtggtcggcgcggtgctggccatggacggcaagatcgaattcggcgtgatcgtggcgttcatgatgtacattcgcctgttcacgcaaccgctttcccagttcgcgcaggcgttccagaacctgcagcgctgcgctgccgcttccgaacgcgtcttcggtttcctggaagagccggagctggccgacgaatccggcaagaaagcactgctgggtgtcggtgtggatggcaagccgcagccggtgcgtggcgatgtggaattcagccacgtgcggttcggctacgacccggacaagacgatcatccacgacttctctgcgtcggtgaaggccggccagaaggtggccatcgtcggtccgaccggtgccggcaagaccacgatggtcaacctgctgatgcggttctacgagatttccggtggcacgatttcgatcgacggcgtcgacaccaagtcggttccgcgctggaatgtgcatgaccagttctcgatggtattgcaggacacgtgggtgttccgtggaacggtgcgtgaaaacatcgcatactcgaagccgggcgtcactgacgagcagattgtggccgcctgcaaagccgtcggtctgcaccgctacatcatgtctttgccgaatggctacgacactgtgctcgacgacaaggcgtcgctttcgcaaggtcagaagcagctgctgacaatcgcccgcgccatggttgaggacgcgccgattctgattctagacgaggccacgtcctccgtggatacccgtaccgaggagttgattcagaaggccatggacgcactgacggtgggacgtacgagcttcgtgatcgcgcaccgactgtccaccatccgcgacgccgacatgattttggtgatgaacggcggcgacattgtggaacgcggcacccacgaggaactgctcgctagaaacggcttctacgccgacatctataacagccagttcacgctgatcgactgagcggctgagtggctggcttaagtggggtgctttggttggcttgcttgagccggctgacgatcagaagaagcggccgggaaaaccggcgctgatggtggcgtgacggtcggcgtccaacgtggcgcaatcgaaggcaaaagtgttgctcagctcgttcggatcggcaacgaacagcgccgtagccaaaccgtctgccaccgcagtcggatagtcgacgaccaacgtggattgcacagtaatccacgtggcctccatctgctgcgcgggcaggccgtcgacggcgttgagcagatgatgaatagccagatgtgtccgttcgtcaaccgccacctcccaatggcggcgactgggcgcgctcgcgcaaaacgcgccatcgcaaatctctgccacacccaccgcacgggacgaatcgtccggatcctcaagcgccacacgaatcgggctggacgtgtgtactagcaggtcgcctccagcatcaatcacaaattccgggaaggtgttctctcgattgaaatctgttgccccagcagtgtgcgccgaatccttccgcatggcgtgctgtgggtgcggttcacgagacacgcatgacggttccaagccacccaacaagccacccaacaaatcaaccagatagcctttgccgcacgcgccgaaatccaaatgaaccgagccatgcgtgaccaacgtcgtactatctgaacgtactacgtcgtgcccccatacagggcgtccgcgcaaagcgcccaagcgctcggcggcgtcggcttcgacggtgaagctcagcgtgggattgtaaccgagacgaatcagatcctcacccacgcacgggtcgatcgcgccgcgtgtgacgtcgtgtagtgcgtcgtacaaatcaaacagtgggccggcccaattgggaaaatcgaaatgcccgccatgctccgcgtttccgatgcgcgtaaccagcgaatcggcgcggaatcgcgaaagcacatgctcgtatccgtcgatgagtcgttccattttggcacgcaggcccgtggaaaccgggcgggcggtcgaaaccagcaaaccggtgccgagcgccttgggaaacgcggtggtgtagggcatgcgctgcacgagcgaaacggaagcatccataatcctgatgctagcgcgttcgttcgttgagagtgaggccttatgtgcccgttttgtcgatgctggtgcttggctgcggaacgtccggcgcgtcgaattcaacaagcatgctgcgagtgtgccactatgtgagatgacacgccgaagatggtaaaaacaggaatggcggaattccgccgattctccatactcgatacatcagaacaaattaaaaatcaagactgttctttaaaaaactttcgttttatcttggctttcggtgcgcacgtcgcacactgaaaagttttgagaaggaaggtttggaacatgtcatctcgcgttgcgcagcgctacgcaaccggttcctatgatccgtgcgatccacgagtctcggcttccggccgtctcgtcacgctcgtcgccgcgctgatgattgcgctcgccacgcttttcgcgactaccgcggttccgcagtcggcaatcgccgccgatgacggtcaaacgaattttgattcctggactgccgccgcgaagaatatcgaagaccagcttgcaaccgccgaaaaagactataatgacggcaattacggtcaggctggcaccgatttccagaccgcgcattggatcggttacgacgcatccaacttctcgaaagtcgtcaacgacaccatcagcgccgacaagcagaaggaactgctacagcaattcaccgatcttgaagggcttgcctaccagcaggaccaaggcgacgccatcgcaaccaaaatcgacgcgctgaccgccgaaatcaacgcaaccgcgcaaacgctcgatgcgaacgcagacctcgccaatcctaaggaatacgcgaagcagcgtgccgcacaaaccgcggaagagcgcaagaagcttgacgcggccaagaagaattcgtccaaaggcaaaggcgaccgcacgtggagtgaggttgccaacgaaatgaccgttattctcgaccaggcatacgaggctgccgctgctggcaagggggacgaaggcgccacgctggtcaacaacgcctactaccagtactacgagaagctcggcttcgaaaagaacgtgatgaacgctatttccggcgaccgtgtttcgcaggtcgaataccagttcaagatgactcgtaagaccatgcgcgacggcggttccgacaaggaaatcaagcagctcgtcgacgatttgaagagctggctcgtgaaagatgcggccatcctcgacagtggtgcgtccggcaatgtcaacggcttcaccaagctcgttaccagttctgccggtcaggcgttcctcattctgatccgtgaaggcctcgaagcgctgctggtggtggccgcagtaatcgcctatctggtgaagtccggcaacaagcgtttcgccaagtggatctaccttggtgtggtcgcaggtctggccggctccggtttggttgccgtgctcttcacgttcctgttcggcggttccggcccgattcaggagatttccgaaggcgtgtgcgcgcttatcgccaccctcatgctgctgtggaccagcaattggatgctcaacaagagctccgtggaagcgtggaacaactacatcaggaacaagaccgaagctgttgttgccggcgcgcaaagcaaggtcgaatccggtcagggcctgggcttgggcatggtcacctcgcttgccatgttgagcttccttgccgtgttccgtgagggtgccgaaacggtgatcttctacgaatccatctactccatgagccaggatgcgcacggcatgtgggttggcggtctgaccgccgccgcggtgctgatcgtcatcttcctgatcttgcgattcacttcggtgaagattccgatcggcccgttcttcctcgtaacttcgattttgatggctgcattggttgtcattttcgcgggtggcggcatccatgcgctcatcgagggtgatcttattgaaggtacctacttgagcattgtgccaactaacgattggatcggcttgtatccgtacgtcgaaactattgcggcacaggtgattgctgcgatcgcggtggttgcgctgttcgtagtcggcttcatcaagaaacacaggatgaagttggccgcacaagcggaacaggctaagtaagcgccaatcaataatcacaagtaaatatttagagatttccataagttcccaacgttcctcgaggaaccaaagaaaaggaagagaacacaatgaagaataagaagatcgccgccctgctcggcgtcctgctggccggctccatggctttctccctgtccgcatgcggcaactccaacgattccgcatccgacgccaagtccgacacctccacttcgaacgccaccgacagctccagcgattccagcgctgacgacagctccaatgccggcttcgaagagatccaggtcgacgagaagcactccgatcaggatgttgacgctctgaccgtcaacgccgtgtacttccagccgatcgatatggaaccgtccggcatgggcctgaaggctgccgacgcttccttccacttggaagccgacattcacgccaacgagaagggcactaagctcggctacggcaagggcgacttcgtgccggatctgaccgtgaactacgagatcatcaacaacgcgaacaacgagaccgttgattctggtaccttcatgcagatgaacgcttccgatggcccgcactacggcgccaacatcaagctcgacgaagctggctcctacaagctcgtgctgaagatcgaatccccggagaagaagggttggatgctccacgttgatccggaaaccggcgttgagggccgcttctggaccgagccgctcgaggtcactttcccggagtggaactacaccccgcaggagtggtgatctggaacgtgaattccggcacatgccaagcgaaacggtttggatgtaagcctgaattcatgttgggattcaactcgtgatcaacgccgttcccgtatcgcgaaacgtatgcaagtagcgcgaatatgggtacggcgttcgcggttgcttggatagtcgttcgacgtacttaaggccgtctggccgagtctacgggcgaacaaccatccaggcaaccgctttcttgcgttttaggggatgcgcttttgggagataacgcgcttttttgggaatcttggtaagggggttccttttgcgcgctgaattcactaggctttgacagggatatacgacgaaaggtgtgagatgctgacgcagtacgtcacggtgttgcagggaacgctggcaccggctttgctgattatggcgctgaacgtgatgctcacggtcggtgagggtcgtgacaagccgttgagcgcgtactggcgtcttgcgggcttcattatcggattcgcgggtgccattgtgttcgccgcgttgcgtgcgaccgcggtgatcaatcagcgtacgttcgtcaattaccccacgttgtggtgttgtgtgattttcgatgtcgcagtgttcgttgttgtgctgttcgcgcgtcgcatcactacgaattggcatgatcatcgcgcgttgcttgatattgcgaatgcgattggcgcttttgcgattgccgccaccaccttccgtgcgttgcctgatgtagttttgcgtttgacgattttcgtggagccgggagatccgatcttcacttcggatatgctgcttcgtgcgcttggtttcgtattgggtgcggtcactgcgattgttgcggcgttgattttccgtacgatgcgttccactgcgattcgttggtcgttcactacggccgtgctgctgctgattgcgctgctgtttgtttcgcatttcactgatcttgcgcagattctgcagtccaagcgcatcgttcatttccctacggaagcgttcctggcgttggtatggtgcattaatcatcagcgtcatatggtcattgccatggtgttggtgttcattattccggtggccgccagcattgtgatgggcttcaaaatcaagccggaaggcgccaatgaggccattgtgcgatcgcatatcgcgttccgtcgtcgtgcgaaggcggccggcgcatggagccttgttgcgatgattggcatcacgttcgcgctcacatatggtgtggcgcaaacgaagagggttattacgctgtctccgcctgaggattattcgctgagcgacggcgtggccaccatcaaattcagccaaatcaacgacggtcatctgcatcgcttccaatacaaggcgaaagacggcacagtgatgcgtttcatcatcatcaagaagaatggtggagcgtacggtgtcggtcttgatgcttgtgataactgcggtgacgcgggctattacgagaaggatggcaagatcatctgcaagaagtgcgatgtcgccatcaacctcgccactatcgggttcaagggcggctgcaatcctgtgccgttcgattatcaggttgaatccggcaaaatcgtaattcaaacttcaacgctcgacgcattgtcgacgcatttccagtgagcggaaagaggtagtcatgttctttcttcgaatgattttccgctcgttcagcaggcagttcaaacgcaggctgctgatcgcggtcaccgtgtgcttgtcggccacggtcagcgtggccatgttgggcgtggtgttcgacgttggagacaagctgaacgccgaactgtcgacgtacggttccaacatcatcgtgcagcccaaggctgatgccgtcgtcaacgacctgtacaacacgggtggtgatgctgacagcagcgcttccggcacttccgaatccgatccgaccacatttttgaaggaatcggatgtaccgaagatcaaaaccatcttctgggcgttcaatatcacgaattttgcccccgaacttaatatccatgctgacgtgaactgcgcgtccgaatcggcggcatcggcggattccagctcctgtaaggcttccggagtgccgattgtgggcacatggttcgcgaagaccctgcacatggattccggcgaatccacggtggcgggtatgaacggcatgcgttcgtggtggaagcttgacggctcttggccgaaagatgatagcgcgcaaggtctgatcggcaccacgctcgcatccaagctcggcgtggccaagggagacaccgtaaccctctacaaaaccaccgccgacggcagccgcaacaagcagcagatcactatcactggcatttacgattccggcgatagcgacaacaacgcgatgtacattccgtcattcaccgcgcaggtgcttgcgaatctgcctgattctattgacgagatcgaagtcaaagcgctgaccacgccagacaatgatttggcgcgaaaggcgtcgaagaatccgaacgcgctcacgcaagacgagtgggaaacatggtattgcaccgcgtacccttcgtccatcgcctaccagatcgaagaggttatttccggttccgtagccaagcaggtgcgtcaggtggccgcattgcagggcgatgtgctgcagaaaacgcaggcggtgatggtgctgatgaccgtgctttcgttggttgcggccgctattgcagtggcgaatctgatggccgcctcgatcggtgagcgcggttccgaattggcgttgctgaaggcgattggtgccaccgatggtgcggtttcccgcctgatgctcgctgagacggctgtgatttcgttggttggcgcgattgttggtgcgctgttgggttcctgtgttgcgcagattgtgggacacgtggtattcggttccggcattacgatgcgtccgatggtgtttgtgctggtgtttgtgctgctgacgcttaccgtgctgatcgcctcgttctcgtcgatccgttcgattctgggactcaaacccgcggaggtgttgcatggccgctgatttcaacctgagttccgtaaactcggccgcggctgcggcctcggtcacgaacggcacactgtgctgttcgtccgcggaggtgttgcatggcaggtgagttcaagacagtccgtaaggggcatgagatgactaatcgcaagatgttcttcaccatgctgtggggcgcggtgttccgccgtcgttcgcgagccgttatggccgtgatcgcctccatggtgggtgctgccacgctgttctgccttgctgcaacgtgtattgccgttccacagcagatgaacgaggaaatgcgcgcgtatggcgcgaatcttatcgtcacaccgtccgaatcaaccgaaaagtccaacggcatcgacaccgataccaccaaagcgttgaaccagatggtgaaaggctcatacagcgcccgttccgccgcctaccggtatgaaagcgtgcgcataaactcggcgccatacacgctggccggcatcacgaccaaagatgtgaaagcgctcaaccatcattggaatgtgactggcgattggcccagcgaaggcaatgtgatgctcggccgtgacgtggccgacgcgctcggcgtctccatcggttcgaccgtgaccatcggctaccgtgcatccgacgatgcgcaggattccggcgctcccggccaaaccgaagcgcaagccatggaaaacggccgcgtttcgtccgacattatggagaacaccggcaccgaattccgtgtcggaggcatcgtcgatacgggcggcagcgaagacggaatcgtctacgcagtcaatgctgacgtggccaaactggccggttccaaacgcggtgcggacgtgatcgaatattccgtcaatgcggtaggtagcgaactcaacgacgtcgtcaaatcaatcaatgcgaatccgtcaaccggcgtgaaagcgcagaccgtcaccaaaatcacctcatccgacacccgcatcatcgccatgctgcaaaccctgttctggatcgtgtcgctggtcgtgctcgtgctgacgctggtcggcgtgggcaccaccatcagttccatcgtgtctcagcgacgcaacgaaatcggcttgcgcaaagcgttgggtgcatcgtcgcaggccatcggcatcgaattctatgtggaatccgccatctacggactgattggcggcctggtcggcactatcatcggctacttgctggcccgcgtgctgtgcgtgtccgtattcgagcgtgccattggcttcaactggctgttgggcgtcgcttcgctgctgttgagcgtgctcatcgccgtcatcgcatccattccgccggttcgccgcgcaacccgtatcgaccccgccatcgttttgagggaggaataatcatgagttccgagaatacgttgaatatgttgcttgaattggatcatatttccaagatttacggcgatttgcgtgccgtcgacgatttgactttgaccgttccgcaaggtgaatggcttgcgattgtcggttcgtcgggttccggtaaaaccacgctgatgaacatgattggctgcatggacacgccttcaaagggttccgtcatgctggaaggccgcaagttggaggatttgaacgccaagcagcttgccgacgtgcgtaagaacatgatcggattggtgttccagaagttctatctggtaccgcatctgacggctgtggaaaacgtgatggtggcacagtactatcattccgtagtcaacgagcagcaggcgttggaagcgttggaacgcgtcggtttgaaggagcgtgcccaccatctgcccggccagctttccggtggcgaacagcagcgcgtgtgcatcgcacgtgcgctcatcaactgcccgaaattgattcttgcggacgaaccgaccggcaatttggatgagaagaacgagaaaatcgtgcttgacctgttccgtcagctgcacgagcagggcactaccatcatcgtcgtgacccatgatgcgctcgtcgcatcttgtgcccagcgcgagattatgctcaaccatggcgtgctcgtcggcgagaagtggaatgatgaggccgcacggaaggcctatgagcaggcgggtggcaagccggcatacaccggttccactacggaaggcgcacagaatggcgagacggccatcagcttcgccgatccgaccaaagtcgcgaaaaccgggggtgaggaataagctgaaatcagccgaataatccaagccatagcactgacgaatcgtacggagcgaacatgagcaacgaatcatcgaatgcgatcaaagtaatcgcactgtctgcggcaagccttgcattgctgtcggcatgcggcgaacccacggcgacgccaatggacgatgaatatgccggaaattccggcgaaagcgtgcaatcgcaggaagaaaattcaaagaacagcggtagtgccaccgactccggcgattctgcggatacggacgtcaaaaaccatgccgacgatccgaacagcactacatccgataagcaagacaccggcaactacgccgacggtacctactcgatcaacggccagtacgggccggtgagcgaagacactatcgacgtgcatgtgacggtcaaagaccagaccgtcaccaatgtggaggttatcgggcatccgttcacgtccatctccaaaaagcaccagaatgcgttcgccgaagccatcaacggtgtggtggacggcaagccgctcaaagacctcaaggtagacaaggtggccggtgccagctggacgtcggaagcgttcaacaaggcgttggacgtggcccgtcaggaagcgtcaatccagtagggccagtagcggcgaaaagcccgcaaacgtacaatgagcgcctcagctacagccgcacccaaagagtgatcaaaggccgtagcgggggcgctcactaagtttcagattactatggcagctctgctctgcgatgcctttcagacggccataacgggccacagaacggccgccatgttctcaggccaaggaatactcgcatcgccatgcaacgccttacaggcgagcatggagccgagtatcgtgctgaacaggaattgcggattcaatccattacggaacactccggccttcatgccgcgttcaacaaactcagaaaaacgcttttccgcaggaacaagtacttgattggcaatcgcattcaacgaagtgttatcagacgaaagcaccacaccaacggccttcaaaccaaaatcgctgtcgaaaaaacaaccttgaatgcgttgcaacatcgtcagcaaaccgtttttcgacaactcgacatcgctgaaatccggtaatcccgcaacttccagctgcacacggtgcaacagatcatcagcattcttatagcggcgatagatcgtggttttcgcaacgccagaacgacgagcgacctcttcgatggtcaccgcgccgacgccatcggaaatcacaatcgcaagcgtggccttcataatcttatgatcggtctgctcacgaagctgctcgcggcggctctgcgccttgcgaacagcctcatgcacgtcactgaccgcgtcggaaaccacatcggaaacggcttcggaaaccgcctcatgcactccggtaatcatgagatcaccttggtgctttccaccttcgccacataccacttgttgaacttgaccagaggaatacgcagcaccaggccaatcagcagcagcggaatcaggaacaacagtagcgagccgagcgcatgccagtaatcgttgttgtaaataccggcaattgccgcacgcaacgccacaatcgaatgcgtggccggcaggaacgggctgatatcgctgatgatcttcggcagcacggccagcggatatgcgccattcgagccggaaatctgcgccactagcaccagcacgccaatagccttgcctatattgccgaaactcgccaccatcgtgtacgtgaagaacgagaacaccaaggagctcgtccagccagccagcatgaacagccatggatgcaccgcctgcacatgcagaaacaggagattgccgcccagcgagaacgtgctctgcagcagcgcgatcacaccgaacacgccataatggccgaggaacagctgatgcggcttcggattgtcaagaccctcacggttcttgcgtgaaacgccgggtttcagcgttacagccataagcagcgaacctacgaatagtggaagaatcgtgtagaacggcgccaactgcgagccgaaattcttaacagggaacacagctgtgcgcttcacctggacgggggccgcgagagccgccgccagtgaatcggtgttattgccgagcacttccttgacggtgtccatattgccgctgttcagtgcgtcggaaagcgtgccattgaacgaagacagcgcggtgcccgccttggtgaggctttcggcggtggaatcaagcaccgtgcgaatattggtcagctgcttgtctgccgacttcgtggtgctgttgagatctcccaacgcgcccttcagatcggcggccgtgctgctcaatgcggtgaccgtgttgctgatcgaatcggaaatatcgttgagctgcggcttgagctggctgtcgaaatcggttttgatgccgtcgatggaggccttcgcctgctgggcgagctggttcacgcgctcgcggtcggctgtggtgtcgctcactttcgtgtcgatattgtcggcgctggtgttgagtgagttcgctagatcgttgagttgcgtaatggtcgcgcccacgttggttttgagatgatcgatggcgattttcgcgacttccggcatcagattgttgttgctgagctcgtcgagggcgtcgtagatgttctggtagctttgcgcctgcttggttacgtttgcggcctgattgcgcagggcagtggccgtattgccggcttgggtgcccgcattgttgaatacgctgtcaatatcggtggagaccgcgccgaagctgttcgccgagctgttcaacgcggtgctgagagcgttcgtgctggttttgacggctccggtcagatcgttgatgctgtttttcgactgtttgagctcgttgccggcgttcttcgcgctgtcgctcacgttggaaagcaggctgttggaactgtcgagcaggttctgtgcgctcaatgtcagtgagctgaacgtggtcaacgcggatgacgtgtcggtgagcgtgttcgcgaaattgcccatgttgttgctgaagttggtgagcgtggcctgcgattccggtttgtcaagctcgtcggccagctgcgaggtgatgctgagcgcggtgctcgtcaacgtttcggagaacatttcgttgatctgcgctgctacggtgtcggctccttggccggtgatctttggggcgagtgcgttcttcttctcgttgttgtagtaggtgagcgtggcatggtcgccgtctgcggtgaagaacgtcatcatgcgggtgctgaaatccttcggaatcaccactgccgcatagtatttgccggatttggtgccgtcgatggcctcttttttggtggtgaaggtccagtccatctggtcgttggcgcgcaaggtgttgaccacttggtcgccgatgctgatctttactggaatgaggtcggacttgtagccttcatcgtcgttggcgacggcgaatttcagattgccggtattggcgaacggattccagcttgcgctgatgttgaaccaagagaacagacccggaatcaccaccagtccggtaacgatgatgatggagacgatgttgctggtcaggcgtcgaacgtcgccgacgaacagtttccagatgtttttcatgcgttgctcctttcgctgttaccgttgggattggcgttgctcgctgtgccggtgttgccggccgcgttcatggcctgtaccagtgttgcgacgccgtcggcgtcggcttggttggtgcctgcgacgttggcgatcgcctgtttggtttcgtgttttcttcgtcgtgccttgcgcatcaacttgtctcgcctgttttgttgcgcgcgcttcttgcggcgcagcctcgcagcttgacgttccaccagctgttcgcgaatcgcttcgtcgctgaggctgccgagttccacctggcgttgcaggctgaaacgcatgtattcgatgaccatcaggaatccgatgatgagcagcacccaaatgatccaggtggcaagcaccacgctcttctcgccgttggtgaaggagaagatcagcaccagaatcactggcacaatgaaaccggcgatgagcgcgccacgcttgagcttcggatacagttcggcgaaacggcttgcgcgttcctcgatcgcctcacggtagccgcccttgtcggcaagcacctgaatggcttgggacacgttgtatccgcgttccggaagctgcacttcctcgccgatgatcatgtcgctttccttgatttgacgggcgaacaggcggttgagattgaccagcagcgggcgaatcgcaagtccaatgaagaatgcggccacggcgaacagcagcagcgtgccaatcgacttgagccaatgcccatcgtagaagccggcaatcgtctctcggaacgcgtcaatcgaataactgaatggcacgaacgggtagaccatgcggaagaatttcggcatcatctcaatcggatacaggccggaagcgcccggaatctgcacgataaccaacgcgacacacaatcccttgccgatatgcatgaacgtggtcgatagtgcgaatgtgatgctcagatataccagcgatgtgatggcgccggtaagtacgaacagcggtgcgttcacggtctgcacgccaagcagcaggtcgccgatggtggtgatcgtgccttgggccgcgcccatgatgccgagcagcatgtagcgggcgaaatatttttcggaagcggtcaggtcgaggccttcgaggccttcatcgtcgacttccaccttgaagatcaccacgaaggcgaacgcgcccacccacagggccagattggtcatgagcggagccatgccggaaccgtaggagtttatcgggtacacgttcttcgtgtcgatcacggtgggggactgcatgaacgaggcgattttctccgtgtcgagggaactgccgccggtcaggtttttcagcatgtcgacgctgccgagtgccttcaggtcggtgctgacggtgatgagcttgttctccacatgttcaagctgcttgtcggtgttctgcagggtggtgcgggtgtcgttcgttacctggtcgagctggtcgagcacggcggaggtttgggtgacgatggtgttttggctggtcacggtgccagacagcgtgccagcggtcatggcgagcgagctcaggcctgagttgagctgggggagcgcgccggaattcaacgtgttgcgggcatctcccatgcttttcagtgaattttgcgtgctggtgttgaagtcggtggcgagtttggacacgctgtcggacgtggattgcgtgttctcgctcaacgttttgaggtcgttgagcgtgccagcggccgtgttgttggtgtcttcaagcttcttgatgatgtcttggtactgcgtgttgtcgctgacgttcttgagcttctcgatgagctgggcgttacggtcggtcacgctttgcatgctgctgacggcctgctgtgcggctccgctcgcggaagagacggctgtggtcaccttgttgatgctggtggtggtgtcgctggtggcctgcgaaatcaggccggaaccgttttccaaagcagtgttggcgttggaagtgaaggtattgagaccgttctgtgtggtgccgatggcggtggcggtgttcgccaggcccttgccggcgcttgctgcggccagttgcacgtcgttcattgcctgacgtgcggattgcgtttgttgcggcacgttggcgagctgtgcgtcaagatcttcgatggtggagcggatgaggtttacgttcttctgggttttgtcgagttctgctgtggtttcgttgacgaaggagttggttttgccgttgatggtgccgttcgcggagttcacggctttagtgagtacttcgctgacagtggagacgaaggtgttgttgacggtacggtcgacggtggtcgcgccttgatcggtgattttcggggagattgggctcgatttttcgttgacatagtattccagcgtcggccggttcttgctgtcggtcacgacgttggcgagatcctcgctgaaattggaggggatgatgattgccgcatagcagtcgccggactgtatcgcttccatcgcttcggccttgcccatgaattcccagccaagctggtcgttgtctttcagcgtgtcttcgatctggtcgccgaggttcattttgccgagcagggcgttgtcggtgcctttatcgacgttggccacggcaactttgatgccttgggtgttgccgtacggattccagaatccgtagatgttgaaccatgcgtacagcggcggaatgatgattatgccgatcatgatgacccaggcggcgggtacggtgacgagtcgtttgaggtcacgacgcagaatctgcagtacgttgcgcattgtctccccagtccaatggatgttcgaccgtgttcgcgcgtagcgatacgttatccgtagcgctacgcctcccgtatcgtaatacccgttctcggacaaatttgggcacggacgtaaatgcgctccgcccatgactgaaataaacacgacaaactgcggcggaactgtgaatcttgccgttaatgaccgcacaacttgcattctgtgcatgcgcaagtcgagtctgttgtctgcgatcttgtgattacgagatggcacgtgacttgtgcagacagcaatcgcaggttgtgctggttgcgcacaaacaatcctctcgtgtagcgcactgcgattgggttttggtagcgttgtacaaggaaggacgaatagtatgggcagaaccgaagaagtgagcgcggccatcgccgacgaaaccgaaatcacagcgatcgaagaggccggaatcattgcgcaatcaaaatcggcggaagccgacgacaatccggccgaccgtagactgccgctgattgcacgcatttacggcatcgtcatgctggtcgaaggcgtggtgacgttgccgatcatcgtgatttcctgcctgtatgcagtccaagccgcgctttccggcaggctggcgtttggcgcgctgaacctcaccactattctgtcggttattcatgctgcggtgctgctggtctccaccgcatgccttgcgattttcggcatgctgctgattctcaacaagcgtcggcacatcgcgcaatggacgtatttgatgattccgctcacgcttgcggaaggcctattgtcgttgtcgttgcagggtttgggtgtgaatctgatcagtccggtcgtgcagctgcttgtattggttgcgttgcatattacggccgatccgtcgctgcgcgaggagcgtcgtttgcagttcgcgcttcgtcgtttggatgcgcgcagcgagtatgagacggctgtttcgaagggcatggccggccgtgatctgactggcaaaggctatatttcgttggatttcttcaacttattctggctgtttgtggtcggttgcgtgtttggtctggtggtggagacgctgtaccactatgtgctgttcggcgaatggcaggatcgcgccggatttttgtgggggccgttctcgcctatctacggttttggcgcggtgattctgacggtgttgctcaaccacttgtggcggtcgaattggatgctgattttctgcgcgagcgcggtgattggcggcgcgtttgaatatttcaccagctggttcatggaagttgcgttcggtattcgcgcgtgggattacacaggcaaatggctgtcgattgatgggcgcacatccggcaaatacatgtttttctggggaatacttggcttggtgtgggtgaagctgattctgccgcatttgcttgcgatgattcagcgtattccgtggaagattcgctatacgttgacggcggtgtgctttgcgctgattttcgttgacggcgtgatgacgttgatggcgctggatgcctggtattcgcgtatggcgggtattgcgcagaattcgcctgtttcgcaattcttcgccacgtatttcgacgacgacttcatggccaatcggttccagaccatgacgctcgacccgtctactgccggtcgcatgtagcgggctggctgggctgggctatgcggcgaagctttgtgcgagctggcggatcagatccggcctatgtccgctccatgaggagttcggtgagatgacgaccggaatctgtttgaaaccagcgtttttgatctgttcgaaggtggacgggttcttcgtcagatcgacggtgtcgtaacgcacgcccagctttgcaagctcttgttcggtggcttcgcattgcgggttgctcggattggtgaagacggtcacggtcattcgatttcctccctatgcaaatggctttcgtcgtttgtgaaagccgtgtcggccacgttcttcggttatgctcgcttacgcaagccactatctagcatacacactaccggtagtggtgtgtcgtgagatccttcactgtatatagtggggaattccccagaattcccaaaaatacgaacgtttgttcgaatatgctccagtgtacctcaaactacggaattcgcgtctgagcgcatgtcgcaatccagttgccatttatggtgggcgcatcgattgaaaatgtgtgttgatgggtgtggggcgaatgcaagcggctttcgcgtgcggatgtggccgtgactactcgattgagggaagggaagtacatgtcacccccccccataggatgtctgatggggtgtagcgcgagttttcccgtgcgaacgtgtcgaaaaatccgacttcctgacttactttggcgtggtagtgcgcttggtgtgtgtggggaacttcaagggggttttgagcgttctttagggaaatgtatctacgctatgctgaagtctggcggttttccgtcggaaataggaaaaccctggaagtcgaatggcttccagggtcgtggatggttggtcgctggcaagggcagcgcatcagagtgcggaagtgttttcgaaggctcttccgcacttgtcaactgcgtttgaggtatagccctcgccggcagccagccaagtctttatactaccccccccccataggcatactcggattatgagagggcgtgtttgcgaagtcacgtaatcaatagaacgacgatttggcttcgtgcaagctttccttgaaaatcatcccggaaatcatctcacacgaagccaaaccagatcattcctacgtgaacgacgcttcggctaagctaagctcaactgggctcaggcgcgcttgcgcagcacggtgatgccagcgaagccgagcagagcgagcacagcgaacaccgcaacaccgccgacggtggcaccggtgttgccgagaacggccttcttgatcttctgggcaacggtcttcttggtgttgctcttggtgtcgttcttcttggtggtgtcggccggcttgctgtcatccttcttggagtcgtcggtcggagcgtccttgtacatggcgtacacggcccagttgccggtcacgaccatgtccgggtcgaccggaacgtcgccgtcgttggaggcgaagccccagccggtgaagatcttgccctcgacggccggtgcctggatgccgagcgcgtactgggagaacttgaccttgtccttggcgtagtagccgacggtctggatgagcttgtcggtgcctgcgtagaaggagaccacgttctgggtggtgtcatcctcggtcggagcgtccttgtacatggcgtacacggcccagttgccggtcacgaccatgtccgggtcgaccggaacgtcgccgtcgttggaggcgaagccccagccggtgaagatcttgccctcgacggccggtgcctggatgcctgcggcgtaggtggagaacttgacgtggtccttggcgtagtagccgacggtctggatgagcttgtcggtgcctgcgtagaaggagaccacgttctgggtggtgtcatcctcggtcggagcgtccttgtacatggcgtacacggcccagttgccggtcacttctgcgtccgggtcgactgcgacgtcgccgtcgttggaggcgaagccccagccggtgaagatcttgccctcgacggccggtgcctggatgcctgcggcgtaggtggagaacttgacgtggtccttggcgtagtagccgacggtctggatcagcttgtcggtgcctgcgtagaaggagaccacgttctgggtggtgtcatccttcttttccgcgttcttgtacatcgggtagacggcccagttgccggtcacttctgcgttcgggtcgaccggaacgtcgccgtcgttggaggcgaagccccagccggtgaagatcttgccctcgacggccggtgcctggatgcccagtgcgtactgggagaacttgaagtggtccttggcgtagtagctcacggtctggatcagctcgttcttggtgttgtagaaggaaaccgtgttcagagtcttatcttccgaagccggagtgttcttgtacatcgggtagacggcccagttgccggtcacttctgcgttcgggtcgaccggaacgttgccgtcgttggaggcgaagccccagccggtgaaggtcttgccttcgactgcgggtgcctggatgcctgcggcgtaggtggagaacttggccttgtccttggcgtagtagctcacggtctggatgagcttgtcggtgccggcgtagaaggagacggtgtactgggtattgtcgtcctgtgccggagtattcgcgtacgtcgcgtatacggcgatattcccgcacaccggatcggtgtccttgagcatggggccctcggagtaagcccagccggtgaaggtcttgccctcaacagtcggtgctgtgatgcctgtggcgaacatggagaacgcggtgcccttttggtagccggtcttctggataagagtgccatctgcggcatagaacgagacttcgacaatcgtggagtcgctctgagtggacacggccgagttctggttctggtcaccttcggccattgcgactgccggtgccaaggcagccagagtcgctacagctgcaacgcccgcaataatctttttgctaaaagacatttggggaaaccctttcttagttacgtaactaattgccccaaagcgatgccttcgaaataccgccctgaatgcgtggcgttccccctcataagaattccagaaagccatgatagctgccccctagcgactttttccagaggctagggcgtgttcgttggaattgcaatctttctcgattcccacactttcctattgccgttgtattggcggaagccttttggaatcggcaaggtgccatcccgtcaaggcgtcttgcctgtaagggaggaatccgacggtggcgatggcagggtgtttgccggtgcggatgatgatgtgacaatccgtgtttggggtgcgaacaatgtgagctcgtctaattgcatctggagccaaaaccgcgggaattgaaaaacccttggaatctaatgtttccaagggtttcatatgtgccccccgtgggattcgaacccacaacccacgacttaaaaggacgctgctctaaccgttgagctagaggggcaacaaagagctagtatacagcatatttacgcaaaacgccacacaaatcagctataagtgacaaaaaacgtggattatcaccaagtcatcgccgaatcatcatcgaattcccgcgaatcgcagcatcatttctgcatatctgctcgtacagtggaatgcatgtcatgtaccacgattcttataggaaagaaagccagctacgacggctccactatcatcgcacgcgacgatgattccggttccggccgttacgatccgaagaaattcattgcggtcgcgccgcaagaccaaccgcggcattatcgcagtgtgctcagtcatgtcgaaatcgatcttcccgacaatccatgccgatacagcattgtgccgaacgtgctgccaaatcgcggaattctcgcggaagcgggcgtcaacgagcacaatgtggcgatgagcgccaccgaaaccatcgcagtcaacgagcgcgtgctggccgctgatccgctcgttgagttgcaaccggcgaacaaagccgctaatacccctgaaattccgggcggaatcggagaagaagacatcatcacccttgtgttgccttacgtaaccacggcacgcgaaggcgtcgcacgtctcgccgaactgcttgaaacatacggcacctacgaatcgaatggcatcatcatttccgacgtaaacgaaatctggtatgtcgaaacgatcggcggacatcattggatcgcccgccgcgtgcctgacgactgctatgcgaccatccccaaccagctcggcatcgacgatttcgactttgacgacgccttcaacacccaacgtgaattcatgtgcagtgccgatttgcgtgaattcatggatgcgcaccaccttgaccgcactatgagcgcggctgcaagtagcggcttcggattccagccgacgagcgctttcggaaacgtcaatatgaacggtggcagtaatagcagtagcggcgcggcgctgagacgcaaccatttcaatccgcgcacagctttcggcaccgccaccaccaaagaccgcatctacaacactccgcgtgcctggtacatgcagcgctacctcaatccaagtgaggattgggattcgccggccgcccgatatacgcccgcgtccgacgatattccgtggtgtcgcgtgcctgagaacgctgtgacgctcgaagacgtcgatttcctgatgagcgcacacttcgagggaaccccttacgacccgtacggtactctcggaacgtcggaaagccgccatcgctaccgtccgatcggcatcaaccgcaccgggcatatggtggccatgcagatccgcccgtacgcgccggaaaccagccgctcgatcatgtggatttcgtacggttccggccccttcaccgcggccacgccgttctatgcgaacgtcgacgatacgcccgcctacctgcgcgacaccacgccggaagtctcgaccaacaatctgtactgggcgaaccgtttgatcgccgcgctcgccgacgcgcatttctacgaaaccagcaatgcgatcgaagaatttgcggaatcggcccgcgcgtatggtcatcgtctggtggaacgtactgatgccgaattgcgtgagatgaccgcgcagtcgagcgcgtccgaatcacaaaagagtacagaaaccgcggagattacggaagacgcaagtattgcaatcatcgccagactgcagcagtccaacgaagaaatggcggaatacttgcgcactcacgttacgaaactgctcaacgacgtgctctacacgtccagcaatctcatgcacaacagtttcgccatgtccgaccgctggaactgagcataaagtcttgaaatccggcaaaacccgtcccaatgagctaggtttccgcgctcggggcggttccgcatgaacgtaggctgttggaagcgtcagtgctgcttccaacagcctcacgactgcatcctcgccccgtcgtcagttctgccatatataaggcagatagtgccatccagaccgtcgattgaccatcaaatcgtcggaaatcgcaatcagttgaacccgacgacgtgttccgccacgaaatatcccttgcgaatcacgaaacgaccgattgacccgcgcaaattcaacgcacgagacatggctttcttgcgcacatccttgtaaatagtgggggagtacgccttaatgtcgtcccacatatcctttttcttctcataattttccggatcgcgagacaaaatcatgaacacacttgccacggaactttcaatcgccaggaagtggatcatataacggtacaggccgtccggtaccgtgtcgcgttccggagtggcgtgcaccatgcactggttgacgaggcgcagctggtcgacacggcggatcatcacatcggtctgcacgctttgcccgtcgcgcccgatgaaatagtggtagaacggcgtatccaaatacttcatggtcttcacccacgggaatggttggtacgcgtaaatgaaatccacgtagaacgtgtgctccggcagttgcatgccggactctcgcaccacggaagtacggtacgtcagcgcgtgcatgagaatgtattcagccaagccgaaatgcccaagatcgttccaagtcaggcgctcgccggccttcatggcatggcggaagttcactacatgcttgttgcgtttgccaaccttgtcatacacataattggtgacgagcatgtcgatcggctcggtggaatcggcctcttcgcgcagcacggccatgacttgttcgagtgcttcgggaccgacccaatcgtcggcgtccacgaccttcacatacatgccgtttgctgccgcgatgccggtgttgacggcccctccgtgccccctgttctcctggtggatggcgcgcacgatgcctggatagcgggcctcgaatttctgtgccatttccagcgtgccgtcggatgatccgtcatccacgatcagcacttcgatatcgtcgttgcgcttcgctgcgattaacgacatgacgcatcgttccaaatattcggtcatattgtacgcgggcaccacgaaggtgagcgtcttcttctcctgcatagtcttccttggtcggccgaggtgaccttccgcgtgcgcgtggtcactgcgtaacgaaactaacgtagcaccttgttcgcttcaggggaacggtttgtgcgcaataggcaccctgaatagttcaatctgcacctgaaatttcccttaagggtatcgttgttgacgattcgtcggttttcgtcgatgtttattggctgttgtgctgcttacgattcctctgttgcgggcactgtttaattcctgcgcttggcatctgttggagtgggctgcgatgcttgcggtgacagggtgcggctgggtcttacgactgctgttcggcttgtgtgtcttggcttccggctgcgccttgttcggtgttctgttcagcgttctgcccggctgggctttccgtattgttttgtgattgtgcctcttttgcggccttgcgctcacgtttcgcgatttccttgatttcgcgcctttcctgcttctccgcctcttttgcggctttgtcgctttcgaaacgcagttccggcttggcttccatgcggctcaagccatgccaggccagattcacgatgtgcgcggcgagctgctccttgctgagcttgcgctggtcggcccaatattggcaggtgtagacggtcatgccgatgagcatctgcgcgtagtacggcacgcccttggcgggcagatgctgccgcttgaacgcctcggtgagtatgtcttcgacgcggatggagatgtcgccgagcagcgagttgaatgatcccgcgggatcggttttcggcgaatcgcgggtgagcacgcggaatccctcggcgttctcctcgacataggtgagcagtgcgagggcggtgcgttcgacgatctgccgcggatgcgcctgcggatcggatagcgcgttgatgagggtgtcggtgagcgcgcgcatttcgcggtccaccaccacggcgtacaggccctctttacctccgaaatgctcgtacacaatgggttttgacacttttgcggtggcggcgatctcctccacgctcactgcttcgaaacccttcgacgcgaacagcgaacgaccgatttcgatgagctgctcgcgccgctgatacgacgtcattctggatgtgttagccatgctgtccagtttttcacgtcccgtggatagtctgtccgattctgcagaatcggacaattgtggtgcgtttgacggtgcttacttgtccgtttctcccgaatcggacattcgtggtgcgtccgcggggcggggccggagtgtccgttgcgctttttaggctggagccatggatacgaatgtgattattgcgattgtcgctgttgtcgttattgcggcaattctagtgattggtggttggtggctcggtaagacccgcaagaacgccgtcaacaagtccactgaggatgcgaaagcggctgctgatgcccgtcttgctgcggaagcaaagtcggctgcggctgattcttccacggtgaagccgtccgttgattccaatgttgatgcagctgaaaaagctccggctgaaagccagcagaagtcctcagctcaagcttcctcttccgaaacggcggctcctgcaccagccaccgaagccaagcccgaaccggttcatgaaacccccgaagccgccggcacacgcatgcagcgtcttaaggcgcgcctgtcgaaatccggcaatccgttcggcaaggccctgttcaacatcctcgccaaggatcagctctccgaagctgactgggaggacgtcgaagacacccttctgcttgccgatgttggcgcggaagccagcgaacagcttgtcgaggaactacgcaacgacgcccgaatctcaggccagtccgatccggccgaagtgcgtgccgcgctgaaagacaagctgctgaagctcgtaggcactgacacggatcgccgcctcaatgccgataaggaaggcgcgaacaaaccgaacgtcatcatcatggtcggcgtgaacggcacgggcaaaaccaccactgcgggcaagctttcccgcctgctcgtttccgaaggcaagcaggtcatgctgggcgctgccgataccttccgcgcggcggccgccgaccagttggaaacttggggtgcgaaggtgggcgttccggtcgtgcgttccgacaaggacggcgccgatccggcgtccgtcgcattcgaggccagcgccaaggccaaggaagagaacgtcgacgtgctcatcatcgacaccgccggccgcttgcagaacaaggcgaacctcatggacgagctcggcaagatccgccgcgttaccgaaaagaatcttccggtcgacgaggtgctgctcgtgctcgacgccaccaccggccagaatggcatgacgcaggccaaggtgttcgccgaagccatcggcattaccggtgtggtgctctccaagcttgacggttccgcaaagggcggcatcgtgatttccgtgcagaaggagcttggcgtgcccgtcaagctcgtcggcctcggcgaaggcccggacgatctcgccccgttcgatccggaaggcttcgtcgacggcatcctcgcctgagatgattacgctctcgagaaagcctccccgcgtgggaggctttctttttacccccgaccagtcctatctcgcctatataaggcagatacgctgaaaaatgggctgatattggttttgtcctgggagtggtgcgcaatctgaaacaaaacatgccagccgctttattccgccattttcggttggcgtaatggcgagatggcgttaccttgctgtaacacgtcgtaacgttttcaaaacgcgggcggcgttccataccgttttgtcagccccatacgatggggccggaaatgtgaactcaaaaagaaagaaagaggagggtgacatgggtcagcttgattctggaaatgccgcgtggattttgacttccgcgtcccttgtgttcctcatgacgccgggtgtggcgttcttctacggtggcatggtccgcgcaaaggccgtgctgaacatgatgatcatggaggcggccgctctgtccgtcacaatggtgatctgggtgctgtggggctggtccatcgcctacgcaggaacttcggtcggcggtgtcttcggtgatccggccacgggcttcctgttgaaggattccatggtttccgacggtggcgtcttcacgtcggcttcactgaactccaacaattacccggtcagcgtcgatgtggcgttccagtccgcattcgccatgattaccgtcgctctgatttgcggcgctatcgctgaacgtgtcaagtactccacttggatgattttcgtcgcgctgtggattaccttcgattacgctccgctcgcccacatggtgtggaatggcggtctgctgagcgctgacggcgcgatctcccaggccatcggcgctgccgcccacgatttcgcaggtggtacggtcgtgcacatcaatgctgcagtcgccgctctggtgatcgtgctgatcatcggcaagcgcaagggcttcggcacccagccgttccgtccgcacaatgttccgttcgtgatgcttggcgctttcctgctgtggttcggatggttcggcttcaacgctggttccgcgttcgcagccaacggcaccgcaggctacgcttgggtttctacttccgctgcaaccgccgccgcaatgctctcttggggcttcactgagaagatccgtaccggccactacaccgccatgggtgccgcttccggtatcgtcgcaggtctggtcgctatcaccccggccgccgatgtggtttccccgctgtgggccatcgtgctcggcgccatcgctggcgtgcttacctgcctcgcttgcggcctgaagttcaagctcggctacgatgattctctcgacgttgtcggcgtccacggcgtcggcggcttcaccggcactgtgctcatcggcttcttcggcgaaggtaccggcctgttcgcaggcggcgactggaagcagctggttgtgcagctcctcgttgccctcgttgccatcatctggtccgctgttgtcaccggcatcatcgccttcgctctggagaagacgattggctggcgtgtcaccgaagctcaggaagtcggcggtattgatcttgccgatcagggtgaacgtgcttacgattttgctggtaccgccagctctgttctcaaggaggtgaagtgagatgaagctcattaccgctatcattcagccgcataagcttgacgatgtcaaggaagccctcgctgccgcaggtgttcacggtctgaccgtgtctgaggctaacggttacggccgccagcgtggccacaccgaggtttaccgtggtgcggaatacaccgtggacctcattccgaagattcgcatcgaggtgctgtccgacgacgccgatgccgagactctggtcggtgtgatcgtcaagtccgccggctccggcaccatcggcgacggcaaggtctgggttgccccgcttgactcggtgacccgcgtgcgcaccggcgagaccggctctgccgctatctgataattcattcggatagatattaaggactccgggcttaggttcgggttatcaatagacagatccccgtacgtgcttcgcgccgtgcggggattttcatacgattttcgcgtcagattgtctgcttcggatttcccttatctgctcagatttgcttgtttttgcgaagattcataaggatttgctatgacttcagcggttgatggtcttaaacaacgtttcatgaatataagtcagccggatgccgacggcgtgtaccgcaatggtgcggcgaagcgcaaggctcgtacggatctggccatggattgcctgacgaagttgtggcaggaggcctgccagacggtttcttttgacgttccgcaagttggtattggtcttggtgcggtcggttcgttggctcgcggccaagttggaccgagttccgatcttgacttggtggtcatttatgagcttcacgcgcttactgaccagcagctcaatgagcttgccaacaaattgtggtatccgatttgggattctggccttgatcttgaccagtcggtgcgcacccgcgcgcagtgcgaggcggtcacagaccatgatctgcccgccgcgatgggttggctggatgtggtgccgatagcgggcgacacgcagctgatcgaatccacggccgtctccattttagagcgttggcgtagggccgcccgtaagcgcttgcctgaattgttgggttccgccaagtctcgtttggacgagttcggccgtatggcgtacggcaatcagcctgatattaaggagtctcgcggcggtttgcgcgattccgtgctggtatccgcgcttgccgcttcttggcttgccgaccgcccgcacggccagtatgacgatgctgtcgaacggttgttggatgtgcgtgactgcattcatttggttgccgccaaagacacgaatatgctgcttgctccctatcaggcgagggtttcggcgatgttgggtttggctgatccgacgttgccgagcggcgagcgtgaggcgaagtcgattgatgatttgcagacgttgctcgctcgtgttggccgtcaaatcgcgttttcgcttgattctacggcttcccgcgccgagcattcgttgactcatgagaagcctcgttttgcgttttttcaggtgttccagcctcgtggcggtggcaagcgtcaggcgcctacgtttgatgtggtcgcgcccggtattgccaagcatgaggaggagattgtgcttgcgccgggtgccgatccgaagtctgacccgtgccttgcattgcgtgcggctgttgctgcggctgagtttggtctgccgattgcgcccggcacgttgcagaatctgaagtcatgtccgattgatgatcgcacttggaatgatgagtcgcgcagtctgttcttgcgtttgcttgcgagcggtcccgcgttgttgcaggtatgggaggagattgattttgttgatattccgggtcgtttgattccggaatggttggcgattcgtaatcgtccgagcgcttcggctgctcatcgttacacgattgaccgtcattcggttgaggtggtcacacggcttggtcgtgaaacacctcgtggaaaccgttatgatgatcggcattatcaggcgttgctgttggctggtattttgcatgatatcggcaagcgtccgtgggttgccgatcatgctgcggagggtgcccgtcatgcgtccacggttttgaaacgtatgggttttgaccgtgacattatttggtgggtcacgttgctggtgcgcgagcatcttacgttgtcggaatttgcgactggccagaatcctaatgatccgaatgttggtgacgaattggcctcccgtcttgatcatgatccgctgctgcttgacatgctctttgacctgactcgcgctgacggttcgtcattgggtgccacgtccggcgagaccatttccaaacagtacggctggagcaaatggcgcgaaaccctcgtccgaaccatgtacaacgccacccgctatcacatgtgagtccgtgtaggccgtgggcgagtgtccggcaaagcgactggttaccaatatggcgcccgccgcgctgtcgtatatgcgctatttaagaaaaagtggggaacatatcaccttcagttcacttaagcaagtcaaaaccaggggaatagacgcctgtacgaaagatgtccccaagttgtccacttggttatccccatttggtggataactcgatatgttttccacatagttatccccaatatgtggataacttggcttttttcgactttcttatccacagcgaaccgattcgcgcgtgtcgtgtatcatcaactccagcaatgcggagaatcctcgataatctcagcacaatactgttcgtgaagtggcacaggtattatggtttttcccggtacaccacacatcgaagagctggagaagcatggcggagagcaattcttggaacaacggcctgaatcaagggcaaaaccgcggtttttcaggcaatggcagcacttccggaacatccggagcagccattcgcgacgccatctttgaccgtgtgccgccacatgacgacgccgccgaaatggcggtgctcggcggcatgctcatgagcaaagacgccatcggcgaagtctcacagatgatcgacatcaccgatttctaccagccgcgtaaccaaaccgtgtacgaagccatcatcaacctgttctccgcatcgcaacccgtcgacgcggtgctggtagccaatcaactgctcaaagacggcgacctcgaaaaagtggggggatccgactatctgcacagcctcgtcgcatccgtgccgaccgcagccaacgcaaccttctatgccgacatcatccatcagcgcgccatcttgcgcaatgtgatcgcagccggcaccaaaatagcgcagctcggctacacggccgaaggatcccaagccgaagacgtcgtcaacctggcgcaggccgaagtctacgaaatgtcgaccggcaaagtgaggcaggattacgcgccgatcggcaccgtcatcaccgacacccttgaccaaatcgaccgactgcagaacggcgaagtctccaagggcgtaccaaccggattccgcgacatcgacgaagtgacgcaaggcctgcagccgggccagatgatcgttgtggcaggacgccccgccatgggcaagtccacgctcggcgtcgatttcgcacgatccgccgcgttgcaccacaatatgacatccgtgatcttcagcttggaaatgagcaaaaacgaacttgcgcaacgaattatctccgcggaaacgaatattccgttggcagccatgcgccgagcggaagatatcacgcaggaacgttggaatatccttaataatctgcaagataaactgcagaacgcaccattattcatcgacgatagtccgaacatgagtttgatggagatccgtgcgaaatgccgtcgattgaagcagacgaatgacctgaaattggtggtgatcgactacctgcagctcatgacttccggcaaggccgtggaaagccgccagcaggaagtgtctgacttctcgcgtgcattgaagctgcttgccaaggaattggaagtgccggtggtggcgctgagccagctgaaccgtggccccgaaatgcgtcaggacaagaagccgcagctttccgacctgcgtgaatctggttctatcgaacaggacgccgacgtggtgttcctcgtgcacagaccggacgcctacgacaaggaggaccgcccgggcgaggccgacatcatcatggcgaagcatcgtaacggtccgaccgataccttcaacctcgcgttccttggcgcgtactccaagttcaaagatatgccgcaggactatcagagccagcaggaggtataagcatggcgtggaactcattcgcaacgccgttgatcggcaaagccgtgcgagcggcctcccgcttggcacatggtggcggcagcgcgttccccggcaaaatcgtggaacagatcgacccacaattcctcgcacgcacgctacagcagctgccgctcggcgtggtgctcgtatccggcacgaacggcaaaaccaccaccactcgcatggtggcaagcatgctggaatcgttgggattaaaagtgttcaccaacccgaccggatcgaacttcacccgtggcgtggtttcgtcgctgctggccgaagtctcgcttggcggcaaactggacgccgatatcgccgtgttggaactcgacgaagcgtatgcggtgcatttcgtcaaacaagtgcaacctgactactgcctgctgctcaacgtgatgcgtgaccagctcgaccgtttcggcgaaatcgacaataccgcccgcctgctgagcaaagctgccgaagcgaccaccggaaccgtggtgctcaatcgtgaggatccgcgcatcgcacggcttgcagacgtcacgcatactgaagatggtgtggaagtgcgctatttcggacttgacaagtcgctgcgcagcttcttcccttccgacgatgacatgtgcacgacggttgatacggaatcggcagctgatactgaagcgtcagttggtattgacttgtccgaatctgcagaatcggacgaaaatattgagattggcgatgcttccgcaattgcgaaaactggggaacatgcagaaaaatcggaaaatgcagaatctgcggaacagctaccggctgacgtgaccctgcttgccgtaggcgaccatcgtgccagcttcggcatcgatggcgaaacgtacgaaaccggcgtgaaactggaaggtgtgtacaacctgtacaacgcggcggccgcgctggctgccgtgcgagcggtcgtggccgacgcgcaggcaatgttcctgccgttcgaagagaacgtaaccgacgaactgctgcgccaagtgggaatctcacagcgcatgatcgatttcgcgcactccaccacgcaatccatgatcgacgcggcatccgaagtcactccggcatttggacgcggcgaagtcatcgacgtgaacggttcaccggtggagctgctgctcgtcaaaaatcccatgggattccgtctgtcgctcgcatccttcgcccccgaaggctgcgacaccatgatcgccatcaacgacgaatacgccgacgggcgtgacatgagctggctgtgggacgtggacttctcctcgctgcgaggcaccggtgtatctatggtttcaggcgtgcgcgcatgggatatggcgttgcgtctcgaatatgatcaggtgccggtgaatagcgtcaacacggaacttgaagaggccgtctcaacgttcgtgaacgcgaatccgggtacccccaagcatatctactgcacatacacggcaatgctcaaaacgcgagccgcgctcggcagaatcgccgaagtcgccgacgctggcgtgggcaagtgacggcgcacatccgcacaatccggcaaaacgtgcgaaaaacgcatgaaaatcggcgcaacgcatgaaaacgcatgaagaacgtatgaaacgcatgagggagacgatatgagccagacaatcgacatcgtgtcgctatatccgaaagacatgaacatctacggcgactccggcaacgtactcaccatccagcgccgactcgcgctgtacggctacgaaccgcacgtgcacgcctacaatcagagcgacgcgtggcccgaacatgtcgatatgattctgggcggcggcggccaagacaccggccagaagaaaatcatcgacgacttcttcaaacgcgccgacctgttgcgctcgctggctgccgacggcacccccatgctcatgatttgcggcctgtaccagctgttcggcgaatatttcgaaacggtggatggttcccgactcgacggcatcggcgtgatcggcgcgtacacggttggtcaggaagtgcgcatgatcggcaatctgaccgagcattccgccgattttggcgatatcatcggctacgaaaaccattccggtcagaccttcctgcgcgaaggcgtgcagccgctcggtactgtcgacgcggacggcaccggcaacaatggcgaggatcatacggaaggcgcgcgcgtcaacaatgtgattggcacatacatgcacggttcgctgctgccgaagaatcctgcgctcgccgattttctgatccgcaccgccgtggaacgccgatacggttcgttcgatccggttgctgcagggcaaacgcaagcgcagcgtgcggaacttgacagcatcaatacgattgcaggcaacgcgcgtcgcgtggccatgtcacgcccgcgctgatcggccgttcatttttttgcgcgagtttcgcacgatcacgctgtcctgtgtttttgcggcttcgttttcgttttccgtacgctgtgagcatacggcagcgagccttccgcagaattgcgacaattgatcagtttcgttgactttatttgtgaagataatgcgatagagtgggtactaccatcacctaaggaggtaatcatggctgattttgattttggtgacggcctgcgtaaggtcttcctcgccggcgttggcgctttggcgaccacggttgagaagagtcaggaaattgtcgacgatctcgtcaagaaaggcgagctgaccgtcgaacagggcaaggccctcaacgccgaactcaagcacaaggtcgcggaggtcaaggaagcctccgacgccaaggctgcagaggaagtcaaggaagcgaagcctgaagccaaagccgagtaacgttcaatcgttcccatcgccgtctgcgcgtcgcatcacgttcagacggcgatttgctatgcggaacttgcgcgtcatgcgaaacttgcgtgccatgcgaaacatgcgaacaatcgcgtgcgattcgcatgaaacgtgcgaatcgcatgaaatacgcgggacgcaagcccctatgaatcctactcatcgtaatccgaccaacgtttgcgagcagcgatatgtctttgaattccccaatcgagccggacgcggcccgccccgaaagcgtggaaccggtcacactctctgaccgagtcaacgcggtgatcaatccgacggcggacccctcgcccgacgcggcggcggcaacggcagccaaatccgcggaaaaaacgggaatgccgcaatcgcgcaaacagaacagcgcaacctttacgcaacccgaaaccatcggactgttcggctctcgcaaagactccttctcgcagcgttaccatctaacgcgacgcggcaaactgaaacgacttgcgcaaatcgcacagatcgtcaatcagttcgacatcgtgcacggactgacgcccatcaaaatgcgtctcatgttcgaagcgctcggtccgaccttcgtgaaagtcgggcagattctatccatgcgctccgaaatcctgccccaatcgttctgcgacgagttgtccaaactacgcgccgacgccgatcctatgccgtacggtacggtattgcaggtgcttgaggacgaatacgggcgcccagcaagcgaaatctttgaccatatcgacgccacaccgctcggatcggcaagtctcgcgcaagtgcatcgtgcgaaacttaccaccggcgaggacgtggccgtcaaagtgcaacgtccgggtgtgcgcgaaaccatggcgcaggatgtgtccatcatgcgcaccattgcacgaatcgccgccaaaaccatgcgcagcgcgcaagtggtcgatctctccggcgtggtcgaggaattgtgggacaccttcgaatcggaaacggacttcctgatcgaagcgcggaatctggcggaattcaaacgattctgcgaacgctacaaatatatggactgtccgaagccctacccggaactgtgcaccgaacatgtggtggtcatggattacgtcgagggcatttccgtctcgcatcccaacgaacttatcgaagcgggctacgatctgaaggaaatcggcaccaaactggtcgacaattacgccacgcaagtgcttgacgaaggtttcttccacgcggatccgcacccgggcaacattatggtgcgcggcgggcagatcgtgctactcgacctaggcatgacgggtcggctcaatgcgaaaacccgttccgtgttgaaagacatgattttcgcggtcgccgaacaggattcgcccgcgctcgccgacggattgctgcggtttgccggagctgaagccgattccgaagactacccggccttgctggccgacctggatgtgatcgttaaggaattcggcaccgtcgaccttgccgaactcgacatcgccgccatgctcaccgcattgacgcaaatggcgcaacgccacggcattgaagtgccgagcaccgtcaccacggtcgggcgtgcgctggtcactttggaaggcctgctcgacgagttcattccagacgtgaatatgattcagatcatctccgaccatatcgccgcaagcacgtcgaagaaggatttcgccaaggatgaggcgaaatcgctggttatcgaaggtcatcaggcgctgcacagcctgctcgctgccgccaatgagctgaaagtggcctcccgtatgcttacgcgcggccagttgcgcgtgaatatggagatggtcggttcgcaggaaccgatccatctgcttgccaacatggtgaacaggcttacgatggcgctgatcgtcgtcggattgttcatcggctcgtcgattgtgtactatgcgggcatcaaaccggtgattttcggtattccgatcgttggtttcctcggctatgtgatcgcgttcgttttgtccgtctggatcgtgttcgacatttacttcaagggacgttccaacaaaaagcgatgacgctagtctagggggagagtggattcgcgttggatgaggcggcagggaaggtattccgtgccgtggtggggctggccgttgatggcgtccatcaggtagcgggcggctttgcggccgatgagttccgtttcattgtcgatgctggtcagcggcgggcgggagctcttggtgagcacgtcccaattatcgtggccgatcaccgccacatcctcaggaatgcgtagatgctgcgacttcaacgcgtcaatgcatcctcgtgccagctgatcgctctggcataccacggcgtcgaacttcacgccttggtcgagcagcagtctggtggcggcacgcccccaattctcgtcccaacggccatagcgaatcgggccagccggttccaaaccaacctcggccaacgcttccaacgcgcccttggtgcggtcggtggaggccgtatacgtttcatcgccgccaataatggcgatacggttgcgtccgcacgaaatcaaatgatttacggccatgcgcccggcgtccacattgtcacacgtcaccgaacaatcgttggtgtcggtggaaggaccatacacatacaccagcggcacgccccaatcacgccccagcgacgggcgcggattcgtctcgcactgcacaatcagcaggccgtccactttcagcgacagcagtttctctacatggctgcgttccagcgcatcgtcaccgcgagcattggcgagtagtaccgatgtcgattgtgcgcgcagctcgttttcggcgccaataagaataggcgtggagaaacggccttgcagatcggaagtgaccaaaccgatggttccgcttctgccgcttgccaacgattgcgccagcttgttcggggaatagttgagttgccgcgctgcctccatcacgcgctcgcgggtgtcttcactgacgcgcggtttgccatgcagcgcctttgaagccgttgccaaagacacgttggccagcgctgctacatcttcaagccttgctgttgagtgagtatctgcagttgccatgatgttcccctttttttacggtgtgacgaaaacgttggctgcgcgtcgatgcgcttcgccgcccttgtattgcgtaatattatacgacaaaactgcgaaagttttcgcatcgtgtcaaaaagtggacaaaacggctttatatagccgattgctgacattttcacttgcaaattgcgaaactttcgcatttgcgaaaatgaacacatttttctttcgcattttctgcatctcacgtcattttttgctgtcataaacgattcttaaaatgctaagaatcgtttatttataacggttttatcgacatgaatacctttgcattctgatgtgcgaaagcgattttgcaaaatctggagaaaaccatatactgagaaaaggctttcgcactacggttcaatcgaaggagaacaaccggaaatcgtgaaggcagacggcggaaggcccgccggatggctcaaagctgagcgatacatagagaaagaagtagacatggtgtctttcaacaaggtcactcgcgttattgccggcatcgcggcaaccgcgttgcttattccgatggctgcatgcggcggtggttccagcagtggtggatccgcggctccggccgatattccggcagccggcactgatgacggcactgagatcactctgtggacccgttctccgctggagcgtcaggccaagaacgcggtgaaggcctacaacgcctcccacaagaaccaggtcaagctggaaatcattccgaacgacgatatggaaggcaaggttggtggtgcctcccagaccgattcccttccggacattctcgccggtgacgtggtgcgtattccgtactgggcttctgaaggcatcttcaccgacatcaccaagcagatcgacggactcgacaacaagtccgacctgcagcagggccacattgaagccggtaccgtggatggcaaggaatacacgctgccgttcatcaccgacgtttccgtgatggtatggaacaagaatctgtacaaggaagcaggccttgacccggagaagggcccgagcagcatcgacgagttcgttgagcaggccaaggcggtcgcggccctcaacaaggacggcgtggcaggctcctacttggccggccagtccggtggcgctctcgtgttcgacctgttcccgtccgtgtgggctgacggcgaatccgtgatgaacgcagatggcaccgaagccaccctcgacaacgattccatgaaggccgtgctcgacgcctacaaggaactcgccaacaccaccaacggcttgggcgcaggctccaaggaagaaaccggtgccacctggaccgctccgttcgccaacggcaacatcggtgtgatgccgtatccgaacacctcttccaccgcactgttcgaagctgagaaggacggcggcttcgaagtgggtgtcaccccgatcccgggcaccaaggaaggcaagacctccacgttcctcggcggcgatgccatgggcatctccaaggactgcaagcacgtcgctcaggcttggaacttcctcgcatggctcatgagcgatgacgcccagaaggaagtcttcgcagccaacggcgacaccgcatccaacatccagaccctgaagacctcctacgacgatgccgatcctcgcgtccagaccatcaactccgtaatcatcgacggcaatggccagaccccgaagtccgcagctttcaatgaggccttcaacgcagccggttccccgtggcagctgctcatccagaacgcagtctggggcgatggcgatctcaaggccgacaaccaggccatcaccgacgtgctgggtcagtgaggtgagccactgaaaacgaacttctcctcctttttctcctttccccgatttacataacttaagaacaactgaatatcgaataactgaatatcgaaaacaaaaatcgacagaccacagttgtggtctgccatgaagatcgacaatacttcaaaaacaatgtcggtcttcatggcggatttcaacggccgcacgagacggaatcgcacttccaaacgcatatccaatcgcttggccatttatgtcgaaaaccccgaacgattcaagagagagtcgccaaaagtgttccaaggagggaatatgactactgtttccaagaacgctgcgccagtgaagacgcatcgttccaaggccaaggcggaggcaacccgtcgtggcctgctgtatgcgctgcctgattggctgatgatcatcatgctgttcttcgtgccaatcgtactgctcgtcatcatggccggttcccgctggtcgttgatgggcggtaaccgtggttggaatttccctgagaatttcgtcaaggttttcgaaaataaactgctcggacagtcggtgttgttcacacttgaatacaccgtgatcgtcacgattttcctgctggtgctcggccttggcctggcgctgatcgtgcaggaaagcaccaagtggaacaatatgctgcgcacgtgcttcctgctgccgtccgcaaccggtctcgcctctgcttcgctgctgttctacgcgctgtactccccgcaggtgggccccgtcaccaagatcctgagcttcttcggattgatggatgagggcggctccgtgctcgccaccggccagagcgcgctgtgggccaccattattgtgatcgtctggcgtttctccggctactacatgctgctcatgatgatcggcctgcaggccattccgggcgacctgtatgaggccgcgcgcatggacggtgctggcacgtggcgcattttccgttccatcaccctgccgctgatgaagccgaccatcgtgatgtgcctgatctactgcgtcaccggttccatcctcgcgttcgaccagttcttcattctgaccaagggcggtccgaacaattccaccatgaccgtggtgcagcttatctacaacttcgcattcgattccaagaaggatctgggcatggcggccgcactgtcgctgatcgtgcttgcggccctcgtggtgatcaattccatccagatgcgcggtatgcgcgacaacaccaagtgagcaaggggagggaactcacatgactactccattgtggaagcgcgtaatcgtctatattctcgaaggtctgctggctctggtcttcatttcgccgctgatctgggtggtggtctgctcgttcagtccgcagcctggttccgcacaatccaagggctggggtgtgaacaactatctgacgttgttcggctaccaggaaggcctgccgaagtacctgttcaactcggtggtggtgacgttggtcgccgtggtgttctccgtggtggtgtgcacgctcgcaggctattcgttctcccgtttcgactatccgggccgcaatctcggattcatggtgacgctgtccattttgatggtaccgtatgcgtctctgctgattccgctgatggtgtggtacaaggatattggtctgaacgattccttgctgggtgtcggtttggttattaccttgttccagctgccgatgagcacgttcatcatgcgtaatgctttcgatgcgattccgaaggatatggaagaggccgccatggtcgatggctgcaactccctgcagtcgttgattaagattctggtgccggtcgtcaagccgtcgatggtcactgtcggtctgcttgctttccttgaggcttggaacaatttcatgattccgctgtacctgtcgagttcgtcgaacgccacgctgccgctcgctttggtgaacatgcgtcagcagactatgggcgtcattgattacggtgccaccgaagctggcgtcgtaattctgatgatccccgcagccatcctcttcctagccctccagaagtactacgtcaaagggtttatggctggagccgtcaagggctgacacctggcgatgtcagcccttgggagacagcccagtggactgtttccaggctccggcctgagcagaaccgaaggcggagtagccaagagccgtcaagggctggcgaagtccttaatcttaaggaaatatcatgaatgtaactattacttctcctttctggaagcagcgtcgcgaccagatcgttgaatccgtcattccctatcagtggggtgtgatgaatgatgagattgccactgaagttccggatgatccggctggcaatcagcttgccgataataaaagtcatgccgtggagaatctgcgtatcgcagccggtgatgagaccggtgaatttcatggcatggtcttccaggattctgacatatataagtggttggaggaagcggcttacgcactgtcgtatcatcctgatccgcaattgcgggaactgtgcgataaaaccgtcgacctcatcgcacgtgcgcaacaatcggacggatatttggacactccgtaccaaatcaaaaccggtgaatgggcgcatcgtgagcgtttcacactgattcagcaaagccatgaaatgtatgtcatgggccactatattgaggctgctgtcgcctatcatgaggtgaccggtaaccagcaggcgcttgacgtggcgtgccgtatggcggattgcatcgatgccaatttcggcccggaggacggcaagatccacggtgctgatggacatccggaaatcgaattggcgttggcgaagctgtatgatgcgaccggtgaggagcgctatctgaatctggcgcggtatctcatcgacgtgcgtggtcaggatccgcagttctacgccaagcagatcgccgctgtcgacaacgactacattttccgggatctgggattctacaagcccacgtacttccaagccgcgcagccggtgcgcgagcagcagaccgctgacggccatgctgtgcgcgtggcctatttatgcactggaatcgcacatgtggcgcgtattaccggcgatcagggcttgctggatgcggcgcatcgtttttggaacaacatcgtgtcgaaacgcatgtatgtaacgggtgcgatcggttccacacatgtgggggagtcgttcacgtacgattacgatctgccgaacgacaccatgtatggcgaaacgtgcgcttctgtggcgatgagcatgtttgcccgccaaatgcttctgttggaaccgaatggtgaatatgccgacgtgcttgagcgtgagctgttcaatggtgccatcgcgggcatcagccttgatggcaagcagtattactatgtgaatgcgttggagacttcgccggacggtttggacaatccggatcggcatcatgtgctttcgcatcgtgtcgattggtttggctgcgcatgctgcccagctaatgtcgcgcgattgatcgcgtcggtggaccgttatgtgtataccgaacgtgacggcggtcgcacggtgctcgctcaccagttcattgcgaatcaggcaagttttgattccgggttgcatgtggagcagcgttccgattttccgtggaacggtcatattgagtacatggtggaattgcccgctgaggcggctgattcggtacgtttcggcgtgcgtattcccacatggtcggctgattcctatgcgctgacatgcgatggtgttgctgtgaagacggctccggaaaacggtttcgtatatttcgcagttgctccgggaactgcattgcatgtggtgctggatcttgatatggcagtgcgattggtgcgtgccaactctcatgtgcgttgcgatgcaggtcgtgttgcggtgatgcgcggtccgctcgtctattgcgcggagcaagccgataatgccggcgatctgtggacgtaccgtcttgctgatggcgtggatgtcgcggatgccacggttactttcgagagtgatttgcttggaggtgttgacgcggtgacgttgcctgccgttcgtgaggctgcggatgccgtggacgccccgttgtacatgtccgctcagcgtgacgcctcagatgagcggacgtcgctcaagctggtgccctactacgcatgggccaaccgcgaactcggccaaatgaacgtgtggttgcgcagctaaacaaaagaaagacttgctacccggcgctatgagtgccatggtgccgggaagcgggtgagcgcggcgtgatcgattggagccgaatgcgccgcgctgactggaatgagagaccggctgccccttatggggtggccggttttgtcatagcccctagtataagacgggaaaatgcgaaaactttccttttcgcataaaagccatcgtatggcagttcacttagaaagcattggagaaaactgaaagaaaatttgcgaaaccgtattcgcgtcatgtattcttgaaatgtcggtggacgctccaatctcatgtccatcgcacgactctcattcctacagaaagaaagttggatgccagggaacgagccttggcaaccaagggccaacgatggtccatgtaggaggaattgatgacaccatcaacaaggaagaaagggattgtcacgtcattgggcgtgctgacggcagtggccacactgttgtctggcggtgtgatgaccgcatacgccaatgacgcgctggccaatccgaactctgccatggggtatccgagtttcaagggggccgccgacccgattccgggcaccggcgtcgctttcgatccctcgacaagctacctcaagcaggtgttcgatgcggatgttgccaacggtgccggaaccgacaccgcacacgacttctggatcgacaagatgctgacgcgcacaggcaccgcaccaaacggtaccggcaccaacgatgctggcgactacaactatgcgggcgcagacaagaacgaatacctgttctcacgtggccgtgccgcattcatgtacacgcatacgccggaagcacttggtttcgtaggagatgtcgcatactgggatcagaccggcaacgacggctttaccgttgaggtaagcattggcggttccaagcagaccctgcgcgagaacaccgacaagcgcaagcagacgccaagctacttcaccacggaattcaccaacggcgacaagaccattaccgtcaccgaagtcaagtacatcacctacaccaatgtgatggtcgcgaatttcaccatcaccagcaccaccggcggtgacgtaacgctgacagcagcctcgccattcgcacaagacggcaatgacggcgacactgaactgaccggtcgcttcaatgtgaagaacgatctgaccaccatctatccacggttctccggcaacggtttcaccgtaaaggacggcaaactcgcttccaccctcaccttggaagcgaacgtgccacaaaccaccaagctgcagcttggcctgatcgccaacgagttgccggactccaccgcggaatacgaagcccgattcaacggcgatctcaccgatccggccgcttcctacaaggattccgtgaccacctacaaccagtggtgggtcgataacattccttacgtggaaacccaggaacacaatatcgacaaaaccgtgttctaccgctggtggctgagccgtttcaacatgttggatgccaatatgccgggcaatacgttccagtatccgacctccatcgaaggcgtgctcggatacaacaaccagatcgtgctgacatccggcatgttcatcaacgacaccaagtggttccgtaacgccgaatactcgtacggcacttgggtgtcggccgggcagacagccaagaaaggccagtccgggtattactactaccacgacaatccgggcgatccagccaattggaaccacagctacacgcagtacatcaccaaggccggttgggactcctacaaggtgcacggcggcccgtcatcattggctgaagcgttgggtgattacggttccgaagatgtcaaaggtctgctcaattcgcaaagcgagccagacagcaacgacaaccagaatagcaacggcaacaagctgatcgactggtcgtggtggtccatgaccggcaacgatgccgacgcggtgtcgttctccgaacccggtcgttccggccagcgtatggaccgtgccgacggttccgccaacatgtgggccaacgccaatgccgccgcgcaagcatacaaggctgccggagacaccgaaaaagccgctgaaatgcagcagatcgccgacgccatcaagcaggatgtgctcgacaacctgtgggattccgacagcaaactgctgctgcacaagtggctgaacgacggtcaattcgcgaaatacaaggaactcaacaactactatccgtattccgaaggtctgatgccgatcggcaatgatgattacgatagtgcgttgcgcttgttcgaagatgccgacgaattcccgattttcccgttcttcaccgcgaatcaggcagacaagaaggcgctgaatttcccaggatcaaacaatttctccattatcaatgcaactccgctgctgcaaatctattctgcgggaatccgtgattataatgctgcagacaacggatatatcacgaacgaatcgttcaagaaactgctgtattgggtggcgttctcgcattatcagggaggcgacaaccagtatccggaccagaacgaattctggaatatggataataattccgcaggaagcacgattccggagaagaacgccgacgccagcaagaacggtggaaagatcacctaccgttcctggattcaccacacccagcttggcaccaccaactggacgattgtggaagacgtggcaggtatggttccgcgtgaagacaacaagattgaactcaatccgatcgagattcccggttggaaccacttcaccgtcaacaacctgagctaccacgggcaggatctgtcgatcgtatggaacaacgacggcacctacaacgctccgaagggatataccctgtatgtggacggcaacgccgtgttcacctccgataagctcgcccacctcatctacgatccggccagtggaaccgttgaggttgccgatgattccggagcggtgatcaccggcgcgaccaccgccaccatgccgaacgccaacgaagtgacctacgcatcgaacagcagggttacgcagatcttcgcgcagtccggacagaacgtggacgaagcgtccaagagccaggccaacgtggccaaggacgccgatgtggaagccacttacgaaaccaagggatacccggcaaccaatgcagtggacggcaagaacgtgatggaatccttctggggcaccaagggatccaagaacgccaaggattcgctgaccgtaacgttcaagaatggcgtgcagaacatcgacgacgtgcgtttgtacttctaccagacctcgtccagccagacgattgccggctacagtgagccgtcggtgtacacgcttgaatatcaggatgaggccggcgcatggcatgtcctgccgaaccaggtgcgtacgcctacttacgcgggagccaactacaaccgcgtgcagttctccaaggtcgtggccaaagccattcgtgccaccttcactccgcaagcaggtcaggccattggcttgaaggagattcaggcctacgaaaccgacattgtgccggaaggcgaacctacgaaccaggcgccaagcgttgacgcctacattgccagcagcacctcgtccggtgcgcagctggtgggcacggtgaaggacgacggcctgccgtctgacacgctcaccaccacatgggagcaggtgtctggccctgaaaacggcgaagcgaagttcgtcgacgcaaccgctgccaacactacggtcacgttcaaccgtgagggtgactatgtgctcaaactcaccgcattcgacggtgagaagaccggtttcaaggaagtcaccgttcacggcattccttccgacggcacggtgaatgtggcttcacagtccactgcgagcgccagcttcaccaatccatatcaggcgaaggacaatgccaagaaggttatcgacggtcaggtgttgtataccaatactccgaatgagacctggaataattggggtgacaataccggtaccgagccgtggctgcagcttgcctgggatggcactgttccgttgaagaaggcgaagctgttcttctggactgacggtggcggtgtgccgatggtcaagtcgtggaagttgcagtatgcggatgagaatggcgattggcaggatgtgaagcttgccgccggccagtcttataccacgatgcagggtgaaggcaatgaggttcgttttgccgaaacggtggagacgaacaagttgcgtgtgctgttcccgaagggtgccattgttggtgctaccgaatttgaggcgtatgcgcttgatccggtgagcgtggatggcgtgaatcgtatggtgcagactggcagcaaggctgccgatgtgaatctgccgaagacggtgagtgccagctatacggacggttcccgtcgtgacttgagtgttgcgtgggatgccatcactgacgatcagcttgcttccgatagcgagtttgcggtttccggaacggttattggcgcgctcgctggaaccaaggccactattggcgtgcgttccgacgcgcagtctcagactgctggtgcggctcagccgatcgaacagacggtgtaccagaattccaagtcggtggctttgccgtctgtggttccggtgcgattccccaatggcatgcttgacgatcgcacggttatgtgggatgaggcaagtgttgccggcgtcaggttggacaccatcggcgattatgaggtgtccggcacggctgagggttcaagctcgcaggccaagattacagtgcatgtggtcgccgatccgaatggtggtgccgatcctgatcctgagccgacgccggatcccaagccggagcccgatactccgttgactggttggattgaaggcagggccattgacaccacggtgagtgccgaggcgagctggtctccggcttccggcaagctcaacgatggtgtgctggttgacgatacgtggccgtctgatgatgacgccgatgtgaatggccgcgtgtggggcagctggggtcaagcttccgctggcatgtacgcgcagtacacctggagcaaggaagccaccgtcgattccagccgtgtgcagttctgggccaacttcgcggagcgtaatgatgccaagggtggtttggatgttccggacagctggaagattcagtacttggcttctgatggtatatggaaggatgtggagaatgcgcaatactccaccgtgcgtaattccccggcctcacgtgcctctgacgatgctcaaggctggagcgtggccacattcactccggtgaagaccacgtcgttgcgcttggtgcttgatccgccgaccgccgagggcgtcaccttcggtctggcggttgccgagtggggcgtgcatgctgcggaaagcactcctgatccggaaccgactcctgacccggatccaacccctgatccggaaccaagcgtggacaagagcaggctcgaatccaccatcaacgcagccggttccgtgcaacaagctaatttcacgccgaacagctggaaggcattctccgaagccatgggtaacgctcaaaaggtgtatgcggacgagagcgccacccaggatcaggtggatgcggccatcaagcagcttgaagaagcccagcagacactggtgaagaaagccgacaccactgagttgaagacggttcttgaccaggcacagggcgtcagcggtgacctctacaccgaagccagcgccaagaagttggctgaagcagtggatgccgcctccaaggtgctgaacgatgagaacgccacccaagctgatgcggatgccgcagtcaagcagctgaccgaggccatcgccggacttgaactcaagccagcaccgaagccggacgacgacaagaccgaccccaagccgaatgccaagcctggaaacaagccggtttccaagtctgaagtcagtgccgcaatcagcagcaccggcagcaatgtcatcggcatcgccgtcgtaggaatgatcgtcctgctgacgggagccgccatcatgctgacgcgccgcaaccgcgactagcgctagcaattgctcaagtcctcttacggatcgcacgaggaataccaacgtaacctaagcaatccgtaagaggacttttcaatatccaatcgtgaaaacaggaatattcatgagcttttcgcacatctcacatgcgtcgatgaagacgctggtggcaggcatcgcagccgcagccaccttatgcacgggagcaatcgcaaccatgcagacagccaacgcggccgacgcaagtaccgcgcccagcgtcgccggacacgcctacaacgatctgccggtcggcaatcccgacgtcaccgtcacgcaaatcgacaacagtgcgttgccggcaacccttcgcaaccccatcgggcagaacgaaggaaccaatacccccaacgacctgtcgcaaaactactattccgcagacgcatccacccttgaatacgatggcaaactcttcgtattcacaggacacgacgaggccgaaccaacctacgggtccttcaatatgaaagactggggcgtctacgtaaccgacaatccggaatccggcaaatggacgcactacaagaccatcgccaaagccgacctgttcgactgggcaaccggcgacggagcctacgcaggacaagtagtagtcgacgatgctggcaccgcagacacggccgacgactggttttactactacgtgccagtcaaagacaagaacgcagccgcgggagccgacccgttctccatcggcgtggccaaatcaaaaagccccctcggaccatgggtcgacgccatcggagcgccgttgctgactaccatgcagacgcaaatcgaaaccatcgatcccgcattcttcgtggacaatgacggtaccggatatctgcacttcggcaccttcaacagcgaactcgccgtaaaaatgcagcgggacgccaacactggccgcacctcatatgttgccgtggaaaccatggacggaacggcggatggagcgccgaaaatctacaatatgcgtgacgccgacgcgctcgccaacatacccgactacgatgccagcaaagacgtgcttggcagcgactatgcgaaccaagtgaacgcgtcgctgaccttgggcaacaacggcggcgcttatgccaacgggcccaaaggcttctttgaggcggcatgggtgttccgtgaaggagacacctactacaacgtgtacgacggtggcaaacccgggtcgggagtggcgacctgcgtggaatccaactatcaggcgtgcgtgcaatactccacgtcggcaagccctcttgggccgtggacgtaccaaggcgtaatcgtcgaatcgggatcgtccaccaccatgcatccgtcgattcaacgattcggcggcaaatggtgggtcacctaccacactggagacaagactggtggtactgacttccgccgtgcagtctgcatcgatgaagtgacgtggaatggcgggcgcatgaacgccgtttcgcatccgaccaaagccgaacggttgcaaccctcacgcaacgtggccccctatgcgtcagtggacgcgacctacaccgaaacacccgcctacaagggttccgtgaacgacgggcgagtgctggaaactgctgtagtaccgccgaaccattggacgaactatcgaaagatgccacaaacacaatcctccgattcactgatctaccagtggaatggcgctgtacgtgtgaatggatcgaaagtctggttcgataccgatgcgaacgcattgcgtgcccctgcctcatggaaactgcaatatcttgacgcagacggttcctggaaggacgtgcccaattccagcgaatacggcgtggatacaggcaagaacgcgcctaatgaagtgacattcgacgcagtgaccaccactgcgctcaaacttgacatgaccgcgcaagccgttgacgggggctatgcttccgttggcgttcctgaatgggaagtatatgcgcaacagggagcagttgtggctgaacggccagccgacgtctacgccaagaccggagacgcgccggaattgtcgaacacggtgaaagtcgcgtacggctcggaaacagtggaaactccggttttgtggcgcacggtgtctgcttcttcgtatgcgcaggcgggtgagttcaccgtgcaaggtgtggttgctggcattgaaaccaagcagcaggctgatgatctggcagccggcaacgtagccgtgaccgtacatgtttccgacgattacgtaaaaccggctgataccattgctcctgccgtgcgtgtggcattggctggcacggctggcaatgatggttggctggtcacttcaccgatcgctcttattacggcttccgacaatgcggctgcgccgatcgcaaaactcgaacttgcggtcggggatggcgcatgggtgaccgtcggaacgaatgtgaacactgcggtaaaggctgtgactggcgagggtatagtgagtgtgcgtgcgcgtgccactgatgcggccggcaatgtgagcgaaatcgctgctgcggaagcgcgtgtggatgctacggctcctacggtaaccgcctcggtagatacggtttcccgcactatgacattgaccgcctcagatggtgctggatccggtgtgaaaacggtggaataccgggttggaaacggcgaatggcagcaatatgaagaaggcgcggcgattactgcttcttcgtcgaagcgcgaaacggtgagctatcgggcttcggacattgctggcaatatgtcggctgcgggcgtcaaagatattccatccgatacgtcggtgccgttggccggctatatcgagcaagatgccgttgctactgacgtggacaaaaaagcgtcttcttggacagctggtgttgccgcgcttaacgacggcaaaaccattccgggcgattgcacggttgataacgcctgcatttggggtacgtggccgaataccggtgaaatgaagctcgactacgaatgggatcgcgaagtcaccatcgattccagccgtgtgcaattcacctccgatggagggggcttgggaatgccggcgtcgtggaaactgcagtattgggatgctggaacgaatgcgtttgtggatattcccgatgccacatatacattggtcaccaatgctcccggcgcttacggtaccgataacggcggatggagcgaggcaacctggactgacgcggtgaagaccactaagctgcgcatggtgattcaatccggcagtgcatcgccggctgccgccgaatggcaggttcatgcacctgaaccgactccggacccgacccccgatccgacgcctgagcccgagccggaaccaacgccaactccaaagccgactccggatatcgataacaacggcaagcaggacggtaataatgccgagccttctgcgaaaccgcaatcatcgcagcaatctcagtctcaacgtaagaagaagctaagctctacaggcgtcgctactacggcaatcgtcattgccatgacggtgctggccacggcggggtgctgcatcttcgtggccaagcggggcaagctgcgtaactgaatccaatataaaagtggtaagttctcagcctcggcctctggactgaatatgtgtgcttgacgcactcaaggtaccgctacgcggtcttcgcggcaagccgctcacttcgcctgaggaaagcccattgggctttcctcttcacggctcagtggccaagcctacgatcaagcacacgtattcagccgccgacctttggggtccgacccctacgtttgtgtgaactcggacgtcatcggaccccattttgctcataactcgcctatgtatggcagatttgcgggtctgtcaggaagcatctcgcctatatatggcagaagacttcgctaaaaagccatatagggggtatgaaaacgcatgttttctgactccagtctgccatatataagcgagatgcctcgtgacgagactcaaaatctgccatatatagtcgagatatggctcggctgttggtggcttgagacggcgacatacgatcgcggatcgcgtaggtggtcgccgtttttgtgatttatgggctaatctcagaagagacagattcgatggccgcgaacggtgagaaccaacgcgagagaatgcgcgagcggccgcgtaagggaggaaagcccatgtccaaatcattcgtcaacaaggcgctgctcggcggcgcagtcgctgcaggcgccgcagtgtgggcgatcgcgccgcgtaccttctccgataagcgccgcaattatgtgccgtccattcccgacgtgtggtacgcgcatcgtggcctgcatgacgcgggttccggtctgaccgcgcagtatgccaacgagagcggcgagtatgtggcgctggcacgtcgcatggccatgaaggccggctatggcagccccagcgtgactggtgcgatcgctccggagaactcgcttgcggcattcgcagcggcttgcgaagccggctatggcatcgagcttgacctgcagatgaccgccgacggcgaaatcgtggtggtgcatgacggcgatctgatgcgcgtcgccggagatccacgccgtatcgccgatctcacgtacgatgagctgacccgcatcccgctgttcccgaccgacgcccccggtgccgccgtggcagcgccgttgccgggttcgcttgaaaatccgccgctggtcaccacacctgacagcgctccggaagggtatttccagcatgtgccactgttcgccgacgtgctcaaggtagtggcgggtcgtgtgccgctgatcgtcgaatacaagttcgacgacaattccaagtggggttcgcgcgatgtcgagctcatggaaaagggcgacgcgctgctgcaggcctattccggcgcgtatgtgatcgaatcgttcaatccggctgccgtcaactggtataaggagaaccgtccggaagtgtgccgtggccagctttcctggtggccgcagggggaggagaagccgtctgatcctgctgcgctcgccaaggaatatgcggccggtgcgctgattttcgactggatttcccgccctgatttcgtcgcctacgattggcatggcggcaacagtccgcaggtacggttggcccgtttcatgggtgccgttcccgtgtcgtggacggtgcgcagccgcgacgagctcgcccagtgcgatgactggttcgaccatcatattttcgaggcgttcgtccccgacgagcagtagaggttttacatatgatttcggcctgccgccgcatgatttgcgttgtggcaggccgtttttattcgatttacttgattgactgattgggttgattcggttgagctctgatgcggtcagtcgatcacgccatatagacggtcgccggcatcgcccaagcctggcacgatgtagcacttgtcgttgagcttctcgtcgacggcgcacagcaccagcttgaacttaatggatgggtcgaggttctcctcaacgaacttcaggccttccggagcgcccagaatgcacacggcggtaacatcctttgcgccgcgctcggccaggtaatgtgttgctgcgaccagcgtgccgccagtggcgagcatcgggtcgatcaggaagcactgacggccgctcagatcgtcgggcagacggttcgcgtacgtgatctgctgggttgggttctcctcgtcgcgcttcatgccaaggaagccgacctcagcggacgggatcatcttggtcatgccgtcaagcatgcccaggccagcgcgcagcacaggcacaatgatcggcgccggggaagcgatgtgcttgcctaccatcggagcgacgggggtctcgatcggcttgtccacgacttcgacgtcgcgggtggcctcgtaggcctcaagcatcacgagttcggaaacgagctcgcggaacgtggaggacggggtgttcttgtcgcgaagaacggtgagcttgtggtccaccagcgggtggttcaaaacatgaatatccatgtcttctaagcgtagtccataatcgcgaggaaaagcgcgggaactgggaaaggagccaagaaagaaactgaaaatcgtatgaaaaaagcaacgaaacttaagaagagggaaagcgccgaaccacgaaagcgcctgtcggcgcaaaggccgctcgcagcggcaaaaaatggagcccggggctatgcatggcccggcgcgagttcctattctacagatgctgtagaccgtacgttacgtcgtgtcgcgaattgatggtgcgagcgccgtaaaacacttccggtagcggtacagaggtgggtgcagaggcaggtgcaggggacgggtacggaacgcgttactccagttttccgcgacgccacagattcgccccatggcgaaaatccttggccgtgacgaacagattgccggccgtgtgcatcaaacgggacgatttcgtacgtacctgcttttccatggcggaaatgccggaatcgctgctatcggaaccttccgcagctttcaatcgtgcgatcatattgcgtgcctcgatgcgcaatcccaacgcaaccacgtcggtgaacgcggccgcacgttccagcgcaaccgcaaaatcgccggtgaacgcgcctgcgagaatcgaatcggcaatatgcgcaatgtcatcttccgtgggcgcctgatcgacgccggcaatcgccgaggcggtagtggcaaccggctctccagcgcgccacaaccgcgcgatcgactcgcgattcttccgcatccacgtgcgcagcagatacagccgccacagaatgcccggcagcgaatccggctcggcgctgctccacagttcggcgatcacgtcaacgccctcgcggtccaccagcgtgagcacgcgctccaccagttcggcatcctgcgtatgatgcacgcggtccaacagtgcggccgccgaagcgtggctcatctcgttgatttgcgccggatcggcacctcccgcgatattgtcggccatcatctggtcgagttgccccgggcgggccggacgcggcgatccggtgttggtgaaaccggcggaacggcttggtacaaccgatccggaaccgtaatgcatgctagtagacaatgggcgaaaccttttgaatatcgataatgctgggaccttgcggcgtatcgattataaacagcgctacggcggtgccggtaggcatgaacggcgttttggcgatgagctgcttggagagcgctttgcgggcgcatagtccgcgcaagtgatcgaacatgcctccgataaccggtcggtgcatgcagatcgccgtggtttcgcgggtctcgagcgtgagctggatctgcttgaggaacgccagccatgcgatggtcgggtgctcggcgaaggcgtcttccgtgagcgcgtcgatgtgttccatcgggcgttcggtctgccagctaagcacctgcagtgtttcctggcagcgcagccatggtgaggttgcgaggcgggttgggttgtagcaggcgagttcgcggttgagtgcgaatgccgcggccgcgcctttcggagtgatcggccggttcgcgtcggtgcctttccaggatttgcgcgattcggctttggcgtgacgcacgatcatcagattctgcgcggtcgcggcaccctcctgtacgcggtccacaaaaatggcgagggtgtctttatcggtggaatgcgtgaggattttacgtgcttcacgtacggaaacccacacgatatcgttgatttcgcctacatccgcgcgatgcacggggccgaatgcgtcaagcagatgttccgcatcatctccggaaatcggttgcgccatccaatacaacgtgtgcttggtgtcgacggcgcgatcgtgtgaatgccgggttttcttgccttcttcggacagtggatattcgacttcgcacagatacgggccgagtgcgatggaaacgcctgtctcctcgccgatttctcgcactgcggcatgacgatgcgattcgccctgctcgagtttgcctttcggccagctccagtcatcgtactttggtcgatgcacgatgcacacttcaatgctgttgagttgttcctttggagttttctgcgctgcgattgctggattttccgcgatttcgctaccggttttccaccgccatacaatacccccggcggcttctacgacacgtctcatgctctcgctcatatctttcattgtaagtggttgggcacgggtttccccatgattgcgcgacggcaatcgtgccatccgagttttcctgcgttttcccacgatggtgatcgcgtatgccgcaacataggaaatggccgattctgcaacagcagaatcggccatttcctacggtttagtgccttgccggtcggcgcgtatgcttcttgatgagatattcctgggaatcgaccagcgggcgaccctcctcatccttcgcatgacgcacgtaggttccgtcggctgccatatgccacgaggtggtggaatcggccatttgcagatccacgtacttgatcagctcgtcgatctgctccggagcggtgatgcgtaccagcgcttcgactcgacggtcgagattgcggtgcatcagatcggcggaaccgatccacacttccggacctgcggccggaccttcaccgatctgcgggccatcggagttcgcgaatgcgtagatacggctgtgctcgaggaaacgacccagaatggaacgcacgcgaatgttctcggaaagtcctggaacacccggcttgagcgcgcagatgccgcgttccacgatgtcgatcttcacgccggcctggcttgcacggtacagcgcgtcgatggtcttctcgtccacgatggagttgaccttgatcttaatccacgcttccttgcctgcgcgtgccgcatcctcttcgcggcggatgcgctgaatcagaccggaacgtacggtacgcggcgctaccagcagacggtggaagctcgacttcggcgcataaccggacagctggttgaacaggcgggtcatatcctggccgaccaccggatcgcaggtcagcaggccgagatcggtgtagatgcgggcggtcttcggattgtagttaccggtgcccacatggcagtagcggcgcaggccgtcggcttcctgacgcaccacaaggctcagcttgcagtgagtcttcaggcccacgatgccgtacaccacgtgcacgccggcgcgttccagcttgcgtgcccatgcgatgttggcgtcttcgtcgaagcgtgccttgatttcgaccagtgccagcacctgcttgcccgcatgcgccgcgtcgatgagcgcgtcgatgatcggggagttgctggacgtacggtacaacgtctgcttgatggcgagcaccttcggatccgccgcagcctgcgctaggaacgcctgaacggaggtagagaacgaatcgtacgggtgatgcaggaggatatcgcgttcgcgaatcgctgcaaaaatgtcttgcgcgcgggacgactccacctcggcaatctggcgattggtggtcggcacgaacgaacggtacttcaagtccggacggtcgatgccgccaagttcgaagagcacggtcgcatcgagcggtgccggcaggcggtacacctcatcggcactgacgcgcagctgatcggcgagcagctgggaaaggaacgggctggtctcgtcggaaatctcaagacggatcggcggtccgaaacgacggcgcagcagctccttctccatggcgttgagcaggttctctgcatcatcctcttccacgtcgatatcctcgttacgggtaacgcggaaggatcgcgcttccttgatgatcatgcccgggaacagggattccaggtgcgcgatgatcaggttctccatggtgatgaagccgtagcgcacgttggtggcatcgtcgtcggtcatgtcgtcgacgggcacgagacggttcaggtttccaggaatcttcacgcgagcgaagtgggacttgccggaagccgggttctccaccagcacggcgaggttgatggaaccgccggaaatgtacgggaacgggtgggccggatccacggcgagcggcgtcagaacagggaacacctgctgacggtagtagcgagacaggcgctcctgttcggcggcggtgagcttgtcccagctcagcagcacgatctgttccttcgccaggtcgggaagaatgtgatcgatcatgtagtgcgcgtgctcgtcctgcaggcggtgcgcctgctcgctgatggcgcgcagctgctgccttgggctcaatccggaggcggccgtcacggcgatgccggtgtcgatgcggcgcttcagacctgcgacgcgaaccatgaagaactcgtcgaggttgttcgcgaagatcgcggcgaagcttgcgcgttcgatgatcggcagatcttcgtcttgggcaagttcgaggactcgcttgttgaacttcagccagctcaactcgcggtcgaagaagcggtcgttcggcaacggctcttcgccggcctgaagctcacgcttgtcgtttttatcggtctcggcgatatgctcagctatctggctgcgcaagatcgccttcgagggtgcgtcaaaaatctgtgccatactttcctactttatccttaagtagctggaaatgctgtaaaaagccggcaaaatttagctggagttaacattcgttcgctcattgtgcaaattagggtgtcgacacgccgtgtttttgtcgcaaacgcacgcaaacgaacaaacacgccttgcgtttcgcacacgatggagcatttttatgattcttgcgatcgtaaagcaacagttgcgacaaatacggaacatcagccggtttcggtttgcgattgccggattgctgagcataattacgaagtacaagaacaacttaaagagcagagcccacaaagagtgtatggccaagataggtcgttacgttgaacgggcattggatagacttaccgttacgacgatgttgttgtgcagagattctgcccttaaggttcttgcaaggaaggcccgctcggcgggccttcctttttgtttgcctgttctcagggagtttttcgggaaaacgacggacgccgattatcgtcgttgtgtggataacggtgcataacacgccggggttgtggataactcgcgtcctccgaccacagggccggttcagcttgcaatggtgctcgccgaagcttttcaatcgacggtatgagtaatgcaacgtctttttcgaatgttcctccggtgccgctgccgtcgggcgggctgttgccggtcgccggcgcgatcgcgccgcaagcgtcaccgccgacacaacgcagaaccgtctctgcgcaacggttctatacgccgccgggatcgaatcgcggtggaacgcaactggttggcgctgtgcctggaacgtatggcatggttgcgcaatgcggtcgcgcatcggtggaggaaccctgcgatatgggcaatgtggtggttatcgactccgtggtggcaggagtgggcacgagcactctggccgccttactggcccgcgagctgagcgaacgcggcctcaaatgtgtgctcgtcgacgccgatctgcaaggaggtgggctggatgtgcttcttggcgtggaaaacgaggacggctcacgcttcggggaaatcagcgctccgcttggcaatatcgacggcaaagcgctactgcgggagctgccaatctgggatggtgtgccattgctggcatgcgatccttggaaaaccgaaaatccgcaatcgtgggaagtgcaagcgtgcattcatgcgctatcgcaggtgcgaagcgtggtcgtcgtcgatatggggcaatggaacggactgcaggatttgacggaactgcgcaaggccatccgcattaccgtggtcgaactgacggtacttggtcttgcgcgggccaaagcgaatctgcgggcgcattacggttcgatcggagaacacgatgccgcaacgcaggaacgggagtttctcgtaggcgtgcaaccgcgcggaaccgtacgcgaccatggcacgacggcaatcgaggaagcggcggaatacctcgactgcgatatcaccgcggtcatcaaaccggatgccaagctttgcagcgaactcttggaagggcttggactgcgcaaacccaatcgtacgaacgcgaaagccatcgcaacgttggcggatctcattcaggaagcgttgggagaaaagagcatcagtcatggaactcgggccacttagcgacatcgcatccgagccgggcgtcaccgacatcgcggtaacctgcgacggaacggtgtgggtggatcgcggccaaggtatgcggccacatgcattgcgcgtgccattcagcggtccccaagccatccgcgatttcgccgtgcggctgtgctcgcagcttggcagaaggctcgacgacgcctgcccgatagccgacgcctccacggtggaaggcgtgcgcgtgcacgcggttatcgcaccgctcgttccgcaaggcgccgccatcagcatacgattgccggacgttgttgcgcccagtctggaatctttggcggaaaacggcatgtttccaagcggatggatgcctttgctggaaggattcgtggaacgaagggccagcgtgctcgtgaccggcggaaccggagcaggcaaaaccacgctgctcaaagcaatgcttatgcgatgcgcgccgggggagcgcgtcatcaccgtggaggaggtgcgcgaacttggcatgctcaaccatgccaaccacgtgtcgctggtgacgcgcggcgccaacatggaaggcaaaggcgccatagggctgtcgcagctgatatgcgcgacgttgcgtatgcggccggaccgcattgtggtgggcgaatgcaggggcggcgaaatcgtggatctgctgcgcgcgctgaattccgggcatcgcggaggcatgaccaccttgcatgccaatcaggtgacggcggttccctcacgtttggtggccttgggattgctctccgggctgaatccgcaagccaccgcggcgctcgcgcaagacgcgttcgacgtagtgctgcatgtgggccgagtgggaggcaggcggcgcatcgcgcaaataggacggcttgaattcgcagaggggaaactgcggggaaacctattggccgggtggaacggcagccaaatgcgggcttcgcaacagtggcctgatttcgtgcgcgtatggagtcgttgaatcgaggtgggcagatggaaagcctcagcattatttgcgcggtattgtgcggactggccgtatggctgtggcctcgccgaaacgtatgcgatgtgggcgaacgggcgggaaacgtagtggggcgcgcaggcgaaagccttgatgaaaaacctgatggaggattcggcgggcggtctgacggaatcgaagaggcgaacatgccggcgaaaccattgcccgccatcggatgtgtggcgtgcgtggcttccctccgcgcatccgtgcgcagcggagccacattggtgcaggcgttcgaagaattgggtggaacgccgttcgccacacccgaacttaccaggcttcgcataaccatggtgatccgcagccgatgcccgcccaaagagcaatgcggccaagtcgaacggctgagcggcgagctatatgcggcctgtcagctgagcctgacgctcggatgcgaaaccggccgatgcctgcaggcggtggctgaatcgttgaaacggcaacgattattggatgatctgcgtaccaacgcattcgccatgcccaaagcgacggtgaaactcctgatggcgttgccgctgctcactgtgctcttgggagaaggtatgggtgcgcactcattggccttccttgtttcaggggtcaaaggcttggcatgcctcggatttgccctctgttgctacacgttcggacttatctggatacgtgcgctgatgcggcaggatgatatgaaaggagccatgtgatgactggcttatggatgctgacggcggcggtgtgcgcggccgaagcgatgtggctgaagcagtggaggccggtccgtgtgccagccgaccttgcgcccgccggacgagtgcgggaacttccgctgccgctggtattggagatgctcagcgtcgccatacggcagggatcctccattccacgcgcgctgattgccgtgggcgatatcgctgcgggagaattcggcgcgggactacggtcggccggagaacagttgaacaaaggtgtttcctgggatgatgcgtggccagatgatggcgatcttgcggtggtgcgcgatgcgttcgcctcgtcatggcacagtggcgcctcgccggtggaacgtttggaaacagcggtcgaacaattggattgggatgagcgctcgcagatcgaacaggctgcagcgaaattgtcggttcgtttgttgctaccgaccggattgtgctttcttcccgcatttgttgcggtggggattattccggccgttatgtcgtttgtgggatgacggcaggaaagcaacgtgggaaatatggctcgggaaatgtgggaaacggacaatcctcgaagaacgatgttttgtggataaatgtggatgacacgccgtggttgtggataacccacgtcctccgaccacaaccctgaaaaaacgttccgacgggcacgatgatgcgcaacactgggtgcactcggccatctggccgaggttgttcgaacgaaaggaacgccatgaacaacgaaacgccaatcaacgtcgatggctcgccagacctgatgggcaaggcaggacagctgctgcatgccatgcgtgaacgggccggcaaagcggtatgcctgctggacgcgcgtatgcgcacgctgaccgtcgaaccggaggaaggcgctgccactgccgaatatgcggtggttttggttgccgccaccggattcgcagccgttttggtgggcattatgaaatccgatgccatcaaaacgctgctgaccaacatcatcaagaaagcgctgagcgtcgggtgattcatgctgaggcaatggtggaaacgccataccgatgatgccgatgagggagcggccaccgcggaattcgcggtggtgctcccctgcgtggcggcggtggcgattttggtgttgtgcttggggcgtgcgtctgtggtgtccatgaattgccaggatgcggcggcggccggtgccagggctttcgcggttgatgatacgggcggcgaatcgaaggcgaggaccgcggtcatggcggctgcgggaggttcggcgacggtacggttcgagcgtggggcggacttcgtcaccgtcacggtgcaatgccctgtggtgccggatccgaccggtgtgctgcccactcgagttaccggcaaggcgacccgctacttctagcgttgctccgaagcgtgctggtctctgcgcagtgagatgcgggattgttggttgtggcctgtgcatggaggtctgtgaggtttggagcttgcgacatacgacgtgtgaaacatgttgtgaaacactattggcaaccatttgatggatgcgggtcggaaaggaatggataatgtgaaacgccttgtgaaacattggtttgcttggattcgcgggtccgatgagggttcggggaccatatccggtgtggctttgatcgcagtggccgccatcatgctgggcgcggccgcgtcggcgggcaatctgctgctgtgcttgcatcgcgcgcagaatgcggccgacctggcgtcggtagcggcggccaatgcgttgtattcgggatcgtccgatccttgttccgtggcggaacgcactatatccggcaataatgcgacgatcggatcctgcacgatagaaggcgaggatgtgctggtcgaagcgcaggtcggcacgcaaatgccattcgtatcgcatgtcggcaaacagtcacgggcggggccgattgtctgcgaataagtgtggtgtggagcggtacattgtgcgggaaatcgcgcttcgtaaaaagggatctttctacgtaaaggaacattcgttccacaaaacgcggccatttgtatggaaagccgttcgcatgtggcgtgtggagcgaatcgcggttatcgtactgaagtatgagcgaaacgtcatgtgtgaatgcgaccgttgccgttgtcggcaatccgacgtcaaacaaaggcaagggtgccgaggtcggcaagcaggtggttgagctgctgcaagaggccgggcgcaagcatggcttcaacgtgatcgacgtgaccggcgagagcttcgacgattccttggcgaatgctaggaatcgcaggaacgaatacgactacctggtggcggtcggcggcgacggcatgattgcgcttggagccaatgccgtgggctgttccggtaaaccgttgggcattgtggcgacgggttccggcaatgatttcgcccgcggtcttgagctgccggtcaatcgcgtggaaaccgctgtcgacggcatcgtcggcgcgattgtgcgcggcacgcatattgacgttgatatgggtttggccacgtcgttgcagggcgggtatgccgtcgattccagtaccggcgatgatctggtcggcgattcggacgtgccattgcgcccggcggtcaaccgcttctacgcgggcatgctgtcgtgtggtttggatgcgagtatcaacgaccgtgccaaccattcccgcttgcccaacggttcggtgcgctatttcgtggcagcgattgtggaattgacgcatatgaagcggtacggataccacatcaaagccacgttggccgatggaacggtggaagaaagagacattatttcaccgttgcttacggtggccaattcacggcatattggcggtggcattgagatttcgccatattcacgattctcggatgggctgcttgacctggtatggctcgaccacgtgcccaatgtcgccgaatgcgtggatgcggtgtctcacgcgtatagcggcaagatcctcgggtgcaaggtgtttgggtggaagcgtgtgcgcgatatcgaaatcacccgcgcgcaagagggtgatgagccgccggtcttgatggcggacggtgaatatgttggtcgcctgcctgtcaaggtcgtagttcaagaccgtgcgttgcgtgtgctggtgccgccggccgtggcggaaagccaagctgccaacaccgaagaaaaagtgctggaagccatcaagcgtgatcaccgtgatcctgtcaccggcaaaaccgacacctactacgcgaagcgctcgcggtagtgcgtgcacatgccggtcaaaccgcaacattgcatatcgaagatggcacgtatgcaactgattgcgtgatcggcaatcgtaagcaatcgcaaataatttcgcgataataacgaaaaatccagtacccgcaagatctttatcttacgaataccggattttctgtaactagcgaacgccgtaactatcgaacacggattgcggtcaggcggcgacttcctggcgggcgatggcctgctcgtagtcgcgggtgcccttgaagacttcctgcagccacgggttgacgtgctgcttcttcgcacggtacaggatgtagccgagtgcgagcacgttggccacgagtgcgatgatcgacacggtcaggttcacgttcggattgttcaccgactgcacgacgaacttggattcatcctggaacatggggaacacctgcgcgaacatgcaccagatggcgagcgtgttggcacggttctgaatccagccgcccttgttccagaagaagttcgccacggtcggggcgagcagcagcgcgaggccgcaataccaggagtgggttggcaggcagttgtaggtgtagcagaagttccaaatatcgtatgcgacgatgaacacccaagtcatgtcaggccacagcatatcctgcttcttcttcgacacgtaaatgccgaaccagccggtcatgcaggcgatgttgatcaggccggcaacgccgttgaacacgttgtgccagccgccatacagcgtcacgccttcggtggaaacccatgtggtaccccaggcgcgaatggcggattcgaagtcggagaccacagcgatgagaatgttgatggccacgatcacgaacgggaagcatttgaaccactcggacttgccgatcttgccccacttgtatttgagtgccatgaagccgatgcagcccgcggtggcagcatacagtttggcatagtggaaccagctggtcatatgaacgtaggtcgggttgttgagcgcccactcggcacccatcgcggcggccacgtaaatggtgatgaagtagatggtcagaatggccggcacgatcaggaacgcgatcacgccaccggtcttggtgcgacgggccagctcattggcgccgatcaggcagcagaatacgaggatccatccgatccactggtatatggcggtgtcgccatagacttggaacaacatcgctcttcctttctctcaacacgtatgcgcgcggggtgagctgcgtttacatgtattcgttcaggtgcagcgtctgtgccgcgacctgtctgatgacggtgtcttcaatgtcgggatgcagtctgatcagcgaaatcaggccaacgatgagcgtatagaacgtctcatgctcgttggtgatgggcatgccatgcaatttctcgaaatcgcgcactgtcgaattgcagatgtattccgcaatgcgatcggccacgcggtcgatgaatttgatgtacagtcccgcgttgccgtcttcgatcatgcgttggctgaacgggccctcatcggcgatgagggaacgggtcagtcgcaccacgtcatcgagcgctttcgagatgttgccgacttctcgattggcgttccactcctccaattgcgagatgacttcgtcgatgacgtcgtcgagcacggcgtccgcaacttggtctttgtcttggaaatagtggtagaagagagatctggtcatgcctacgcgacctgcgatatcgctgatcgtgattttcgaaaagcccttttccaggcagattgcgcgggctgcatgcacgatttgcgcgcggcgtgcatctccgactgttgttgcggaggcgttgtgctgtccgtccatggctttctctccttcgttcgagtggcgtctctcacctgcgcgacacgttgacactctgtcaatttcttgactgccctcagtctaaaccgtacattgacacaatgtcaatttcgtagtgtcgatgtcgtcactcccagcttaaacgttgccgcggcgcttgtctttggggacacgcgcttcaccgttacgggcaggctgtgcggccggtctttgagaaaaaacgtgtcgtaattaatcggtagcctagtgacaccacagcggaaggaattgcgatggcactggcactctatagaaggtatcgtcccgacacgttcgacggcgtgatcgggcaggatcaggtcacgattccgctgatgcgagcgcttgatgagaacaaacttacgcacgcttacctgttttccggtccgcgcggctgcggcaaaaccagttccgcacgcattctcgcgcgttgcgtcaactgcgcgaaaggcccgacctcgcacccgtgcggcgaatgcgaaagctgcaaggacctcgccacaggcggccccggttccatcgacgtggtggaaatcgacgccgcttcgcacaacggtgtggacgatgcccgcgaactgcgcgaacgtgccggattcgcccccgcccgcgaccgctacaagattttcattctcgacgaagcccacatggtcacgccgcaaggcttcaacgcgctgctgaaaatcgtggaggagccgccggagcatgtgatgttcatcttcgccaccaccgagccagacaaggtgatcggcaccatccgttcgcgcacccaccattacccgttccgcctagtgccgcaggaggttatgggcccgtacctcgagcggatctgcgaagacgagcatatcgaagccgagccgggcgtgctgcgccttgccatgcgtgccggcggcggttccgtgcgagacaccctttccgtgcttgaccagctcatggtcggtgcggtcgatggcagcatcgcatacgactccgcggttgcgttgcttggcttcacgcctgacgctctgatcggcgaggccgtcgacgccgttgtcgacaaaaatggcgaagcactgtatggcgtgattcagaaggtcgtggtcggtggtttcgatccccgtcgatttgttgaggatttgcttgcccgcgtacgcgatttgctggtgctcacgttgggtggagagcgtgcggaaagcgtgctttccgacgatgcggccgccgagaacatggatgatttgcgtcgtcaggcttccgctttgggattgtctgcgctgacgcagatggctgacacgatcaatgcgacgcttgccaatatgaccggtgcgatttcgccgcgcatgcgattggaattgcttgccgcgcgcttgttggccgggcgtgaggaagggatggctgtcgttgcgtcatcttccggtgtacctgattttgccggcgatgccggaacttccgcggctgccgaatcgtcgcgtggatccatggccggctcccgtcgccgtgcggcacgacatgccgcaggaaatgtgcgggcgcaggattctgcgcctgtgatcgataccccttccgcgcctgtgcagccgtccgtggcgccgacgaatcctgccgatgccgtcgcatccggcgtggcttccgtgcttgctgacgtgcagcaggcgatgaatgcgacgacttccgtcgcttccgctgcgcctgccgcaacttccgtaccagctcccattcatgacgatcgcacccccgaccagaagtgggatgcgctggtcgcagcccttccggaagacgtgcaacgttacgtaagccgtgaaaaagtgcctcgcgtgctactgagcggcgacagcttgtggatcaaattcgacaaggcgctcagcaaatacgcgttcgccaagggcgtggcgaaggagtcggtggatggaaccaccgaagtggtgaaaatcgtccgcgccgaagtacataaggtgttcggcccgaatgtcacgcttgcccccgccaaaaagctggcggacggttccgaatcggtgccgtggagcaagcttagtccggaagagcaaagcaagatcaacgtgcagctggcgcaggagcgactcaaatccgcaacactgctgaccgcgaatcttggcaccgccgcaagtcttgaatcctccggcaaagagtcggcaagcaagagtggacaaaaaaccgaagatggcggcaatgccgggaattccaacgatgaggagggccaccgagccgaggcggaggcagccgccgaagctgatccgtgggcaaatccgcaaccggctgcgcctgcgcaaccgcagcaagaatccgatccgtgggggagtcccgcgccagtagctcaacatgtggaacagtccattccagatgatgatccgtggggcgcgcccgcacaaccgatgcaatcgcaatcggtggttgcaagcggcgtcaacgatgtgaaagcgccggaacagcatacgaaacatgtggccgttcccgatatcagcgacaacgttgatccgtgggccgtgccgatgccagacccgcttccaactccggtggacgacgatccttggggtgcccctatgccagttcaggcagggccggcggagccgtctcccgctccagtggaacctgaaacggctcctaagcatgccaatcaccagcatcgcgcacctcggcaggaagcggcaccgcagcaaggccagccgaacgccgatccatggagccaacagttctccgcgcctgcgcagccaacaccgcaggtcgccgcggaagacgacgaatattccatgagcgacgaatcgatcggagcgtccagcgcgttaagcgtggatgatctgacacgactattcgaagtgaaaaaagtcgaggatttcggccccgacgacgccaaaaacccgcgcaacatgcagcagaagaagaatctcgacgactgatggcggtgcagtcgcaagcaaaaatgcgaaaccgagcaaaatcgacgaatcaacgcaatcgtaagcactgcataatcgcgaatcttatggaaaccaaggaaaggtgaaccatggcactggcctatgacggcgccatccaacgactcatcgacgcattcgcgcacctgcccggcatcgggccgaaaggtgcgcaacgtatcgccttctacctgctcaacgcatccgacgaagaagcgcaaaccctgatcgacgccatcaccgaagtcaaggaaaaaatacgattctgcgacatctgcggcaacgtgtgcgaaaccagcccatgccctgtctgcgccgatccacgccgcgaccacagcgtgatctgcgtggtcgaagagtcgaaagacgtgatgagcatcgaacgcacacgcgaatatcgcggcctataccacgtgctcggcggcgtcatcaatccgatggccaacgtgcagcccagcgacctcaacatcgccaaactcatcgaacgactcaaagacagcgaagtcgccgaagtgattctcgcgctcaatccgaacgtggaaggcgaggcgaccaccagtttcctttcgcagctgctgtctcaaaccgacatcaaggtcacgcgcttggcgagcggtctgccggtcggcggcgatctcgaatatgccgacgaaatcacgctcggacgtgcgttggcggggcgtcgcgcggtctgacgctacattgcctgcgcgttgcttatgctggcttgcgctggcatgtattggattgcgcaagcgtcgtacgggcgatctgcggaagatttgacggaacgtacgccgaaaaaatgtgtggattccatatattgttccgcatgttgggcgtgcaggggcttgacaaatcggattttttctataatcgagcagcctgcctagaatatcggcagacgacacattgaagaagattggataagttgtggctctcatcgtgcagaaatttggcggctcttccgtagccgacccagaatcgatcaagcgcgtggcccgacgcatcatcgaaacgaagaacgccggcaatgacgtggccgtcgtggtctccgcaatgggagacaccaccgacgacctgatcgatcaggcgctcagcatcgactccaacccgccggcgcgcgagatggacatgctgatgaccgcaggcgagcgtatttcgatgagtttgctcgcaatggcaattcatgcggccggctctcacgcctactccttcaccggctcccaggctggtttcatgaccgacgcccagttcggtaccgcgcatatcaaggccgtgaagcctgaccgcgtgcgtcgtgcgctcgacaagggttccgtggccatcgtggccggcttccagggcgtgaatgagggtggcgacgccaccacgctcggacgaggtggatccgatacctccgcagtggctttggcagtggcgctggacgccgacgtatgcgagatttacaccgacgtcgatggcgtgttcaccgccgatccgcgcattgtgccgactgcacgccgtatccccgtcatcgactacgagtcgatgctggaaatgtcttcctgcggctccaaggtgcttgccctgcgttgcgtggaatacgcgcagcgattcgacatgccgttgcatgtgcgcagctccttctcccaccgtcgcggcacgctgatcgtgccggaagacgtcgatccgcgcacattgccgaacatctgagatatctgagattcgcattcggcaatcgcgagacatcgcaggcaatcgcaagaaaaccaagactttacgaacaaaggtaagaacatgagcgaaaacaacagccagtccttgggtgacctgttccccgatcttggaccggaagtcccgatcatttccggcgtcgcgcacgacaacaccgaatcgctggccaccgtgcgccgcgtgccgaacgagccgggcatggccgccaaggtgttcacgctgctggccgaggccggcgtgaacgtcgatatgatcgtgcaggcttccgcttccaccggcaccgccgatatttccttcactgtgcccggttccgccgctgccaaggtgcgggatgtgttgcaggagaagcaggacgagctgggctaccagtccttcgacattgacgccaacgtgggcaaggtggccgtggtgggcgtgggtatgaagacccactccggcttggctgccaagttcttcaatgcgctgagcgacaagggtgtgaatgtgctgatgatctccacgtccgaaatccgcatcgctgcgctggttccgctcgagcagctgcaggacgccgtccgcgcgctgcacactgcctacggcttggatgccgagcaggtggaagccgtggtgtatggcggtactggtcgctgacgcaataccgcgcaataacaatcgaaaaaagacttgactggattgcttgaggcgctcagccaagtcttttttattcccatatctgttttacagatattttttcagataatctgcaaatgaaaaagcggaggattgctgaataatcaacaatcctccgcaatattatgttctgcagaaatcagatatcacaatgtgcaatcatgcatgatcatgcgtaactgcagaacatatgcagatcgttatcacttcttggtgatgtagccgagtgccttcagcatttcggcgctttccaaagcgccgccggcagcgccgcgcaaagtgttgtgggcgagccccacgaacttccaatcgaaaatggaatcctcgcgcagacggccgatggaaacacccatgccaccctcgtagtccacgtccttcttgacctgcgggcgatcgtcgtcggtcaggtactggatgaactgcttcggcgcatgcggcaatccaagctcggaagccttgctcgtgtagttgatcaggcgatcgacgagctcttccttggtcgggttcttgccgaagttgatgaacacggtggcggtgtggccgttgagcacaggcacgcgaatgcactgcgaggtgatctttagcgggccgtcgaacggcacgatctcgcccttttcctcatcgacgtggccgaacaccttcagcggttccttctcggacttctcctcttcgccggagatgaacggaatgatgttgcccagcatttccggccagtcgttgaacgtcttgccggcgccggagatggcctgataggtgctcacgataacctcgcgcggctcgaattccttccaagcggcgagcgccggggtgtaggcctggatggagcagttcggtttgacggcgatgaagccgtgcgtggtgccgagacgcttgcgctggtgctcgatcacctcataatgctccgggttgatctccggcacgaccatcggcacgtccggagtccaacggtgggcgctgttgttcgatacgaccggcgtttcggttttcgcgtattcctcttcgatggcgcggatctcggccttcggcatgttcactgcggagaacacgaaatcgacgtttttgaccacgtcttccacgtcggccacgttcttgacgaccatgttcttcacgaattccggcatcagcgtttccatcttccagcgaccgccgatggcctcttcgtaggtcttgccggcgctgtgcgcggatgcggcaagggtgaccaattcgaaccacggatggttttcgagcagcgtgacgaagcgctgtccgaccatgcccgtagctccgagaatgccgaccttaatcttttcggacataacaacctctcgcttatgctggaacggtttcgtatgatttcacgcttgaggtcgaccagccggccccaaacgacgtcgtgggcggccacatgcgttgttcaatcttacgaaatccgcggaacaagcaggttcccctatccgtatgctggtctgccccgctttccatgcgttcccgtgcgcttgttgtcgatccgtacgatgatgcttcgcgaagcttctaccggcattttggatttcgcgatattcctggccccatcagcatgttcgtcaaattggtgtgatgcgggctggggtgggctggctgtctgcacaactcaggaatcgggccggttttgagggttgtgcagacggggatcgctggctttttggacggaacgctcgcgtacactggaaaccatgtcgaaggcatcagaagaagcgcagaagcagttggaccgtatcgtggcgttgggctacccggatgtggccgatatgtcggccgccgcgttccgtgctttggcgcgcccgctcatccgtgcgttggaggattccgatttgggcacgcagattctgttggtgcctacgcgcgagttggtttccccggaatcgttgatcgcgcgtacgtcgatcaaccgtatggctggtttcaccacgatgccgccgcgcgatatcgccagttttcttccgcaggatggtttcgaacctccggaaggtccgttttacctggtggtcgagccgcatacgggaacgtgctacatcaatcgagagcccgatgtggcgcgcaagctgatcgattccgacgagcgtttgccgcttacgttggaagagggtcttgcgattgccacgcagcatccggaatggttgttggagaagaacggtttcaatttgttgggatcgcgttccgcggatggtcgtgtgccgagtatttggatgagccagaatgcgcctcgattgggtgcggtatggccgaattcccgtcatacttggcttggcaacgcgttttgcgtgtctcgtcgcggcgtcagcctgttccattgatgttctgctgatatttcgcagattttccacagattttccgcattccacagattggcgattgtccgactgttgcgacggccacgccttgcggcggtcgcgcctagcgcttgaatagtttggcgatggcgtggccggctgcggcgcacattaccgatccgatgcccagcagtgtggcggtgacctgcgggcggcgcaattcgttgcggatgccgatcagatcggtcacgcaatggtcttcgaagaacacacgcaattcgttgctggagtagcgcccgatcaagtcgccccacgtgagcatgcgcgtcacgtagctgaccggattgttttcgcggaattcgaacagtcgaatgcctcgcagccgcgatttcggaccatagcattcaaagccgcaggtcggcgcgtagccaagatcaatgtcatgcacgtgcccgacgaacgcgttcttgtggtcatgcccgcagaacagcgcgaaatagccgcccgcatcgcgcaatgcctgcacttcgccaacgttctcatccgcacagccgatcgcctcgccaagcctcgagccaggtctgcacacgtcacgattcaacacatagcaatgccctgcgaacgttcgcgcaccctccaccgcattcggcgtgtatgcgggcacttcgcgcaggcaatcgtagaactcctgcggcggaatatgctggaacgcgatcgccggaaccgccaaaccgtcgccattgcgctcgcccaactcgcgttgcacttgcttcagccattcgatcgcttccggcgaaggcgtgccatagccgtcggaatcggccaaatcccatccgcgcgaattcgacgcgtattttgcgtaggatgtcagcgattcccgtcctccggcagcattgccaacagtattgccggatttaccagtatctccaacatgctcgcaatcgttggaaataccgcgattgccgtcaaacgcattatccgcatagtcgccggaatttaccatcatcacgctcatcgcaatgcgtcccgacccgtcggaagcctcgatcggaatcgcaaacgtgcctggttcgagcgccaaaggagacgacccggcaacgggattcatgcaaccggaaaactctcggtagaggtcatcctgttcgtcggcgagaatgccgcactggaaatcgtggttgccgtaggttgccgcgaaggggattcgcgcttccaatgcaggtccgaggaatgctgcgaacgtgtctcgtactttctgccgcgtgctgtcgagtatggtcgcggcggtcgcgcgattgatggattgcgcccatgattcaagcttgttggcggatccgttgcgcccgtcgcgtttgttgcgtttcacgagtttcggcgagtcggtgccgatgccgtcgatcatccaattgtcgtcggtcgggggctgttcgagcaacgctttggtgaagggatgtcgtttgatgccgcggattttcgcttcgatttcggtgaccgcgcgtatgtgtgtgcccggctgctctccgcgacggcgcaggaacgtgtcgatgtacgcggggtcgtatccgcgaatctggtcgccggtgaagacgatcagattgggatgcgttttcttgatggcggcttcgatgagacggatcgtgtcttcgcgcacgtttggtccgtcctgaatatcggccatctgcagcacacggaaggtgccgtcgctgttgaatcgcaaggtcatgatgctcactgtaatgcggcaaatttggatatgaggtgaaaaagagacgaaaatcgtggtctgtccgtcatatggcggaatgccggcgatatatgggattggttgccgctactatgggcggcagtgcaggtaggtaacatgcatgtaacaatgtgggccggcagaaggcttgcccagctttacagataaggaggagtgatgggtcaggatcaatcttcagtgtttgatctcgcggcagtcgcagcggcgtccaacggagggaacaacgacccgctgctgcctccggcgcgttatattggagctccgcaaaagcccagcaagatgccgtacaacaagtacgtcgcatacgataagcaggtgccgtttgattacccggagcgtacgtggccgggcaagcgactgcagcgtgcaccgcgttggtgttccgtcgatcttcgtgacggcaaccaggccctcgtcaacccgatggattccgagcgcaagctgcgtttctggaatctgctggtgtcgttgggcttcaaggagatcgaggtcggcttcccgtcggcttctgaaaccgattacgatttcattcgtatgctgatcgagcgtgagctcattcctgacgatgttacgatcgtggtgctgacgcaggctcgcgagcacctgattcgcaagacttacgagtgcctgaagggtgccaagcgcgccgtcgtgcacttctataactccgtgtccgtgctgcagcgtgaggtcgtgttccgcaaggataaagccggcatcaagaagctcgccaccgacgcggccaccctgtgcaaggagcttgagggcgaggcccagggcatcgacctgtattacgagtattctccggaatccttcaccggcaccgagccggagtacgccgttgaggtgtgcaatgcggtgatcgacgtcatcaagccgactccggagcatccgatgatcatcaatctgccggcaacggtggaaatgaccactccgaacgtgttcgccgatcaggtggaatacgtgtcgaacaatctggtgccgcgcgacgccgtggtgctgtcgctgcacccgcacaacgatgagggcatgggcgtggccgccaccgagttggccgtgcttgccggtgccgatcgtgtcgaaggctgcctgctgggcaacggcgagcgcaccggcaacgtcgatctggtcacgcttggtctgaacttcctcacgcagggcatcgatccgcagatcgattattccaacgttcctgagattcgcaagacggttgagtactgcaaccagctgaagatttccgagcgtcacccgtatgccggcaatttcgtgttcaccgccttctccggttctcaccaggatgccatcaagaagggtcttgaggctcgtcaggtggccgccgatcgtgccggtgccgatttggacagcttcgtgtggctggtgccgtacctgccgatcgatccgaaggatatcggccgcacgtacgaggccatcatccgcgtgaactcccagtccggcaagggcggcatggcctacctgctgaagaccaaccacaatcttgatctgccgaagcgtctgcaggtcgagttcgacaaggttgtgcaggcgtacgccgatgagaccaagaaggaagtcaaggacgaggatatttggcgtctgttcaaggacgagtatctgccggtcgaagagtccggcgctactgcggctggtgccgtggtcggcgacagcaaggacgactccctcgagcagtggggccgtctgaagctgctgaaggtgtcggtgtcgtccggtgaagatggttccgataccgtgctgaaggccaggattcttgaccgtggcgtgaacgtcggcgttgatgagccggtggagcgtgaggtttccggcatgggcaacggcccgcttgccgctttcctgaacgcgctgagcaacttcggcatcgaggcttccgtgatggattacgtggagcacaccatgtccgtcggcaccgacgccatggccgcctcctacgtggaatgccagatcggtgaggaagaggatccgcggatcgtgtggggcgtcggcattgacacgtccatcgtcaccagctcgctgaaggccattatttcggccatcaaccgttccgagcgctgatttccgcgggttttcggttctcgtagctgaagggcttgtgatgtacttgcgagtacgtcacaagccctttgctttttgatttcataggattcccgagtttccggattttccagtttttccggattattcggaaactcggaaattcaggattgcgatccccaaatgcagacattgttgccgattgcggagaacgtcatgaccggcttgccgtcgatctcgcgggggagtgttgcgaaccgtgcaatgtaggtcacgtcgtccaatcggatttccgcgtcgcttgcgcaacagttgaatccgttcacggcgccggaaagcggtttccacgatccgcaggtgatcggcccgtccgtcgacctcggcagattcgcgtcgggagtatcgaagaaacttacgatttcaccccgggtgatccgcccgtcctcatggaacgtatatcgcgtcggacgattgatgccaacgtacgtgccatcatcctcttgcttgccgttgaagaacgtatgctgatcatgcagtacaacgttgtaatcgcctgtgagatcggcaatgccggtcggcgcgacggcaacggaaccgcggtattcgtatggtgccgcaaccagccagccgtcggaagtcggcagtaattcgcgtacgtgagattcgtaatcttcatcatcgccctcgctaaagcgttccgcgaaacgggtgtggtagacgaggaacatgcgaccgtccttcgaccgacgaatggcggaattatgcccctgcgagacttcgacatcggcaagttctgccggaccgccatcccactgtacggaagacgtcaatcgaatgccggtgccgcgctcctgattgtcgggaatctcaccgtacgaaatcgcgggattgccgttctggtccacgtacgggccaagcagcgattttgaacggaacagacgaatctgatatccgccggtgcgcccaagccagccgtacgacatgaacagataccaccatccgttttcacgaatgaagtacgatccttcgccggaattccagtagcctccggccactttcacgccgtaataaggatcggaggaatccttgaccagcgggtatcgcacggaataatcacgcaagccggtttccggatcgagcttgaacatccagatgccgccgaaccatgaaccgaaactcatccacatttcgccgtgttcgcacaatgcgggcgccgcgtcgatggcgttgatgcgcgtgtctttgagcgacaggtagcgggtcaggtcatatccgacggtgccatcggttttgggctcaagttccagcactttcggcacgtcggtgttccacaggttgctctcgtcgaaaccggaatataccaccggccccacgtacgtccagtcgccgtccacatggtcggcggtcaacagcacgatcaccgagcggaactggtcgccgttcaccgacaggtacatgcaccacttgcccatggtctcgttccagatcacgtcgggcgcccacgtgttgccgagcaggtcgggattggaatcctgtttcggccatgcctgccaaatatcgccgagcagcgcgtacgggtcgcggctcagattgttatcgaaccgctcccaatgcaccatatccgtgctgcgcgcgcaccgacgatgcgtgccgaacagatagtagacaccgttttcctcgacgattgcgggatcgtgcacggccacccgaccgttggcgagcgtgtgctcgatgccgttgggcgaggtggccggtgccgcagatagtggttctgcagacgattgcactgcagcattcacggttgttgtgccgttttcactcacttctgcgacccccaaatgcacagattgtttgtgcccagagcgctgaaggtcatgactgccttgcgatccttgtctcgcggaagcttgtcgaacgcgccggaatacgtgacttcgccctcgttgccggtgagcttaagcgtcatctggttggcgccttccacggcctcccaagtgcccgtctggtcgccggtcacggtgccgtcttccttcagggtgatgttgatgggcttgttcacgccgcgatagacggtgctcgtcttatcggtgaccttcttcgggcccttgaaatagctggacttgtcgtgcgtcaccatctcgtaatcgccggcgatgtcggcggtcttgtagcccttcttgtcggccttggtgcccgtgtattcgtacggtgcggccaccagccatccgtcggcggtcggcagcagctcgtgcacgcgcacctcatgcttttcgccggaaccggagaaacgggtatggtacacgaggtaagcggtgccgtcgtcgtcaacgaacgcggaattgtggccctgggagacctcgatgttcgcgttgtcgttgccgctccactggatcgagctcatcaggcgctcgccgatgtcgctttgccagttgttgccgatggccttggtggaaatcgcggtgttgccggcttcgtcaacgtacgggccggtgatgtccttggagcggaacatgcggatctggtagccaccggtctgctgcagcgcgccgtaggaggcgaatagataccagtagccgttgtcgtgcagcaggtaggagccttcgccggagttgccgaagccgccgccgagcttcacgccatagtaggcgtcggacttgttcgcttcggtggggtaggtggagttgtagtcgcgcaggccggtcgccgagtcgagcttgaacatccacatgccgccgaaccaggagccgaaggtcatccacatgtcgccgttgtcatcggttttcacgcacgggtcgatggcgttgatgccggtgtcggtctgcgaggtgtaacgggtgatgtcggcatcctcgccaagcacctgcggcacgtcggtcttcttcacgttcacgcgttcgaagccggaatagaccaccgggccaacgtacgtccaatcgccttcgatgtcgtcggcggtgagcaacacgatcacagaacggtagttcgcgccgttgatcgacatgtacatgcaccacttgcccatggtctcgttccagatcacgtccggtgcccacatgttgcctttgacgtcaggattggaggactgcttcgcccagccgtcccaaatgtctttgaagatcttctcgtagtcggtgctcagattgttggtgaaggtgctccagttgatcagatcgtcgcttttgagccaagcgcgatgcgagccgaaaatatagtattttccgttggctttgacgatggagggatcatgcgattcgccgcgcttgatgctggcggtgctggtttcggctttcgacgatgcggacgattgcttcgtcgaattgccggagcatccggcgagcgttccgaccagcatggctgcggcgatgatgcctgccgcgatctgctttgctgttgtacggaatttcatttttccccttccttgcggatgacattgatttgtacaacgatgtaatttcttgtatagtgtacaacgttgtaaagaaaagtcgaatcataaggggtttctcgatgtcgagttcctacgaattgctgtgctacacgcgcgaagctaccggccgtgaaaaggcgaataatgaggacatcgcctatagcatgcaccttgcgttgcgtgccgatggggccgcccaatgggagccgctcaacgagaattacggtattttcttcgccgccggcgtgcctattcaggccgccaccgccgagtcgcgccgagcgtgcgtcgcggcggcgcatttcgtcgccgatccgttcgatgaggcgcatccggccaccgatgccgtcgcatatggcgcggtgatgccggggatcgacatcacgttgaaatccctgaagaacccgtatctgttccgccttgcggatggccgattcgcgctcgccgccacccgtaccgcgcgcggcggcgagccggatggctccgagcgatcggcgttcctgttggccatcagcgacgatctgacctccttcacgcagcttggactggtgatgctgcgtaccggcggtggcgtcaatcgtccgtctgtcgcattcgacgcggacgcctcccgttatgtgatttcctggacgtcgaacgacggcaaatcgtatgtcgcgaccgttgccgatattgtcgccgtggccgaatccggcgagccgatcgatattgcggaagctgtggtaacggcggaatcaagccgttcctgcgattgcaatattcccaatgccattcctggcaacgtgattgccgtcactgaagaagaagcgtcgaaactgatcgaacgattcggtcgtatttacaacgttgaaacatcggtggcgacgcagcatatcgacatggcggcaagcagggaagcgtcccgtgaagccgtgcaggcactcgccaaggtccgcgccgatctcgtctacagcgacggttccggtgccacccgtgccgtggattggaacaaagacgaacttgaggcgattgcgcaggacgccgccgaaggcaagttccagccgggcgacacgcgcacggtgagcggccgcatccgccaaaccgtatacccggtgccatttgccgtggagcgtgcggacccgtcggtgttcgcttggaatttcaacggcaagccgatgttcatgttcatcgccaccgacgataccgacggcaactgcgtcgatccgaacgatggcgccacgcatatgccgttgcgcatcgccgactccatcgaagcgctttccgacgcggcgggcggccgtgccaaggaaatcgatctgctcaaatgcggtgattacaacgctgaaggacgcgccatgaccggctgcttctgggcgccggaactgcatgtcatcgatggaaaactgtcggtgctcttcatgccatgcttcgatgggccggccaccaatccagacggcacgcccaacgatcgcgcaggcaagccggacatgtggacgggcagctgccatatcatgcagctcaagcagcattccgacggcacggatttcgatccgcgcgaacccgaaaactggacggtgccgaagccgattctcacaccgaccggcggcgtgctcaatcccatccaacgtatctcgctcgacatgaccgtcatcagcgattccggccgctggtattacgcgtggcagcaggtcggcagcatttggatcgccagcttcgatccggcccgtccggaacggctcacctgcgagccgaagcaggtcgttgtgccggaattcgcctgggacaacatgatcgccgaaggcccgaacgccatcgtgcatgacggcacgatctatctgatctattccggctcgctggtcggtatcgactacaccaccggtctggtcaccgctccggctgggcagaacgccgacctgaccgatccgaacgtgtggacgaagctcgactatccgctgcagaaatccggagtatacaacgggcagtggcagctcggcaccggccatggcatgtggtccaacgacgaggacggcaatctcatctatgtatttcacaatgcggaatacgagaatggacggtatggcggccgcgacgcccaggtgcgccgcgtgcactggtccaaggagggtatgccgatactggacatgcaggcggcggaagagctcaatccggactatgctgatataacgatgaaaatcgtggtttccggcaataaaggctgatttcgttggcttcagcgccgcaaggggcgaaagccggtgttgggtccgaatgtatgagacgtttttggtgaaaaggggttgacatgccgaagcagaatggcgccaacggcgagcacgtggtgaccatgcgcgaggtcgcgaaggcggccggcgtatcgatcaaaacggtgtccaatgtggtcaacgactacgagttcgtgtcgcaggccacgcgagacaaggtcaacaaggccatcgacgagctcggctacacgctgaacgtgtccgcgcgcaatctgcgcagggggcagaccggcatcatcggcctcgccgttcccgatctgcagatgccgtacttcgcgcagctttcgtcgctggtcatcgaagaggccaagaagctgggcctgcgcgtgatcgtcgagccgacgcaatactcgcgcgaaggcgagattgaggcgttgcacggctcccagcagacgatgatcgacggcctgatctacagtccattggaacttgatcaggatgatgtcgaccaattggatgtggactatccgctggtgcttgtcggcgaacgcatcttcaccgacaaggtggaccatatcgccacggaaaacgtggaaggtgccaagcgcgccacgtcgtatctgctgcagaccggctgcaagcgcgtggccgtggtcggcgtgcatccgggcgagaaggtcggctccgccgcgctgcgctatcagggctaccttgaggcgttggaggaggccggcgtcgaattcgacgagcgtttggtggtcgagtcgggcatgtggcatcgtagcgatggcgtgcgcgtgatgaacgcgctgcttgattccggcgtggttcccgacggcgtcgtcgcgctgaacgacatgctcgcctccggtgtgatgcatgcgatccagatgcacaatctgcgcattcccgaagatatttcggtgatcggttttgataattccgacgattcgcagtatttgtctcctgcgttgacgtcgattgctcccggtcttgaggcggtggcgcgtctgtcggtgaaattgctgaaggatcgtatcgacggggtttcgccgtcgaaggatctcaagccggagcagaaggtgttccgcaaggtttcgtcgtcgttggtggtgcgtcagtccaccaagctgcccacgaattccttggtggtgtgatcttccttccttctttttcttcttcttttggaaggaaggaagtgattggtgcctcggcgcttgcgtccggttttttacggattgccggtgccgaggtttttgttttccctttctggcgattgtctgttgccgggtactgcgattcgattcttccgaggagtcggatgcgagaaacacgcggtgcgttcctccgatttgttacaacgttgtaatagtgatatattcaacgttgtaaattactggaacagcggattgaaaaggaatagacatggctgtttacaacaatccgatcgtgcttcagcgcgcagatccttgggtcctcaaagttgacggcgagtactacttcactggctccgacccggaatacaactgcatcgccattcgtcacgcatcgaatatcaacgacctgcagaaggcccccgaaacggtggtgtggcgcaagcatgaatccggccccgcgagcatctatatttgggcgccggaactgcaccgcatcaacggcgcttggtacatctacttcgcaggcgccgcaacggatttcgaggcttccggactgccgacgcatcgtatgtttgtgctggagaacaccgatgacgaccccaccaccgacaactgggtggagaagggccagatcgtcactccgatcgactccttcgcgctcgacgccaccaccgaggtgatcgacggcgtgcagtacctggtgtgggctcagaaagatcccgcgatcgaaggcaattccaacctgtacatcgccaagatggcaaacccgtggacgctggaaagcgagccggtcatgctcaccaagccggaatatgactgggaatgcatcgacttcctcgtcaacgaaggtccggccttcctgttccacgagaacaagatctacatcacgtattccgcctccggaaccggtgtgccgtatgccgttggcctgctcaccgccgagcgcggcagcgacctgctgaacaaggattcctggaccaagagcccggtgccggtgttcaagacctgcgccgaaaacggccagtacggccccggccacaactcgttcaccaagtccgaggacgattccgaagacctgatgatctaccattgccgcaactacacggaaatcaagggcgatccgctgttcgacccgaatcgtcatgcccgtgtcggcgtggtcaagtggacggagaacggccccgacttcggcgtgccggaacccgacaatctgtggactccggacacgacggatgtgttgccggccgacggcggcgctcttgcgggaaccccggccgcgaaatgactgtggtgatcgcaagaaacgttgcgattccaacaaaacgaataattgaagatcataaagaaaacagcttttccatcggcgtgtttccgatttgtacaacgatggaaaaagctgtataatcagaattacaacgttgcaaacggcagtgcagctgacgaagcgtgaacgacatcgcaaacaaggttgttgatgaatgtcactgcaacggttggaggaaatgtcttgggagaccaagaggaaaaggagaaatccatgaagatcaagaagagcaccaaggctctcgcggccgcggcctccttggccatgatggccaccgtcggcctgtccgcctgcggcggcagcagcaacgacgccgagacgaccgctgacggcaaggtcaagatcacgatgtggcacggcttctctgaggccgatggcaagaccctcgagtccatcgtcgacgacttcaacaagtcccaggacaagtacgagatcgacgcccagctgcagccgtggagcaccatcggcgagaccatggtgaccaaggtcacctccggcgacggcccggacttcgtgaccaccggcgccgacaatggccaaggctggtccatcgacggcaccttccagtgcgtcaccgatttctatgacgacaaggacagcggcaccgatgagtacatcgagaacgtcgttgaccagatcaccttcaacatcgacggttccgaagagaagtgcggcgtcccgatgggctacgcgccgaccgccgtgtggtacaacaccgacatgtggaaggctgccggcctgaccgacgccgactacccgcagacctgggatgagctgctcgaagtcgctaagaagctcaccaagtccgatggctcccagtacggcatcgctttgccggatctcggctgggctccgttcctgaagggcaacggctccggcatctacaccaccgatggcaaggtctccatcaacaccaaggagaacaaggccttcctcgagaagatgcgtgacttctacaagggcggctactccgtgtccggcatggatgagaccgctgctcgtgaatccttcgaatccggccagtccgcaatggtgatcgtcggaccgtgggaggatcaggcctccaccgacaagggcatcaaccacgacctgttcccggttccgaacggcgacggcacctatgtgtacccggacggcaccaagggttccaacaccggctccaccggtctgtactggtgggtcacctcccaggttggcgactccgctaagaagcagggcatctacgacttcttcaagttctacaacaaccacgacaaccaggtgacctggtccctcggttccgcctatccgccgaacaacaccaccgtcaccgccgatgagctctccgagcgtccgctgatcgccaagatcggtgagaacaccagcaagtccttcatcggtatcgcaggcctcaagggcggcttcggcgacatcgccgcctccgtcgacaccctgacctccaacaccgcccgcaccgacgacgacatccagagcctgctggacgacgccgaatcccagatccagggctacctcgacgagtacgccgagtaagcgaagcgggattcacctacaatcaacataagtgagcgggcctgacccgctcaccaccccagcaaaaggccacggtgctggccctcacgccagcgacgtggccttttgctgtattaaaaacacatccctggtggcattaaggaggagataatggcacaagcaactgccgccccaggatccgcgcattccgcagtggccaaggagaacaagaaggcgattcaggcccgcaacctgcgcaccggcctgctgttcaccgcaccggccctcatcgttctcgcaatcttcgttttctatccggcaatcaagacgttcatcacgtctctgacttccgaccgcatcaaccgcgccggcaagttcgtcggcttcgacaactacgtcaagctgttccaaagcgccgacttctggaccgacgtcaagaacaccctcgtctacgcagtggcctacgctccgatcgtcgtgatcgtcgcactcgcgttcgcactgctgctcaaccgcaaggacctcaagttcgtcggattcttccgtacctgcatgttcctgccgttcgtcatctccctgaccgtcgccgccatcgcatggcagttcatcctctccccgtcgctaggcctggttccgtactggatccagcagctgaccggcatcgcgcacgtcgatctgctcggcacccgcgaaaccgccatggcggccatcgtcttcatcaccgtgtggaaaaacttcggctacttcatggtcatcttcctcgcaggtctgcagggcatctccgccgaactgtatgaggccgcttccctcgacggcgcctccgcatggcagaagttccgttacatcacccttccggcgctgcgcccgaccttcaactatgtggtcatcttcggcctcatcggttccttccaggtcttcgatcaggtcttcatcctgacctccggcggcccggcacgcgccaccgaaaccatcgtgtaccgcatctacaccgaggcattcggcaacggcaagctcggttacgcatccgcactgtcgtacgtgctgctgatcatgacgctcatcgtgggcctcatccagctgtacaccaacaacaagcatgagaaggaggaaatcgcatgagcaccgcgactctttccgcacaagagcaagagaatgcccgcatcaacgccgaaaacgagcgtcttcgcaagcaggcgacccgcaagcgtcgcatcggcctgggcttcagctacttcgcactgatcctcatcaccatcctgatgatcttcccgctgctgatcgtcgtgctggtgtcgttcaccccgaacgccatcacgcagacctggccgccgaagctcattccgagccagttcacccttgaaaactaccagtcgctgttcaaacgtctgccgatcggccgagaaatgctcaacaccgtcatcttcgccggtgccgtgaccatcatctccgtgttcttcgactccctggccgcctacggcctgtcccgtgtgaacttcaagggccgtggcctgctgctcggcgtgctgatcgccaccatgatgatcccgggcatggccctgctcatcccggtgtacaagctgctcgccaacatgggcctcatcaacagctactggggcatcatcatcccgcgtatggccgacgtcggcggcatcttcctgctgcgccagttcttcatctccattccgaaggacctcgacaacgcggcccgcatcgatggcgcaggcgaattccgcatcttcgcgcagatcatcctgccgaacgcggtgccggccatcctcaccgtgggcatgttcaacttcatgggcaactggaacgacctgctctggccgttgatcatgacttccaagccggagacccgcaccatcaccgcaggcctcgcaatgctgaccggccacggttcctccgtcaccccgtacggcgtggtgatggcaggcgccctgatctccgcactgccgctgctggtggtcttcttcttggtgcagaagcgcttcgtcgaaggcatcgccatgaccggcatgaagtaaagcccaacttcatcgcctgatcaaacaatccgtaattgaaaatccataattgaaccttgttttccttccttcgataaccgcaccgtttggtgcatagaacaaggccgtcggcgtggctcctccccacggtggcggccttgttctgtattctcgtaaaaaacgtttgtacacgtattcgatacacgtatgtagacgacgcaaaggagcgcgcatatgacttcgcatattctcgaacgggtccctctacagcaggtgaggctactgccaggagaacattttgacgctcaacaggccggcgcgcggtacctgcttgatctcgacgtcgatcgcctgctatatcccttccgcagggaggcgggactgccgcagccgaccgatgccgacggcaatccggtaacgtcgtacccgaattgggaggaaacggggcttgacggccatatcgcagggcattatctgtcggcttgcgtcggattcgcgcaagtcgcagacgatccgcaaccgttcatcgaccgcgccgccaccgtggtgcggtcatggcatgaatgccagcagtcgtttgccggcgatgctgtgatgcgcgggtatgtgggtggtgtgcctgattcccgcaccgtgttcgggcgccttgccgcaggcgatgttgaatcgcagaatttctcgatgaacgacgcatgggtgcccatgtacaacgttcacaaaacgttcgccggtttgttggatacatgggccgattttgcttctatcgatgaacagacttcgcagctggcacgtaccgtcgtgcttgatctggccgattggtggtgccgtatcgccgagccgctggacgacgagaccttcgacaggattctggtgagcgaattcggcggcatgtgcgaatcgttcgccgaactgtacgcgcgtaccggcgaggagcgctaccatgtgatggccgaccgcttcaaagaccacgccatcttcgacccgctggcgcaaggcgaggatgtgctcaccggcatgcacgccaacacgcagattcccaaagtgcttggatgggaacgtttgggcgcgatttgcaacgatgaacaggccgacgccgccactaacaccttctgggattccgtggtacatcaccgttccgtaagcatcggcgcgcattccgtgtccgagcatttccacccgacggacgatttttcatccatgatcgaatcgcgagaaggcccggaaacctgcaattcgtacaacatgtcgaaacttgcggaacgactgtggctgcgttccggcagcgccgactatatcaacttctacgagcgggtgctggaaaatcacctgctgtccaccatcaatccgaagcagccgggattcgtgtatttcacgccgatgcgatcgcagcattatcgtgcctattccacacctcaggaatgcttctggtgttgcgtcggttcgggattggagaatcacgcccgatatggacgattgatttacgcgctgcagcggccggctgcgcaggattcggctgattcggctgctgctggttttgccagttctgccgccgagacgggcaataccgtttcaaacaatgccgaggcggaagctacgcgcctgctggtcaatctgtacatcgattccaccttcgactgcccggagcagggtctgcgcatcacgcagcgcgccgctcgcattgaggatggcgtcgattacacggtgacgttcacattggaatccacggccgagcatgttcccgatactcccggtggtttgcgggaaaccacgctgtttctgcgccgtccgtggtgggcggagcattacggcgtgatggaagccacctgcgccgtctgcacgcttgatccggcacgcaccaacgatattcccgaaggatatctgccgttgcgtctgcgctggaacggcgttgcggaagtggtgatgcggttgcggccgcggatcaccgtcgagcgtatgccggacggttcgccttgggtcagtttcatgaaggggccgaaggtgatggcgctggcttcggatagcgacgatatggacggcgaattcgcggacgccggccgtatgagtcatattgccaccggtccgttgcgtccgctcatatccatgccgatcatcaacggcaatccggtcaaggcgtgcgcgcaggtttccagaccgtacgtgcatggcctcaccgttgccgcgacggacgtttccggccgtaccatgctgttcgacatgcatgagttcagcagtatgcatggctgccggtattccgtgtatctgccggttgccgacgatggcaacgtgtgtgcgttgcgcgcgcaactggccgatatcgatgcgcgtcaggccgctagcgagcagaccgttgtcgacaccatcgcatgcggtcagcagcaatcggaaatcgatcatcggtattcgggcgataacgacatgatgggtgccgacggcacgttgcattggcgtcgcgcgttggctggtggcgaattccagtatgcgatgcgcgggcgtggtcaggcgcatcgtttggaaatcgaggtgattgccgattccgcggaaagcgacggtgaaaacacggcgtatgaagtgatgctcgacggcctgccattgcagcgcggcgaacatcgtcgtatcgatggcgatcccacggcaatcgacgtgtatccgctgccggatgccgcagaaactgcggaaaccgcagaaaatattgagaataccggagaaaacgacaatgctgacgacgctgcgatcgtacgcatctcggcttcggcgcatgacggcgcgaaaatcaccgccctacgattgcataagtaggattgcagcgatgaaaatcgcgatatggcagacgattgaccgtccgggggcgtctgccatggcgatccggtgattggaggatgctgatacgcattgtggcggcaacgatggtattcgttgccgccacaatgtttttgcggttgctgttccggctggcgtcggttgccgtcaatgagcgggtgccttgcctgccgccaacggttgttgcgacggttattgggctccgttcgactggtcgtctccggagttgtcgccactgctgttaccgccgttgccgccgtctccggagctgtctccgccgttattgccgctgtctccgtcgtctccggagttgccgccgtcaccgtttccagcgctgttctgatcgctgttttgcgtaggatcgggtgtggtctgctcggtgttctcttcggccttcggcatctcctgattctgccgtgtctcggtcttctgcgcgccggtgccccatgtgccgtccgggccgccgatcttgccgttgtcggtcggttcggtgaaggtcagcacctcctgattctgcaatgcgagcgacatgaactcctcgaacagatgcgacgggtagcccgtggaggaaacgccatagcctgcgaacgatggcacttcctgcgcgctgccgtcttccgcaggattccaaatggcccacacattgagcagctgcggcgtgtagcccacgaacgaagcggccttctcgtcgtttgcggtaccggacttaccggccacctggcgtccgagacgtgtcgaaacgccagccgcggtgccatacgtggtggtgccctgcatggccttctgtaccagatggcaatcgttcgcatcgaacacctgctggttctcctgcgccgtcttgtacagttccttcgaaccgtcggacgtgagcaccgtgtcgacgatgtgcagcgtgttcttcacgccatcattcgcaatggtggagtggccttgcgccagatcccacacggtaatgccgttgatgcccagaatgttgtaggtggtgtcttcggcgatgtcttcctcaatgcccgcctgatgcgcgatcttggcgagattcgcggcgccgaggtgcttgttgacctccatgaacaccgtgttcaccgaattcgcggtcgcctgatagaggttgatatacccgtaattggtgttcaacgcgttcggcacctgcgcggtggttcccggcgtcgtttcaaacgtcaggccagaattgccgttgaagatggtgttgaaattcacaccctcctgcgcggctcccagcaagccgaacggcttcatggtggaacccggttcgaacgtggcctgcgtggcgttgttgagctgcttggtgaggtaatcgttgcccgcatacatggctttcacggaaccggttttcggatcgaccgcaatgccgcccacctgaatgctttccggcatgccctccggtcgggtgtcgccgacctgctgaatctcgtcctgcatgcccttgtcgagcgtggtgacgatcttgtagccgccggtttccagatcatcggcggtgaacgccttggaattgaccagttcgttcttcaccgtggtcagcagatacccgttcgcgccggccatctggttgctctgctgtatttccgccacggcagggaactgcgcttccttcttctcctgggcggtgatgtagccgtcttccttcatgatgctgagcacgcggtcgtatcgcttttcggcctgttcctgattgacggccggatcccatgagctcggcgccggaatgataccggccaacatggcggattccgacaaggtcagatcgctggcgttcttgttgaaatacgccttcgccgccgcctgaatgccatacgcgccacgaccaagataaatcgtgttcatgtaattgcacagcacctggctcttatcttgtgcctgcgcgatcttgatggccaggaacgcttctctcagcttgccggaatacgacgtggtttcgcccaaatagtagcgttccgcatactgttgggtgatggtcgaaccgccctgacggctgcctgtggtcagattcgtatacagcgctcgcgcgatgccatacagatcgatgcccttgttggtgtagaaggaacggtcttccgacgcgacgatggcattgcccacgtaatccggcaataccgcgcaatcgatgatttcgcggttctgttccgcgtagctgccaatttccgtagtgccgtcggaatagtagacggtggttttttcggcgagggcgaacttttccggttcggggatttccgtggtgatatacatgtaggcgaacaggccgatacctgccgcgagcagcgctgcgaagatgccgagtacccacttcagcacgagatgcttgcgcttgttctgctttttcttaggtccgttggcgcggtgcgatccgtggttctgcggcttgggcgcgctatgggatgcgttgctgcgattgctgccggcgccgccgctgcgggcgcttcttgagcgtgagcttacgcttcgtgtgtgtgaaaccataggttccaccgtagctgattgacttgagaaatcaggtggaaataggtgcgtttgccttggcgggggcattttttgcgcagctcttttacaaatcgacagtttgcaggacgttgcctcaatatcggctgattttcagggttttatcagtttttcaggtgccttttcgctgtttcgcaggtatgcttgaaatttggtacctgtgaaacgcatatatgcatatatataacagaggagtcgtttacagatgagcattcgtgtagctatcgctggcgttggcaattgcgcttcttcgctggtgcagggcgttgaatactacaaagacacgaaggacgaggataagattcccggtctgatgcacaacaatttcggcggatatcgcgtgcgtgacattgaattcgtcgccgcattcgatgtggacgcgctgaaggtcggcaaggatctgtctgaagccatcgaagcgtcgcagaacaacacgatcaaattcgccgacgtgccgaatctgggcgtcgaagtgctgcgcggcccgaccaacgatggtctgggtgaatactatcgccagatgatcgaagagtccgacgccgagccggtcgacgtggcccaggtgctgcgcgacaagaaggtcgacgtgctcgtttcctacctgccggtcggttccgagcaggccgacaaggcatacgcccaggccgccatggacgccggatgcgcgttcgtgaactgcctgccggtgttcatcgcatccgatccggaatgggctcagaagttccgtgacgccggtgtgccgatcgtcggcgacgatatcaagtcccaggtcggcgccaccatcacgcaccgcgtgctcgcccgtctgttcgaggatcgtggcgtgcgtctggaccgcacgtaccagctcaacgtgggcggcaacatggacttcatgaacatgctgcagcgctcgcgcctggaatccaagaagatttccaagacccgcgccgtcacttccgtggtgccgcacgatatggatccgcataacgtgcatatcggtccgtccgattacgtggcatggcttgacgaccgcaagttcgcgttcgtgcgtcttgaaggcactacgttcggcgatgtgcctctgagcttggaatacaagctgcaggtgtgggattccccgaattccgccggtattgtgatcgatgccgtgcgtgccgccaagatcgcgctcgaccgtcatctggccggcccgattctggctccgagctcctatttcatgaagtcgccggccgtgcagcacgaggatggcgaggcccgccgcttggtggaggagttcatcaagggcgaggtcgaaggcagcgaagagcagcttgacgccgatgtcgccgccgccaaggcagctggtaaggatgtgtggcgtgcctgatttttggttcgtctgatatgaggaatccccaatctaccgtcggtggattggggatttttaattacgatttggaaacgatgcgtatcgtcacttcttgaggaggggttcgacctgttcctcgtacgcggtcaacgcggtgtcgatcacgttgtgcatgtcgtagtacttgtacgtgcccagacggccgccgaacaccgtcttcggctcggccttcgcgagctcctcgtacctcgcgtacagcgccttgtcggcctcggtgttgatcggatagtacggctcgtcgccgcgctcggcgaaacggctgtactcctcccacaccacggtcctgtcgggattctgcgaggcggcgcgttccggattgaagttcttgaactcgatcgcgcgcgtgtacggcacgtccgcgtcggagaagttcatcaccgggcagccgaaatggtcgccctcgtcgtagcggacctccttgaagtcgaccgtgcgccacttgagctcgcccagcgagtagtcgaagtagcggtccaccggacccgtgtacaccaccggcacgccggccgcggccaaagccttcctgttgtacggctgggactcgtcgaagaagtcggtctccagggtcacatggatgcgcggatcgtcgatcatgcgctccatccacgcggtgtagccgtcggccggcaggccctcccacgtgtccttgaaatagcggttgtcgtagttgaagcgtaccggcaggcggttgatgatgcccgcgggcaggtccttcgggtcggtctgccactgcttgcccgtgtagttcttgatgaacgcctcgtacagggggcggccgatcagcgaaatgcccttgtcgttgaggttctggggatccttgccggccagctcgccggcctgctcggccacgagcgccttggcttcggcgggcgtgtagtgcgcgcggaagaactggttgatggtgcccaggttgatcggcagggggtagacctcgccgtcgtgcgtggcatacacgcggtgcacgtagtcggtgaacgaggtgaacctgttcacatagtcccacacgcgcttgttggacgtgtggaacaggtgcgcgccgtacttgtggatctccgcgccggtctcctcgtccatgtagctgtacgcgttgccgccgatgtggtcgcgcacgtcgatgatctccacgcgcacgccgagcctctccacggcctgctgggccacggtcaggccgaacaggcccgcgcccacgaccaccagatcgggatattccaccgcttcagtcataagaacaaccttccgaacttaaaacaaacacacaatattcgtgtgcgattcctcatcaagcatacccgtccgccctccttaacgcggggcgcacatggggaagcggcattttgacgtttgatttccctgtgtcgctgatcgtggggctgactgctccacggatcatggcatggtctgtgtggttcgtgcgaggtctgtggcgcgggttgtgctgcggttcgtgcggcttgcggcgcggttcggtccgggcatggtgtacactggtctttgcctccgcgtggcggtacgtcacccaactcccccagggcaggaatgcagcaagggtaagtggcctcttccgggtgcgtggaggttttcttatatcttcatgccattcgcgcataccgtagagccaatgccgtattctcgatgattatgaccgacgaattcaagccaatcatccgagacccgcacaagtccgcgaatatgctggaacagccggtcgcgcccgttcccgtgccgcagccgccgtctgatccgatcgaacaggtgctttccccacgtgaagtgagcgaagggcttgccaaagccgatccgctgacccgtcatccgcgcgtgtcgagcattatgctcagcgtggtgttcggtctgctgctgcttgccgccgcggtgggcgtctggtggttgggcgtgcgcacgatggaaggccaaagctatgaagacatggtctggtcgaaattcgatgcggccctgccgggatggctggaaccggtcgtgcatgtcttcaccatttccaccgttgtaatcgcaacaagcgcgattatgtcgataatcgccctcgctgtactcatcgtaagaaaacgatggctgttgattgctcaactggcggtattcggcggaatctgctttgccacagcagagttgctgaagccgctgctgccacgtccgtacttaatcaatctggaatcaaatcccaataattccgcgccttccgggcatgtcatactcgccgccgcggcaggagtgatcctactatgcgccgtgcctcgcgtatgccgtgcgctcgttgccgtgatcggctggctgtatgcggtactcgtcggattgtcggtgatcgcgggacagtggcaccggccgaccgacgtgatcatggcattgctgatcgtcggcggagtggcaatgatcacgcttgccgcgacgtttgcgaacggcatggatgagcccggttcgcgcgcgtcgtcgccttccgtgcagatcgtcggcagcgtgctgttgacgttcggcgtgctcggcaccctgtatggcgcatacattatttggcagattcagccgggacttgcgatgagtgcggaatggacgaattccggcgcgcacctttccacggtgattctgacggcttccgttgcgtcgttggtgttcgggctggtgttgaccatgcgtcagctgaccgcctcgccattgacgaaacttgggcttgtcggcgcacctccggcccctccgaaacgctgacggcaaaacgtacgatcacgccgaaaatttccggcaccggtcgctcgcgccacacggacggtttgccaactgcatacggtcagtgagtattattgcgttgcaaacgctagtaataaggagtggctatggctaccggcagcaagctcgtgattgtggagtctcccaccaaggccaagaaaatcggtgggtatttgggctccgaatatacggtgatggcctcggtcggccatattcgagatcttgcgcagccgagccaggtgccggccgccgacaaaaccaaattcggcaagttcggcgttgacgtggaagacggattcaagccgtattacatcgtcgacggcaacaagaagaaaaccgtgtccgagctgaaaagcgcgttgaaaaaagccgacaccctgtacctcgcaaccgatgaggatcgcgagggagaggccatcgcctggcatctggtacagacactcaagccgaaagtgccggttaagcgcatggtgttccacgaaatcacgaaggaagccatcaaagcgtcgcttgacaatactcgcgacgttgacgacgacatggtcgacgcccaggaaacccgccgtattctggaccgcctgtacggctatgagctttctccggtgctgtggcgcaaggttgggccgggtctttccgcgggccgtgtgcagtccgtcgccacgcgtttgatcgtggagcgcgagcgcgagcgtatggcgttcgtgcgtgccccgtattgggatgtcaccgcaacgttggaggcgccggatgccgatggcaataatgttgcgttcgattctcgtatggtgtcgttgggtggccgtcgtttggctggttccaaggatttcggcgccgatggcaagctgactgcggccggtgcgaaggatcaggtcgtgcagttggacgaggcgcaggcttccgcgattgctcaggcattggaatttgcaacgtttactgtcgcgtcgatggaaaccaagccgtaccgtcgccgtccggttccaccgtttaccacgtccaccttgcagcagaccgccggcaatcgtctcggcatgagctcgcgtcagaccatgcgtgcggcgcaaggattgtacgaaaacggctatatcacctacatgcgtaccgattcggtgacgctgtcgcaagaggcgatcgcagccgcacgcgaagcggtcgtcaagcatttcggcgaaaactatctgtcggacgcgccgaaacaatatgccacaaagacggcaggcgcgcaggaagcccacgaatgcatcaggccggcgggcgcgaaattccgtgaccctgcggaaatcgcaagcaaagtgccggccgaccagctcaaactgtacacgctgatctggcagcgcacgcttgcctgccagatggcagacgcaaccggttccacggcgaccgtgcgactgtccgcgtcgaccgaatcgaatggggaagccatgttccaggcttccggcaccgttatcgagttccccggctttatgaaggcgaccggtgagggccgccgagcgttcgccgaatcgaagaagggtgatgttgctggaagcgttgaacaggccgcgcaatccggcaaatccagcaaagcggataagaagtcggatgacaatgtgtcgctgccgccgatgaatccgggcgatgcgctcgctgcggtggcggttggtgccgacggacacgaaactcagcctccggcgcgttacactgaagcgtcgcttgtgaaaacgttggaacagaaggaaatcggccgcccgtccacgtatgcgagcattatttccacgattatcgatcgcgggtacgtgtatgagcgcggtcgtgcgttgattccgtcgtggctcgcgttctccgtggtcaaattgctggaaacaaagttcccgcggtatgtggattatgagttcactgccgatatggaaagcggtcttgaccagatcgcgagcggtcaggagaccggcaggaattggctgacccgcttctatttcggttccggtgagggtgccgcgcagtctgcagacgaggcacatgccggcttgcagcagcaggtcgcgcagttgggtgaaatcgacgctcgcgagatcaatacgatcgagatcggcgacggtttgcatgtgcgcgtcggtcgatatggcccgtatttggaggatatgaaccatctggatgatgagggcaatccgaagcgtgcctcgctgccggatacgctcgctccggatgagctgacggtggaagtcggtcatgatttgatcgagaaccattccggcggtccgcgcgctcttggcgtcgatccggtttccggaggcaccgttgaagtgcgtaatggtcgtttcgggccgtatgttgcgctggtgatgccttcttcggatgctggtgctgacggtgacgtggctggtggtggcaagtcgaagaagggcaagagcgctaagaaggctgccgatcgcccgaagatggcgtcgttgttcaagacgatgagtccggaatcgttgacgttggatgatgcgttgcgtctgctgagcttgccgcgtgaaatcggttcgtatgaagaggtggatgcgcagaccggtgaagtgcagacggttaccgtgcaggccaataatggtcgttacggtccgtatttgacgaagactggtgccgatggcaagtcggatacgcgttcgctcgcttcggaagatgagattttcacggttgatttggataaggcgaaggaactgttcgcccagccgaagtatggccgtgggcgcggtcgtggcgctgccaagccaccgctgcgtgaactgggcgtcgatccggaaacgcaaaagcaggtgaccatcaaggaaggcttctacggcgcgtatatcaccgatggtgaaacgaaccgtacgttgccgaagcagtatgctcccgagtcgatcgagccggctgaggcgttccgtctgctggcggagaagcgtgcgcagggtccgtcgaagaggcgtggacgcaagggtgctgctggcaagggtggtgctaagaagactgctgctaagggtgctaaggcttctgctgatcaagttcgtgccgatcgccgtgccaaggtgcgcgagttggccgataagggttgggccaacacccgtatcgccaaggagatcggttccacgccgaccacggtgaaggccgatgtggaatggctcgctgtcaacgaaggctacacccgtcccgccgtagttcccgcccggtgatgaacagtccggtggactgttcgtagcagtgagcagcggtagcgttgcgaacgccgcaatgtagagtgatgaatatgcaaggcatattcatctcctttgaaggtgtagacggcgtcggcaaaaccacgcaggtcgaacggttgcgtgcgtacgttgaggcgcaggggcgcgaatgcgtggtcacgcgcgagccgggcggtactgtgcttggtgtggcgattcgcaagctgctgcttggcggtgtggaaggttccgacgcggatattgctccgcgtgcggaggcgttgctgttcgccgccgaccgtgcccagcatgttgccgaggtgattcgccctgcgctggaacgcggtgccgtggtaattaccgatcggtaccttgattcttctcttgcataccaggctggcggccgcgaattgacggcaggtgaaatccgcgacttaagtatgtgggcaacgtgcgagctattgccgaatcgcacgtatctactggatcttgaccctgtgcaatcgcatgcacgactacagcatgatgaagatcgcatggaatctgcaggaaacgatttccaacgtcgtacacgacaggcgtttcttgacttggcaaaggcggaatcacaacgtttccgcgtgattgatgccagccaatccatcgatgaagtatggtcgcatattcaagacgattttgcacaaatcagccaaacgaaaactttccaatcggaggccgcccagtgagcgtgtgggattcgattgtcggccagcagcgggttgtcgaacaactcaaagccatcgcaagtggcgatccgaaagccattgcgcaatcctggctaatctgcggtcctccaggatcgggccgttccaatgtggcgcgcgcgtttgcggcggcgctggagagccccgatcatggtcttggcgacgagccgaccaaagccgtgcagcaggtgcttgccggcactcatcccgacgtgaccgtgcttgccaccaacaaagtgaccatcggcatcgacgaggtgcgagacatcatcaccacttccgaacagatgccgagcactgcgccgtggcgcatcatcattatcgaagatgtcgatcgcatgctggaacgcaccaccaacgtgctgctcaaggagattgaggagccgagcgcgcacacgatttggctcttgtgcgcgccgagtgcgcaggatgtgttgccgacgattcgctcgcgcactcgcatcgtcaatcttgctgtgccttccacgcaggcagtggccgcatttctggaacaaaatggcggatttgagccgaaaatcgcggtacgtgccgcacgccttgcagaagggcatatcggcattgcgcgcttgtatgcggagaatgagcaggtgatgtctgaccgtgacgagctgattgtgggtgtgcttggattgcgtcgcgcatcggatgcggtgctgcttgccggcaatcttatcgacaatgcgaaagtgcaggccgaagcggaggtgaaggtcaaggcggcagaggcggaagctgattttcgtaggatcaatgggcttggggcgaaggatcgtattcctccgaaactgcgtggcgcgtacaatgcgatcgccaaaaaagacgagctgaagcgccagactacgcgacttacgcgtgatgtgcttgaccgtgcgttgaactcgattgccagtatttaccgtgatgtggctgtgctgcagaacaatgccgaggattcggtgggactgatcaatttggagaatcgttcatcgatcaccgaactgtcggtgcggcttacgcgtgggggagcggtgcggcggctggaggatattgccgttgcgcgtcgccgcctggccggcaatggcaatcccgtactggtctttgaagctctcttctgctccctcatcgccagctagggctagcggcgttggcacatactgttttccgagggcagattcttccagcgggtggggaaatggttgtttggctgtatgattctggcttgctatcgtgcgataactgccggcaaaattgcaaaaattgcgatttagcgctggcagttggtggattcgcggacgatgagttgcggcgcgagtgagatgtgcgcggggctgccgggggcgtcgttgagtaggcgtagcgcttcggagacgatttgtttgaacggcgggcgcacgctggtcagcgccggcatggtggtgcgtgcaatcggcgaatcgttgtagccaaccaccagcacatcttgaggcacgcgaagcccgagcgaatgcaacgccaccatcacaccgaatgcgatcgaatcgtcggcacacaccactgcctccggctgcacgagtggttcggagaacagtcgcatggcgcagtcgaaaccgcgttgcacgctacgatcgccgaacttgttccattcggcttcggtgttcaagtggtgcgcgcgcacctgcgtgtggaacatggcgaacagttccgccgattcgaaggagatttccttgccggccatgtatgccacggatgcgatgccacgttcggccaaatgcctgatcacgatttccatggcggcgttttcgtcgatgctcaccatggatgtgcgggatgagcatcgacggccgcccacctgcacaatcggcaatgtggaggcgtaatgttcaagttcctcggaaaggtaggctccccaggcgggcagtacgatcagcccgtcaacatggcggtccaccaacgattcgatgcgttggatctgcgtggcctgatcgccgccgatgccgagcagcagttgctgcgaatccacatcgatgacgggttcgatttcgtcaagcagttgcgcgcagaacgggtcggtggcggttggaatcaccagtccgatggtgttggtgacggtgctgcgcaatgcgctcgccgcataattgaccgaatagttgaggtgtgccgcggcggctctcacacgtcgtgcgatgtcgtcgtctttggtgcgttttccggaaagcacgcgggagacggtggcgatggagacgttggccagcgcggcgacgttcgtgattgaactgttcgccgaagtagccgaagccgaggcgttgtcggttgtgcgtgccatgctctcctcccaaaatcattcgaagtattggattattcgaattgctgccgtgtctcaatcgcgtattcaggaataaaacagccacccgtcgaatgcggcaggtggctgaagcaagtatcgcaatcatgcatatggaattgcgatcgcattgcgatttcgtaactgaagattgttgaatatcttgcgaaatcctcgaaaatcttcagaaaagaagatcactcggcgttgacgaggatgttcagcaggttgtctgccacggtttcgtcgtcggcgccctgcacgtcgatgaccacggaatcgccctgcttgatgcccaggcccatgatggacaggatggagcctgccggaaccgggttgccgccttccttggcgatggtgacggtgcagccggaggcggtgacggcctgggagaactgtgcggccggacgagcgtggataccgacgggatcgttgatgacggtggtgcgggttgccatgatggacactcctttgagtcgttattgttgattgttttctgttgtgttatttgaaagtcgtgctgcttgccgagtgaaatgcatcggtgcgccgctggtgattactatagcactttttccacgaaacgcagaaaacgtttactggttgtgtgttgcggtttaaagcgtgtatactgtgggcaggctgaaaatgatttaccggcaaagacggtggaaatcattgcggtaactcaacgcgcaaggcaggcgcggaaatcacaagaacacgttcggctcgcgttcctttcgcgagcaaacaacaaacgcaaacgacaaaacaaggaaacaggtcaaaggagttcacatgatcatcaagggtgttggcattggtcgcggcgttgcagtcggcccggtcatccgtatggcgcagccgctgccggaaccgtcggacgccccgcgtgcggaaggcattgccgccgaaagcgaaatcgcccgcgtggaaaagtccctcgcactggtgaacgccgacctgaaccgtcgcgccgaagaggccgccaatggtgacgaaggcgccaagcaggccgctccgattctgcaggccatcgccatgttcgcttccgatccgtcgctggccgaatccatcaaggggctgatccagcagggcaagaccgccgaacgcgcggtgctcgaaggcttcgccgcggtggaagacatgttccgcgccatcggtggatatcaggccgagcgtgccgccgatctgcatgatgtcggccagcgcgtgatcgccgaccttatgggcgctcccgcaccgggcctgccgcagagcgaaaccccgttcgtgctcgttgccgaagatctttcccccgccgacaccgcggcgctcgacatgagcaagaccctcgccatcgtcacctcgcagggcggcccgacctcgcacaccgccatcctggcccgtgcccgcggcatcgtggcggttgtttccgcagccgaagccgagaatctgaccgacggcaccaccgtggtcgtcaatgcggccaagggcgaactggtcgtcgacccgaccgaagaggagatcgccgcagccgaagccgccaagtcccgcgcggccgcagccaaggaactgcgcggcaatccgggctccaccaaggacggccacctcattccgctgctcgccaacgtgggcaagccggccgacgcagctaaggcgctggaatatggcgctgaaggcgttggtctgttccgtactgaattcctgttcatcggcaactccgagccgccgaccgtcgaagagcagacccgcgcttacaccgagctgttgagccagttcccgggcaagaaggtcgtgattcgtatgctcgatgccggcgctgacaagccgctgccgttcctcactccggaagacgagccgaatccggctctcggcctgcgcggtctgcgcaccctgcgcgcccacatggacgtgctcgaaggccagctcaaggcgctcgccgcagccgatgccgccaccgacgcgaacctgtgggtcatggccccgatggttgccgaccagcatgaggctgactatttcgtgaagcttggcaagagcttcggtctgaagttcgtgggtgcgatggctgaggtgccgtcgatcgcgcttatggctgataaggtggccgacgtggccgacttcgtgtcgatcggcaccaacgatctgacccagtacacgctggccgccgaccgtacgctcggttccgttgccaactatcagaccgcctggcatccggcggtgctgcgtgccatcaagatgatctgcgacgcgggcaacgccaagggcatgccggtgggcgtgtgcggcgaggccgctgccgatccggacttggccgtagtgctggccggtcttggcgtgaactccctgtccatgactccggtggcactcgacgacgtgcgtgcctcccttgccgaagtcaccttcgaagaggctcaggcccgtgccgaagccgccctcaacggcgacttctaccacccggccaactgagccgtactagctgtgcctatcgcctgtaacgccttgtttttcaagcgatgtgaggtctgataggccctgtttcccggaccgacccctgcccgcgtgccccacaggctcgccgcaggggtcgtttcgttatgtttcgttatgccgtcaattgaaaccttgtatgagtcagacgcttgagggatactgggtgcatgaagatttccgcagatttcaccgtcattcccgacgcgtttgccaaggcggcgccgcctgagaactgcatcgacggtacgccgattgtttccttccccttctacattgatgcgcttgatcctgcagtgcagttcctgcattgggaattcgttgatccggattcaattccggtatgcggtttccagtggaatcattggtccctcgcgaacctgcccgtggatgcgctgatgtacgatttcaacgattctcacgcgctcgcgattccggctgatttctcgcgcacggtttctgcgatgattcctgaaacggttcagggacgcacgtccgccgcctcgccgttgctgcagggccgcagcagtgatcccgcagtgacgatgcgttacaacggtccatatccgccagatcaggatcatgactactatctgcatgtgtggggtaccacggctccgctcgccggcctcaatcagggattctggctcaacgaaatggaacgtgcgctgcgtacttccggtacaatcgttgatcagggcgctattttcctcactggaaaagcctgatttgtgaaagaggatctcaagtaaggccagaaatttgatttccgcagcaatataacgatataaagatgcggaaatcagaaatatatccgacgaaaacgtattgacaataatcgaaaggattgctgaataattatggcgtgcaccacgattttggttggcaaagacgcaagttatgacggatcgaccatcatcgcccgtaatgaagatagtgcaaatggtgagttttgcccgaagcgcttcatcgtagtcaagcctgaagatcagccgcgcaagtacaagagcgtgctttcgcatgttgaaatcgatcttcctgacaatccgctgcagtatacggctgtgccgaatgccgatctgaaggaaggcatttggggcgaagctggcgtgaacgaagcgaacgttgccatgagcgccaccgaaacgctcaccaccaatgagcgtgtgctcggtgccgatccgttcgtggaactcacgccggccaaaggcaaggaaggcgaagagggctatgagccggaagtcgccggtggcattggcgaagaggatttccttactctcgtgctgccgtacgtcaccaccgcccgtgagggtgtggaacgtttgggcgctctgcttgaggagtatggcacgtatgagatgaacggcgttgctttctccgacgtcgacgagatctggtggctggaaaccgttggcggccatcattggatcgccaagcgtgtgccggacgaagcgtatgtgaccatgccgaaccagctgggcattgacgaatttgatcttgaagatgcgtttggcgagcaggaggaccacatgtgctccgccgatctgaccgagttcatcgaacgcaaccatcttgacctgtcggtggagaattccactccgttcaacccgcgtgacgcgttcggctcccactccgattccgaccacgtgtacaacactccgcgtgcctggtacatgcagcgtttccttaacccgtacgacgagcagtgggatggtcaggatgccgatcataagccggtttccgacgatattccgtgggctcgccagccggaacgcaaaatcaccatcgaagatgtgaagtatgtgctgagctcccactatcagggcactccgtacgatccgtatggaaagcttggcgaccagcgcacccgccacatgttccgcccgatcggcatcaaccgtcagagccagcttgcggtgatgcagatccgcccgtaccgcccgcaggtgagccgtgcgatccagtggatcgcctatggttccaatccgttcaacacgctcgtgccgttcttcccgaacgtcaactccacgccgaagtatttggaagacaccaccacgcgcgtcacgtccgaaaacttctattgggagaaccgcatcatcgcggccctgtgcgattccagcttcgccgacaccgccaacgccgtggaacgctatcaggagaagactggcgcgatgggccaccgcatggttgcctctaccgacgagcagatcgaacgtttggtgggtgacgtgaccgacgaattcgatgcggaagacgaaatcggcgatgttcagcctatggaaccggatgaaatcatcgaagccgtgcgcaacggcgaagcccgtgaaatccttgccgcagccaacgagaccatggccgcgcagctcaaggaggaaaccgacaagcttcttgattccgtgctgtacaccgccagcatgaacatgaagaacggcttccacatgtcggacttctaaaatctcactattcggctctcgtgaccacgttgcgggagccaattattttccgcaatacaacatcgttagaatggcgtgcattccaatttgaagaaaggaaaccccagtgaccagcattgaggatttcaccagccagtacggcttggtgcagaagattgatgcgttcggctatctcgattatttgaagaatgatccggatgctccacgcaagcatggcaaggtcgtgctcgtcaccgccgatactccgctgaaggcgtctcgcggcgagggcaagaccaccaccacgatcgcgctgatcgacgcgttgcgtgagcgtggcattgatgcggccgcagtgctccgtcagccgagcatgggcattaccgctgccggttccaagggcggcgcttcgggcggcggcaaggcttccctgacccaccctgagctgatcgactggggtctgtgcggcgaaatgggcgctatcgaagcggcccagaacctgctggtttccttcgctgagaaggccatcgacgacggcaagctcgacgatatcgccgtgccgcgcgtttccgaagtgccgtcccgttcgctgcgtcagatcgcggtggaccgcggcaagggcaatgtggccgagcgtgtggtgctcactccgacctgcgagctcatgcagatcgtggtgctctcccgttccatggatgagatcgccgagcgcgttgccaagatgattgccggcacgaaggacggcaaggccgttacgttcggtgaattcgttgatttgtggcgtattaccggcattctttccgatgcggtgaagccggcgaagacggaaacggtgaatggttctcccgtgtatgtgcacggcggtccgttcgcgaacgtgtcgatcggcattccgacgctggtttccgtggaaatggcgtgcgccctgcatgatgtggtgatcgtcgaggccggttacggtgctgacgcgggcgctcagaagtggcttgacattgcttgccgcgagtatggcgcacagtggccgtccgccgcgattgtggtgacccgcgcttccacttggcgtgacgatccggcgcttgcctggcgttacccgttccacgtgcagcgtttggaaggtcttgatattcctacgttcccgctgattaacctgtgggatggcgaagacgatcaaattccggcgttgcagcagaccgccaaggatctggagttccgcgagccgattatcggcaacctgtatcgcgatggtggcgatgcgctcgccccgcagcttgacgcgttcgttgacgcggtggtgaatggttccatgccggccacgccgcacagccacaagggtatggctctggtggagaacgtgcgttgggttgccgaaaatgcgtatggtgttccggcagatcgcgtgatcctgaaggacggttttgctgaatcgcttaataaggcggtggacctgtgcgccagcgccggtattgatttcggttcgcttgcactggttgcggtgaagtctccggccacgatgactgacaacgattccgctccggctgaagagcgtacggtgacgttgaagaaggttgaagtgcattccggtgccggtttggtgcatgtgaatctcaccgtttcgctgaccacgccgatgccgaagatcgtgtgataaacgagtcgtagcgttctgatcgcaacattttagggcggtcacttgcgtatatgcgtaggtgaccgcctttttgcaccttaatttcggcggtttctagcgaacgtcgcaacgccatgacctcgaaggaacggaggtaacttcgtcagaagttgccgccccgaaccgtgaggcgggaaacacggtgtgtttccccgtaggtgaggtgagaggttcgcaatatgggcgaacctcgaaggaacggtggaaacttcgtcagaagttgccgccccgaaccgtgaggcgggaaacacggtgtgtttccccgtaggtgaggtgagaggttcgcaatatgggcgaacctcgaaggaacggtggaaacttcgtcagaagttgccgccgttccagccccagtcggtggtggcggtgtagcggatgtacgtgcggtcggccggaatgcccagttccttctccaacgcggccatgatctgctcggtcagcttctcccaagcagaaccgggcacggaacgaccgaacacgttcacctcgacgtatgcggccggcttggaatcgtcaccgccgaaataaatcggcatattgtcttcaaacgggcacatcagccagccttcagacttgccgggaacggcggtgatcgccttgccgtatgcggacttcagcgcctcgcgctgctcggcggtggtggaaacggaaacatgagtgtggatgactggcatgatgctctccttaaattgttggaatcagcctttgcggttcacctccagtctaggcgtcgaacggcgcagtcggggtggctgtgtgagaaattttgggctttgcctgaacggctgccaaggtggtctgcgtgcgcgtgttaaatattcgttgtgagaaaactgattgaacagcttatgaaatttggcctcgttggcgtgatcgccttcattatcgactggggcattctgaatcttctcgtcggcgtattccgcatgcacaacgtgctcgccgcaaccatctcgttcattatttccctgattttcaactacattgccagcatgaaactggtgttcaagcaccgtgacgacatggcccgctggatggaaatcctcattttcgtgattggcgcgctgatcggcctgttcatgaacgacgccattatctggatctccacgtatggcatgaaccatgatgcctacgtgtcgcagagcaccgaatacctgatccgcaccaacgtcggcaagctcatcgccaccgccgtggtgatggtgtggaacttcctgacacgcaaatggttgctcgacgatacgcacaccaacgccatgaaccgtttgcgcaaagccgacaaccgcctcacgccggaagagctggaagccaagtggcagaacagcttctcgcacaagcttggcatatggtcgctggaacacactcccaacggttggcccaagtagtcctgaattcggaaaatctgcctgcacaacccggaaatctgccctgatcaaatctgccctgattcccgactcgcgcagacggccggacagtcctgaatatgaaaaggcggtgcttacacctataaaggtataagcaccgccttttcgtatgctctgcatgctttacgtgcgaaaggtcacacgcttacggtggtaagcatgggctgctcggtggagtccttgatctgcttgaagccgaacagggcgatcgccagcgaggtgagcgccagagccgtcactacaatgaaaccaccgtgtgatcccatacggtcgatgaactggccggcaatcgccgagccgacggaaccgccgattgagttcatcgcacccatccaggccatgccttcggtgaagcgtgtgggcggcaccaagtgcagcatcagctggttgccgttcacccacgtcggtgcctggcatacgccgatgaacaggtagatgatcatgatcacccacagatgtttggcgaacatgaacgagccgatgcctagatcgaccacggcaaggcagaagtagaaacgcttccacagcggaatagtccaattctttgcgccatacacgagcgcgccgatcagcgagctgaacgagaagcaggcgaacacgaaaccggtgtactgcttcatattcgcttccgtggcgaacgcgacgatcgaaatgctggcggccgactggaacgcgcccaaaccgaaccacgtcacgcatacggcgattaggcccggcccccaaatcgattccttgcgcccggcattcacatcggcggcggcctgatccatggcggcctgcacttccgcagccgttttgccttcggaacgtgcgcgatcgcgagcgtactcaatggccgcttccgcctgcaacgccttggaacgggcggcttcgcgctcacggtattccttgcgggtcatgcccgcttcgcgagccagctgcgtctgcgatttcggctcggtggaaagttcggtgaggaacatgagcgcgccgaccaccacacacacgccagtgaatgagaatgccaacagcccggaaatcacggccagtgtggaggcgagcggattgccgatcacccacatgcattcgtcgaacacgccggaaagcgaaagcgcgcggttggttttctccgtgtcacctttaagcagcgtggtccaacgctgacggctcatcgcgccccacggcggaatcgccgccatgaacggtacgatacagaacagaatccacgacggcactcgggcggtgatacaggaaaccagtgcggtcgccgcaatcatccacacgatgattgtcggaatcgacacctgacgctggccgaacttgtcaaccagcttgccgagcaccgggctcgcaacggccagcgcgatcgcctgcacggccgtcagcgcgcctgccagcgaataattgccgtaataatgctgcacggaaatcgtaatcgtcatgccgaccatcgggaacggcatgcatgcgatcactgaaccgaccgaaaatcgggcggtgtgcggtatgcgaagaagctccgcgtaccctccgaaaagatgttggccgatgcttttggcgccggcgaggactgaattggtcatgttttgccgctcctttctgctcacggttggtgcttgcgtccgctgcgttgcgttgccgcggaccgcttgatataccctcgttctgtcttgattgtttgctctccagccccagtctctcacttcaaccttgcttgaacgtcaatcgattgacgttcaagcgtgttgcatagggggtggagactggttgtgtgccattttcttgaactagacaactttatgcggaggtactgtcgcaacacgcggtgcattgaggttggcagacataattcgattggctattttgtaagtactcaccacacgttcacttggtggacgaaaagatgtccggcgggcgaaagacggttgttgcaaaatggttgcgcaacgcttccaaagcttgcgattgcagaattttcgttccatcggtcaacgtcagcagtccggcagcatcttgcggaaaggcggtagggatgcccgcaacaaccatccatttcgtacgtcacggcaaagtcgaaaatccagggcatttgctctacgaacgactgcccggattccacctgtcggaagtgggtgtgcgcatggcgcaggcgaccgcgcactacattgccgtcaatccacgactcaacacagtttccgccatctactcgtcgccgctggaacgcacgcgcgaaacggccggcgaaatcctcaccgcactcaacgaagtgcgtgaaacccgtggcgaggagccgctgaaactcaccaccgacgagcgcatcatcgaagcgcgcaacgaattccgcggcacgcgcatcggctacggcgaaggcgcactctggaaaaacggcaactggaagctggtacgcaacctgtggaagccaagctggggtgaaagctaccagtcgatcgcgcatcgtgtgcaagcgttcgccctcgaaaaagtgggggagcatcccggcgagcaaatcatcgtagtcagccatgaatcgcccatctggagctacaggcacatgctggaaaccgggcacccggaacataatatgctgctacgccatacggcactcgcctccatcacttccattacgtacgattgcgatacacgcaaagtattgtcgatcgcttacgtcgatcccgcggccgacgtgaaatagcgcataatgcggcatggaatcgccggattggaaacttttgaccgagacacgcgacaatgagtgcggcggttgttgaaagaacggggattccatgcaatcatggaagggctggatgctgttgggtccagtgaggaaaacaaaatgtcgaagctgcaaaggggcacgcatggctttcactatcaacaacggagcgctttatcaattattcgataggcctcatatgaaaattgccatcgaaagctgtgttggagtggtggaattatggccgctgcaaaccgttcaggagatggagaatgacgcaaagtacacggaagatctgcaagtaagattctcctgcaccatggcaagggcaatgctgcgattgtcccacgggattaacccgtccgtggcggaagccgtgtacgagggaatggacgagattccgggttgcgatccggaaattgtgcaagcgctcacgcgggccaatcaggcatacgatgtgatgcgcaattattccgaaaccaacaatgccgacctgttcttcgaagcggccgacattctgggcatcttcatcgacgcccatgtcgagacggaagtccgcaatatactgcaaaagatcgtggagtacattcggcagagcgtcagcctgggcttcgacggcggagcgctggaagatgtcaactactgctacgctttcaccacgaccccaaggacgctcaccgggcgattcctcgcggcgctcgcggtgggtgacggtctgatgaatctcatgtgcgaaggcattgacgatgtggacgaacagaccgtgcgcgtgctgccggtgatgctgtacatcaacgagttgtgcgagcagatggctgttccgccgatctatgtcggcgacgtgaccttgtctcgaatggttgcgctgcgtaatgctgtgcgtgaggcgggcagggcaacgccactcgaggagaattccttctgcgacaacacattcaccataaccgcggacaatgtcattccgtgcgcgggcatggagtgggatcatcatgcggagtgcctgcgttgggatccgaagagggccgagcaggaagccaaagatgaggatgaacgtaagagcaaggaagcgctcgctgaaaagttcaatttgatgacggacgctatgaaaagtatgagctacatggatgattccgatgattctggtgattcaggcgaaggtgcggatgctgcgtgacgtgggcaatccgagataatccgaattagtgggaattatcgatataggaataagaaaatcccggcacttgcgattgcggtgccgggattttctttatgtagtactgattattgcaagttcggttcttaagttcagtgctgaacaggcatatttcgtcagtgctgtatgttgccgtacgcggtaggatcgtcggaatcgtcggaatcgtcggatccgtacggggtctggccctgcgaatcgttgccgaacgtggggcgatcgaactgcgtctggtcaagctgggtggactgttccggaaccgtaggcagcggaggcatgctcggcatggaaggggcttcgggtgccggggctgcatgcggagttgccggggcggccggagtgtactgggcggctggagcggctggcatcgcaggtgctgcgtactgatcggtcggagttccgtaaggagcgccatacgggttgccgtacggagtgttggtggctgccggggctggggtcggagcgccatacgggtctgcggtgggcattgccggagtcggcgcaggcattgcaggtgccggagcggctgccgtatacggatcagcggttggcgtcggaacagccgctgcgtacgggtcggcgaccggtgccggagtgccgttcggggcgtattgtgcggttgcggtcggtggcatgcccggggctggggcgtagccgttgccggctgccggatcgtcgaagcgtgcgccggctggatcggtcttcttggccatgagcacaatgagcacgatcgacgtggccaggcatgcgatgaaaccgatgatcaacaggagtatgccggctacgccagtcgagctcgatccgccaccgattacggaaatggcgccaagtcccgtcatgacgaggccgacgctcagcagaacgccaccgatgaagtcaatcgcgtagaggatgaccagcgtggtgccggccttgttggtgtcgtgcaggcggcgaacggaaagcgcaagggatggaacaatcgttgccagtgcccaaatggtgttgacgaagcttcgcattccattggctgtattgctgtcgatgatggcgcccaacaccgcgaagatgacggcaaacgcgatctggatgatgaatgtgcacagaacccaccaccagaattcgccgcgggaggcgcggcccttgaacgtggcgtactttttccagaagcggatgaacgcctcgccgatggtgcagttgtaggccggctggtcgagcggagcggtcagtgcgaagaagctgccggacccctgtggctgaggttgcggtgcgccgtattgcggctgctgctggttgtatccggccgcattgccgtattgcggtgcgctgtattgaggcgcgccatactgcggtgcctgctggccgtaatcattctgaccgtaggagccgtaaccgccatattgctgggcctgctgcgggttctgcggattatattggttggggtccgtcattagattaccctttcggaaagtgaatcgacatcaaaaaagtgaagtcgattaacacaatactcttgcatcgccaaaaataccgaaaaatattgcagtgtgggacaatcccgacagaccccgcaaaaatcccctttgacgtggggcatcttctgacgcgttggggaagtccgtcgatggcgcggctcatgcccagcatggtgttgtaaggattggtggctgcgatcatcgggtcaattagctgcaggatgttcatgaccgcgaaaagcgagttggtgcgtgggactggatggcacgtccggtttgcggggcacaatggagcttatgactgaagctgaaaacaccaaaccagaacttcctgagcatgttcgcgtgcgtttctgcccgtccccgaccggcattccgcacgtcggcatggtccgcaccgcactgttcaactgggctgaggcccgccataccaagggcacgttcgtgttccgtattgaagatacggacgcccagcgcgactccgaggaaagctacaaccagatcatcgaagccctgaattggctgggcatcgactgggacgagggcatcaacgtgggtggccccgacggcccgtaccgccagtccgagcgtggcgacatctacaaggatgtcgcagccaagctgcttgaagccggctatgcatacgaatccttctccactccggaagaaatcgaagcccgcaacgtggccgccggccgcccgaaggctttcggttacgacggctacgaccgtgatctcaccgaagagcagaaggccgccttccgtgccgaaggccgcaagcctgccctgcgtatccgcatgcccgatgaggatgtcgcgttcgacgatctgatccgtggccgcatcgagttcaaggctggttccgtgccggattacgtaatcgtgcgcccgaacggcgatccgctgtacacgttgaccaacccggtcgacgacgccatgatgaacatcaacgtggtgctgcgcggcgaggacctgctgagctccaccccgcgtcagatcgtgctctaccgttacctgatcgagctgggcgtggccaaggaaatgccgctgttcggccacatgccgtacgtgatgggccagggcaacaagaagctttccaagcgtgacccggaatccaatctgttcctgcatcgcgacaacggtttcattcgcgaaggcctgctgaactacctggcgctgctgggttggtccatcgccgccgaccgcgacgtgttctccatggaagaaatgatcgaaaagttcgacgtgcgtgacgtcaaggccaatccggcccgtttcgacctcgacaaggccatttccatcaacgccgagcacatccgtatgcttgagccgcaggacttcctgaaccgtgccgtgccgtacctgaaccgcgatggcgtggtctccgccgattcctgggatgcgctgaccgatcgcgagcgtgaggtgctgtccgcttccgtggagctcgtgcagccgcgcgtgcgcctgctgggcgaggtcgccggcatggtgggctcgctgctctccaccgagggctacatcgagcctgatgatgacgccaagaagcagttgaaggattccgctccggcagtgctcgacgccgccattgcggcgctttccgacgttgctgaagatgattggaagaccgacttcctgcatgagacactgaacaagtcgctgatcgaagatggcggttacaagccgcgtctggcgttcggtccggtgcgtgtggccatgagcggccgtcgcgtgtctccgccactgttcgaatccatggagattgttggcaaggagatcaccgtcgcacgcttgcagggcttgcgcgagcacctgtgatgcgctgatggtgtgattttgccgatcgcatgactgtcgacccgctggaatgttccgttccagcgggtttgttgttctgggatgctgtttaagaatggcggaaaatggcgcgacacgccgtgacttgcgcactcctacggattcgcgtatatttatcactcgttgcggttcgcggctcagctgagaatcacagcaataactcaagcccccgtcgtctagcggtctaggactacgccctctcacggcgccaacaccggttcaaatccggtcgggggtacgacggacaacttttcgaagttgccacgcctgccaaattgggatgtggtgtaattggcaacacagctgattctggttcagccattcttggttcgagtccaggcatcccagccaatgaccctcgcagatgcgagggttttttgtttttcgcaagcatgtctgccagtacaacatagtccaagaaaattgcactaccctaggaagcatgactgaattgcagaacgcagcaaaagccgccgccacgcgaccgcgcatccaaccggcggaagaaggcgacgatcgcccgctttccgtatccgcgcgactgggacgattgcaattccaccaatccggcaaattccgcgttctgcagcttgccgacattcaagacgggccgaaagtcagcaaagacaccgtcaaactcatcgaagcgtcactggatgccacaaggccggatatcgtcatcttcaccggcaatcagatcgcaggatatgatcccgcatacgcgcaaaccacgcgcaaacgtcgttggagcgctgccgcggggatttcctccaaaaccgcttcatccaagtcttccgaagcgtcagaacggttcgaagctgcgctggaacgcacctgcgcatccgtgcgcgccactgtcgaacagctcgtgcgtccgcttgccgatcgcggcattccgtgggcggtgacattcggcaaccacgattttcaatgcgggctcagcaatgcggaaatcgaaagcatttgcagggaatttcccggatgcgtgaaccctgagcctacgggaggcgagagcggcctcgggggcgcaaattctgcaaattctgtgggaagcatggattctgcggaagatgcaggtttcgtgcaactccgggcggaatcgtatttgccgaatcagcgcgtattcgcttgcgagccgggcaccttcgcattgccggttgccgatgtggaccatacgatgtccgtgctgggcttggtattgctggattcaggcgattacgcacgttccggcgggtacggaagcccgtccgcggaggcgttgcgatttcttgccgaagtgccggaaatgatggccacgcaatctcagaaacaggcaggatcgcacgaaaccgcgcaatcgcaggaaaaggcagtgccgtgcatggtatttcagcattttccggtgcaacagtattaccaactgttgaagccgactgcggcgaatgcggcgcgtgcgattgaaggctaccgcaatttcgctggaaaacattacgttttggatgaggaaaaaacgcttcccggcagttatctgggggagggtgtcagctgcccggatgccgacagcggtgaattcgcgatattggaacagcatgactattttgcgatttccgcggggcatgatcaccgcaacgcattcgttggaacagtgccggtttcgcgagaaatggcctcggctgatgcgcagacggcggcttcgccaggcaaggttggcggtctgacgatgatcgcgtcgcccaccagcggtttcggatcgtatggtccggtgccgcagaagcgggccgcgcggctgatcgagttcgacatccgccatccgtacgagccgcgtacgcagctgcttgaatacggcgaattagtgggcaaaccgagcgcgggcaaggcgtacgcgtacggcatgaccagtgaatcgaagcccgaatccgaaggcgtggatctgctgcatcggccgacatggtggagcaaactgttgacttggctgcgtaagaagtagctgaaaagagcgaaatgacaaatcctgcaaggaaatggcaaaacttgcggaaggcaggaaatagcaaaaccgtgtcctgcatgcatcgcggaacacggttgagaggctgtatattgcccgtcagcgaccggaagaagccttaatcaaggcgtcggtcaaatacttgccggcagccataaccagcggggcgtaacggcgtccgggattggaccccatacgaccgtccgggccggaaatcgaaattgcggcaatcacctgaccggaagcattgcgaatcggcgcggaaatcgagcatacgccctcatcgcgctcgttgaccgactcggcccaaccgcgcttgcgcacggcggtaagcttggccgcggtgaacttggcgtgacgcaacccctgatgcaggcgttcggaatcctcccaagccagcaaaatctgggccgcggaaccggcctccatcgacagcatcgcaccgaccggaatggaatcacgcaaaccggaagcgcgctccacggcggcgatgcacacgcgcatatcgccctgacggcggtaaatctgcgcggattcgccagtgcgatccagcaacgtctgcaaaatcggcgcggctgcggtcagcaaacgatcctcgccggcagcagcggccaattccgcaaaacgcgagccaagcacgaaacgaccatgctgatcacgcaacacaaaacggtgacgctccaacgcaatcgccagtcgatgcgcggtcggtcgggccaagcccgtcgaggaaaccagctgtccgagcgttgccggaccggattcaagcgcgtcaaggattttgacggtcttgtcaagcacacccacaccggaatgaatctcattgctttgagaagacgtcgtgtggtgggtctcagctggaagctcagtctcatccgactgcgattcaggcatggtggtgcttgtattcgaagaagtcataagagggattatgccatctcacatattgaaatgcaaaatgtacgcaatgtcggactgcggtagagcaggtattttaatctttactcagttatggaaaaagctggaaaaaaatctgaattttcaacgattttgtaggtacatacggggagatatgccacaatcgcggcgattttgacatgatctggagtgaacttggcgcatatgtgatgtgtgcgttgcatgcaagtatctcatataccggcataaacgcgttcgaaccaggctcgaacaccataggcttatagcacgaacaacgcgggttggcaataccgcgaggaaaaagcgaggaaaaattcgaggaggtcccacaatgggaacgacattggccgagaaggtctgggccgatcatttggtacgcaagggtagcgatggggctcccgacttgctgtacattgatctgatgctcatgcacgaagtcaccagtccgcaggcgttcgaaggcttgcgactggccggacgcaagccacgtcaccttgaccagctgatcgcaacggaagatcacaacacgccgactgccgacatcgaccgcccgaatccggataagatctccgcgctgcagctaagcacgctcgaaaagaactgcaaggatttcggcgtacgtctgtgcccgctgggagacgccgatcagggcgtggtgcacgcgttcgcgccggtgctgggcctgacgcagccgggcatgacgatcgtgtgcggtgactcgcacacctccacgcacggcgcgttcggtgccatggccatcggcatcggcacctccgaagtcgaacatgttatggcaacgcagaccctgagcctgaagccgttcaagaccatggccgtgaatatcgaaggtgaactgccgaagggcgtcaccgcaaaagacattattcttgcgattatcgcgaagatcggcaccggtggcggccaagggcacgtcattgaatatcgtggtgaggccatcaagaaactgtcgatggacgcacgcatgaccatctgcaacatgtcgatcgaagcgggcgctcgcgccggcatgatcgcgccggacgaagtgacgttcgaatatctgaagggacgcccgcacgcgccggaaggtgaaatgtgggacaaggccatcgaatactggaagacgctgaaaaccgatgacgacgccgtattcgacaaggaagtgaccatcaaggccgaagatctcgagccgtatgtgacgtggggcaccaacccgggtcagggcatcaagatttccggcgtggtgccggatccggcttcgttcaacgatgaaaccgagcgcaccgcggccgagcgtgccattgcctacatgggcttgacgccgggcatgcgcatcaaagacattgccgtggataccgtgttcatcggctcctgcaccaacggacgtctcgaggatctgcgtgtggccgcttccattatgaaggggcatcacaaggccgaaaacattcaccgcgtgctcgtggtgccggcctcctctcgcgtgcgtttgcaggcggaaaaggaaggacttgacaagatcttcaaggacttcggtgccgaatggcgtaacgcaggctgctccatgtgcctgggcatgaaccccgacaagatggtggcccgcgaacgttccatctccacttcgaaccgcaatttcgaaggtcgacagggcaaggggtcgcgtacgcatctggcgtcgccggcggtcgccgccgcaacggccatccgcggtaccatctcgtctccggctgatctgtgaatcgttgagaatgcttgaaaacctgagaaatcttggatttccggcattctgtgaatcgttacatcgaaagaaatagtgaaatggaaaaactgactactcttaccggcgtggccgtgccgcttcgccgttccaatgtcgatactgaccagattattccagccgtgttcttgaagcgcgtgcagaagtccggtttcgacgacgcgctgttctatgcgtggcgtcgcgatccggaattcgtgctcaaccagccggaatacaagcggggcaagattctcgttgccggaccggatttcggtatcggatcttctcgtgaacatgccgtgtgggcattgcatgattacggcttccgcgtggtgatttcgtctcgtttcgccgacattttctacggcaacaccgcgaagaacggcgtgctggctgcgattatgccgcaggagtccgttgagttgctgtggaagctgcttgacgaggagccgggccgtgatatgacggtgagcctggaggatcgcacggtgacgtgcggcgacgtgacgctgccgttcgaagtgaacgactatacccgttggcgcctgatgaacggctatgacgatatcgatctgacgttgcagtatgaagacgatattgtgacatacgagaagatgcgtgccgaaaagttcccgttcaagccgaagacgctgccggcgaagcgtgagccggagcagttgatcgcgtccgcgcgcgaaggcgaatacccggattggcagggcccgcttgccgatcgcggcatcatctgagttggcgtctggctaggtgcgcgggctgtttgcggggtgattcctccagtgggtggaaggaacaccccgcttgcgttgttgcgcgggctgtttgcgggaggatttttccagtgggtggaagaattgggacgtcgggatgattgtttgcgggaggattcttccagtgactggaaggattgggatgttatgtgatgcgtgagcgggaggattcttccagtaggtggatgtttttggactttgagacggtccgtagcggggtgattcctccactgggtggaggttttgggacgattaggggactcatattgtccggattcttccagtgactggaaggattgggacgttgggattgctgattatgtgagatttgcgcgggttttgcatatgagacgcgctatggtgggcttattgtttcgtgctttcgtagctttcggagagaaaaatgagccagggttttgcgccgttttatgatgtcaatcgcacgtatgaagacaactatttgcaagggccgttcggcgcgtttgccgaagtgttgcgggctgatgcgtccgattctgcgggatcggtcacgtctgttgttgctgaggttgcgtccgattcctccagtgaggttcagggcgttcagaccattcaggccgctcaagcgcaggaattccttggttttcgtgtgaatctgccgttcggtattccagctggtccgctgctgaatgagcgtttcaccacggccgctttccgtatgggcttcgatctggcggtatacaagacggttcgttcccgcgcatggggctgcaatgcgttcccgaacgtgctggccgtgcatccgcggaatgccgatggttcgctggttccgggcagtgccgaacttgacgagggtgtgcttgccgatacccgttatgagcttccgatttcgatttccaacagtttcggcgttccctcccgtgatcccgacgaatggcagccggacatgcagaaggcaatcgccgcagccggtgacggccagctgctggtgccgagcttccaaggctcccgcgtggagggcatggatcgtgaagcgtatatcgccgatcatgtcaccaccgcgcatttggttgccgaaactggcgctggcctgatggaaatgaacaccagctgcccgaatgagggacataatcgtctgttgtgccacgatccgcatttggtcggcgagattacggaagcggtgaagaacgaaatcggcgatcgtccgctgatcgtgaagctcgcatacattccgaatgatgccgatctggaaattatggtgaaggaaaccgccggccatggcgcggtgcagggtttctccaccattaacacaatctccgcgaagctggtggatgcgaacggcaatcaggcattgccaggcgcggggcgtgaccgttcgggcgtatgtggcaatgcgattcgtggtgcaggtctcgatatggttggccgcctgaatgcgattcgcgagaagctgggtcttgattttgcgatcgttggcgtgggcggtgtgattcgtccggaagattacaaggcgtaccgcgaggctggtgcaaacgcggtgatgagcgctacgggtgccatgtggaacgcccgtttggcgcaagacattaaagccgcactgtagtcacaggttcaattgcgcctgatttgcgctctgttgcgtttcaccgtcctttttttcccattcgctggaaggattagtgcagcacgggggtagctgtccgtcctgattcttccagtgactggagggttttgcccgctgagatgcagtttggtgggatgattcttccagtgactggaggtttttggacggtggaggggcttgtatcgggaggattcttccaccgactggaagtttttgcccgctgggatgcggtttggcgggtggattgttccagtggctgggaattttggtcgaaagtcgaacgaaattgggagacactgcgctgaacgcggcatttcacgagcccactacatgccttatggcaaactgagggttagtgtgtttcaagcttgaaccgtataagggaagcgaaagaggttgagcgtgtctgacaacaacaacgacattctgcacgtcgaaggtggcaagccgctgaacggcaccatcaaggtgcgtggcgcgaagaacttcgtgagcaaggccatggtggcggcgctgctcgccccgggtacgtccgtgttgaagaatgttccggagattcgcgacgtgcatgtggtctccgacttgctgcgtctgcatggcgtggacgttacggtggatggcgatcacggcgtggtcacgatcgacgccacgaatgtgcagcttgccgatgtggccgacgtggatacgctgtctggttcgtcgcgtattccgattctgttctccggcccgctgctgcaccgtttgggtgaggcgttcattccggctctcggcggatgcaatattggcggtcgtccgattgatttccacctggaaacgttgcgcaagttgggtgccaacgtcgataaggaacataaggacggcattcatatcaccgctccgaacggtttgcatggcgcgaagattcacctgccgtacccgtcggtgggcgctaccgagcagacgttgcttgccgccgtgcttgctgagggcaagacggagctttccggcgctgccaccgaacctgaaatcatggatttggtgtgcgtgctgcagaagatgggcgcgatcatttccgtggatgtggaccgtacgttccgcatcgagggtgtgaaggagctgaagggctatacgcacacttcgctgaccgaccgcatcgaggccgcttcctgggcttccgcggcattggccacgcatggcgacattttcgtcaagggtgctacgcagcctgaaatgatgacgttcctgaacgtgttccgcaagattggtggtgagttcgacattaccgataacggcattcgtttctggcatccgggcggcgatttgaagccggtcgcgatcgaaaccgacgtgcatccgggcttcatgactgactggcagcagccgttggtagtggcgttgacgcaggcgaagggcctgtcgatcgtgcatgaaacggtgtatgagaatcgtttcggtttcacgaagccactggtgcagatgggtgccacgattcagctgtatcgcgaatgcctcggatcgctgccatgccgtttccagcagcgcaattacaagcattccgcggttattttcggaccgaccccgctgaccggccgcgatattgacgtgccggatctgcgtggcggcttcagccatctgattgccgcgttggcggcaaagggcccgtccaatgtgcagggcatttcgctgattgaccgcggttatgccgatttccgtggcaagctcgaagctctcggcgcagatttcgactgatttgttgcttgatttatcgctgatatagcttgattggcttggtaaggccggtgttcacaacagtgggcaccggctttttgcttacatattgccgttgctcgttctcaaaaacttagtaattcagtgtataaattattgaacttaatttagggggttatggcgcataatagtgatgcaaaaagttttattgtttttgaaaataatgtcgattttcggcagagattctttcggaatggcattatgattgtcgatatcgaatggcgtttgcaacgaggtgaacagccgaagatataagggtttccctcatcgttattgtgtttactgcatgtccagacggattctagggatagtcgcaacatcttcgtcgtcaatcgtcctccagcctatccaccagttccgcctttttcgtatattccgtgtttttgtatttcgtgtgtgcgtcgtgcatgagcgcaatcgttccaaccaagcggaatgggtggtggcagaatggaacgcatggcatccaaaggaaaaccctcgccgcgttccgcggtcaaaccgttaagcgacgaacaagtcgcaaagctcgcacagcgtcaccatctcgttgacccaacccacgactttccatgcgggccgcgcaaagccaatgaagccgaaatcgcggcgcagaatccgaaagcgacccatcgtctgctcaccggatgcgacatcgtattccgcaaccgcaccaaactcaaggcgtggggcatcgaacacgtgccggaaaccggtccgttcatcaccgcggccacgcacgtcaccatgtttgacgtgttcgtgcccatgatctccatgttccatcaaggccgccgtccgcgctacatggccaaagccgaaatggcctcgtggccgctgatcggcaaatggttccaactggtaggcatgcagcccgtgcaacgccgttcgggcaaggcgaaagccatcgaggaaacctccgtggaaatccttacctccggccgacccctaaccgtatggccggaaggcacggtaacgcgcgatccgcagaaatggccgatgagcatgaaaaacggcgtgggcatgatcgcgcttgaggcttcgcgccgactcggctaccagattccgctgtattgcgcggtaacgtggggcgcggcaagcatcaaccattggtggccgtggccgcgtaaaaacgtggtcatgtgctacgacgaggcgcttgattatgcggatctgctcgccgattgcgattcctggggtgaggaagtgccggaggatctcgccaacgaacttacccgacgcatccgcgtgcgtatgaccgaagtcatggccgaaatccgcggcgaacaagcccccgatggatattgggattatcgtacgatgagccgagtgaaggactgaatcgaagaaggccgaatcgaaaaagaccgcacacgcgattgctgaaatgcggtaatcgaaatactgccagccgattgcgcatacgtatggcgcgtattgcggcatatatcgcggtgtgcgtagccggcggtagcataggaaaagcaatttttgagccaagactccgggttatgaatgatgcccggagtaatgcaaggagcaaatatgacgaacgtgacggtactgggcgcaggagcttggggaaccgctttcggtcaggtgcttgccgatgcaggcaacaatgtgactatgtgggccatcgaaccggagattgtggaaggcattcgcgaccaccatcacaacggtgttcgcctgcccagcgtgaaagtgctgccaagcaacatgaccgccaccggcgaccgtgccgaagccgtagccaacgccgacattgtgatcgtggccatcgccgcacagttcgcccgcgtcgcgctcgtcgaattcaaggacctgattcccgaaaccgcactcgtcgcctcgctgatgaaaggcatcgaacgcaccaccggcaagcgcatggatgaagtcgttatggaaacgcttgacctgccggccgaccgcttcgccgcgatttccggaccgaacctgagcaagcagatcgctgaccgcgagccggccgcaaccgtggtcgcctgcgaaaatctcgacaatgcgcgcaagatcgcagccgcttgcaccaccgactatttccgtgcgttcgtaacccgcgacgtgatcggcttggaaatgtgtggatcgctgaagaatgtggtcgcgctggccgtgggcatggcccgcggcgccggctacggcgaaaataccgccgccatgatcgaaacccgtggcctggccgaactgaccgccctgggcgaggcggcaggcgccgatccgaagacgttcgccggtttggctggcgtgggcgacctgatcgccacctgcggatccccgttgagccgcaactacacgttcggatccaacttgggcaagggattgagcgttgaggaagccaccaaggtgagcaacggcgtggccgaaggcgtgccgaccaccgatgcggtggtggcgctcggcaagcagtacggcgtgcccacgccgctcgccacggccatgagccacgtgctttccgatggcatctcctgcgcgcagatgctgtccgaacttttcggcgaaggcatcagcgaagaataagctttccgcaacatcgcgattgcagataagaccgcactttcaggtgcggtctttttatttttcgaggcatgcgattgcgtaaaacgtcaatcggaatgtgtcaatcgtcaatcgccatatatttcggcaataatagtaaatctgtataaaaatagtctaatcgtgattagacaaagcgattaagctcggttttttcaggttgcaatcgcatcattccaacgtttgattccgtattctatgattcatgaaaataggacatgagtgacgggcgtgtgtaattatggttcgtcgtgtgtgggctgtggggtgcggtttgtatactgaactgcgatattgcgaatgcgtggtatcgcgggcgaacagaagtgcgaaccggcgcgatattgcgaagacagacagtacagacagtattggcagacggtattgggcgcgcgtgcgttcaacggaccaactgatggagcataagacaaagatggcaaaacagcgcattgtggtgatgtatggcggcaaagccgacgagcattcgatttcctgcatctctgcggcgggcgtgctgcgcgcgttggatactgacaagttcgaagccattgaggtgggaatcaccaagaacggcgagtggatcgtaggcggcgaggatccacgcaagtggaacatgagcgaaggcctgccgatggtggagaagacggattcctccaaagatgtggtgctggatgtggcactcggccaggatggtttcttcgctcgtgaagatgacggcacgctgacttcgcttggccacgtggacgccgtgcttccggtattgcatggtccgtacggtgaggatggcacgattcagggcctgttcgaaatgatgaacgtgccgtacgttggctgcggtgtgctcgcttccgccgcttgcatggacaagcattatacgaaggtattgctggctgcggccggtattcccgtggctccaggcatcacgttggatgtgcgcgattatgatgccgcttccgaattcgccgccgaggcggacgagatgcttgccgcggtgcagcaggccggattgcagtacccgctgttcgtgaagccgtcccgcgccggttccagcttcggcgtgaccaaggtcgaacatgagggcgatgcggccgagcttgccgccgcagtgttcgaagcgtcccaccatgattggcgtgtgctcgtggaacagggcatcgacgcgcgcgaaatcgaatgcgccgtgctctgcccgaaggccggcgaggctccgcaggccagctggccgggcgaaatcgtgcttgacaagcgtgccgagggcgacgaccagttctatgatttcgacagcaagtacgtgaactccgacgcaagccatgtggaagtgcccgcaagcctgccggaagaaactctgaaccgcgtgcgcgaaaccgccaaaaaagcgttcatcgcagtcgacggcgccggcctgagtcgtgtcgacaccttcgtgacggccgacggcgaagtgatggtcaacgaaatcaacaccatgccgggcttcaccccgatttccatgtatcccaaggcatgggaggcaaccggcgtgagctacaccgatctgatcaccacgctgatcgagggcgtgctgcgctgatttcgattgggtggttgctcgctttagtctgattcgatttgcatgagactggcatcaatgctgacactgcgttggtgccagttgacatatttcaccaatttacctgcagtttgggaaaatttagtttttccgattcaaaataaactgcatatttactgtaaggtcagtatcgcgttgatttgagggcttatcttctttcttgttgttatgaacaaggcataagaaagatattgatttccatgatttctctgcgcaaactggctgccggctcccttgctgccgttctggctttctccatggccgcctgcggatcggacagcacggattcctcagctgattccacttccggcaaggccgtaaaggttgatgaaaagtccgcaaaggctacttccttggctgatttcggtacgatggacgatttggttgccgccgccgaaaaggaaggccagcttaacgtcatcgcacttcctcacaactggtccaactatggtgaggtcatcaacggcttcaagaagaagtatccgaacattaagatcaacgagctgaacccgaacgcctcctccaaggaagaagtggacgcagccaagactaacaagggcaccgacgctgcccccgacgtgttcgacctcggcttggccgtggcttccaccagcaccgacaacttcgcctcctacaaggtgcaggcctgggataagattccggattccgtgaagaatgctgacggcaagtattacgccgactacaccggcatcatgtcgatcggttggaacgccgacaagtacggcgacatcaacagccttgacgatctgatggatccgaagttcgccggcaccgtggcgctgaacggcaagcctgccgaagccggcgccgcattcaacggttacctcatgatcaaccagctcgcaggtggtgacatcaacgacttgcagccgggcctcgactacttcaagaagctcaaggatgctggcaacctcaccaccgttgacgtgaccgacggaaccatcgattccggccagaccggcgtggtgatggactggagctacaaccaggcctcctatcagaagagcctcaaggagaagggcgtgaactggaagttcaagaccttcaagaacgcccaggtggtcagctactacaaccaggccatcaacgtggacgctccgcacccggccgcagcacgcctgtgggaggaatacttgtacaccgccgatgctcagaacgaatggttcaagggcggcgccaatccggtgctcctcgactccatgaaggaggacggcacggttgaccaggacaccctgaagaccgccatcaccatcgagggcgatccggtgacctatacaaacgatgattccactcgcatcaccgaatggctccagaacaactgggacaagaccatcggcaactgattggcaaccgctcgcaagcaacgcaaacgagctggatcgcaatcgaaaataatgcaatctaaggccggtagaccggcggacacgacgggctgaagcaagttccccgacgtcttctgccgtaacaaccggccttgaagcatgtctcccgcaatagcggaatcccacaatcctatgcaatctcaccgcatatcaatcgtatgaaagcacgcatgcaaccatgactgcagcaatcacccccaaagcgggagtcatcggcgggcgtaacgcacgcgaagcccgcggaactcgaggaaacggcccctccgcaacctccgatttcgccacgcatcgccgcgaaatcggtacattcgtcgtgaccatcccgttcttcgcctacaccgcctgcttcctgcttgcgcctaccgttatcgtgattgtcggcgcattccggaacgtcgacggcggatttaccctcaacaacttcagcaaactcttcgaagcgaacaccatcgccgcgttcgccacctccattctcgtttccgtgatctccgcactcattggcgcggtcgtgggtgcggttgcctcgtatgcgctggtgattggcagcaaaccgaacggactgctgcgccgcatggtcagtgccatttcgtcggtgctcgcacagttcggcggcgtgatgctcgctttcgccttcatcgccaccatcggtatcaacggcgtcggcaccatgctgatccgtcagctgaccggactgaccgtcaatccgaactggttgagctccctgcctggcctaatcacggtctactgctacttccagattccgttgatgattatcatcttcctgcctgcggtcgattcgattcgtccgcagtggcgtgaggcttgcgaatcgctcggcggtaacacattccagtattggacgcgcgttgcggggccgatactggttccgcgtttcatttccgcattgctgttgctgttcgccagcgcgttctccgcatatgcgacggccgccgcattgttctcacagcgttcgattctggtgccgcttatgattcagggcgccatgcgcaacgaaatggatccgaatcagcagggattcgcgcaagtgctcgccttcgcgatgatcatcgtggttgctctggtgatgatgctgagccacgctgtggaaaagaaggccggacaatggcagtgaatcatactgaagcaatgcccccgcagctgcgtgccgcccgcgtgcgcaagcagcgcgtgatcaaggcgattattctcacgttcacgctgctgttcctgttcgtgccactggtgtctatgtttgtgttcaccattcgacacccgctttccggcaagtggagtttggatccgtggattgcgattctcaccggcgatggcagcgcgcttggtgctgacttgtccacattgtggagcggtcttggatcgtccatgggattgtgtgtggtgactgtggtcatcatgctgctgctcatggtacccaccatggtgatcgtgcacattcgctccaagcagctggaacgcgccatcgaatgggtggccaccctgccgctgaccatccccgccatcgtgctcgtagtcggcctggggccgatttaccgttggctcagcgccgacgtgctcagcaccaacccgatctggctgtgcttcgcgtacgttattctggtgatgccatttgcattccgcgcgctcgctgtgggcctcaactccattgacgtgaaaacgctgtgcgaagcatcccgctcgctcggagcctcctggccgcgagtgttcttccgtgtgctcatccccaacctgtggcagtcgatcctctctgcatcgttcatctccatcgccgtggtgctgggcgaatacaccgtcgcatcgctgcttggacgcatgaacctgcaggtggcgctctaccagcttggccaatccaactcccaaatctccaccgccatgtcgctgctggcactactgttcggcgtgatcctgctggtagccctcgatcttatttccgacgcactgcgtaaatccaaagaaagcaacgaatcatgactctcgctgatcagaaagcaaccatcgcacgcacttcggaagcgttcgtaaacgccaatccgagcgccgaaaccgtaacccgagccgcacgcgaagtcctcaacgactccgcggaacgcggcggcggcgtgcaaatgcttaatgtagacaaaatctacccaggagccaccaacaaggcgctcgacaacttcaacctagaaatcaatcctggtgaaatggtcgtgctgctcggcggctccggctgcggcaaatccaccgcgctgcgttccctcgcaggcttggaagacatccaggccggccgtattctcgtcggcggccaagatgtgactggcgtgcccgtcaacaagcgaaacatggccatggtgttccaggcgtactcgctgttcccacacatgaccgctctgcagaacgtggaattcgggttggaaatccgcggcatgggcaagacggaacgccgtaagcaggccatggagaagctggaactcgtaggtcttgccgatcaggctggcaaatacacgcagcagatgtctggcggtcagcagcagcgtgtggcgctcgcccgcgcactggccgtgaacccccgagtgctcctgctcgacgagccgctttccgcacttgacgccaaagttcgtgtgcagctgcgcgacgaaatccgccgcatccagctcgaagccggcaccaccaccgtgttcgtgacccacgatcaggaagaagcgctcaccgttgccgaccgcatcggcgtgatgaaccacggatgtatcgaacagatcgccgacccgcagacactgtaccgccgtccgggcagcgaatacgtggccaccttcattggcctgaccaaccgactcccaggcatcacgaatggtgaggaagccgtggtgtttggccagcgcgtgccgttgctcgaagcctccaagcgcgacgcctccaccgtgctcgtgcgaccggaaaaccttgtgatcactctagccgcaaacgatggcaacatggtaggcgagcatggtcgcgtcgacatggtgcacttcctcggtgcgctcgcccgcgttgacttgacggttgccgcaggtgtgggccacctgcccgtcaccgtgcagctgccggccaatgagcttcctgccggcctgacggttggatccgaagtggtggtggctccgcgtccgatcgccgcgctcgccgtatgagctgtttcgttgcggacgcccatgacgacggtcatgagattgtaagctgatattcagcattcctgtactaaggtgctgaatatcagcattttcgtatatgcaccccgtgcacgtcgtcgcaaaggcaaatatgacgtttccgcagtacccccaatatccgcagcggccgcaacaaccgcatacgcagcagaatccacaacagccatcccaatatcagcaacaaccgcagtatccgcagccacaagccaatccctacgaactgtggctcaggcgcgtgaaaagcgtgttctcccgcatcggcgcaggcatgtgcctgatggtggtgatctggtatgcgcttgcaacggtgctttccggcatgctctatcaggtactgcacaccacgaatctgccgaattgggcggtgtatgtggcatcggatacccctttgtatctcgtggccatgccgctcgcggtactgattatgggcaaatcgtcggtcattgaaacacgcaagttcgacatgaagccgggccaattcttcaaactgctggtcatgtgcttcccgctcatgtatgtgggcagtctcatcggcaatatgttggcgtcgctgctgtccggaggcaaagccagcaattcggtgagcgatctggccatgcaattcgacgtgtggaacgtggtgttcctcgtaattctcggaccgttgttcgaagaatggatcttccgcaaggaactcatcagccgcacgcgcaaatacggcgaaaaaaccgcgatcgtgttctccgcgctgttctttgctctggtgcacatgaacctgttccagttcttctacgcattcgcattgggtcttatgttcggctacgtgtacgtgcgcaccagcaaactgcgttattcggtggccatgcacatgatcgtcaacttcatgggtggcgtggttgcgccgtgggtggtgacgaacattgacatcgacagtctgatgaacgtgctgaccagtgcggaaaacggcgacggaacggccatgatgcagtggatgggccagaatgcgacgggaatgatgatattcggcatctatatgctgctatattacggtctgatcatcgcgggcatagtgttgcttatccgcaatcgcaagaactttgaattctataccgcaccggaagaactgcctcgcggcgttcgcacgagcacggcaatactgaacgtcggtgtagttacttacattgtagtgacggttattattacgtcaatcaatctaatgatgcaataatttcagtataaaaaagtgccgcatgtggactactgcatgcggcactttatatatatgggtcaaccgcgatttcttatgttcgcgaggatattacgattctttgttaatggcgcgattctcaagaaaatcagcattggcgatggaacgtgccacggcgttgatcatgtcgggaagcaacgattccggcttggcgtacgcgcacacttcgacattgatgccgtaaggggagtagccggtcagtcttactttcggagggaagcgcggatcggccaaatcggcggtatcgcgctgcacggcctgaaccacctgacgggtcatctcgtcgatgtcggtaccggccttggcggtaaacggcacacgaaccagcatttcgttggacggattgagtttttccagtgacgcggtgttcagaatcgaattcggaatgatcttgatgttgccattgcgctcgcgcactacggtctgacgccagttgatatcttcgaccacgccatcggtgcccgccacattcaccagatcgcccggctggattacacggccaagcatcagaccgaaaccgccgatgatgttcgcgatcgtatctttcataccgagcgacaccgcaagaccaccaatgccgagcgcggtgaaaatcgtggtcggattaatgccgaacaccggctgcagcacagtgcccacagccaacgtccacaccaccgcgcgcagaatattgatgaaaatcgaagcgttcggcacttgcgaacggtccagcactttactcacgattcgggtaagcgccttgtcgataacggccgcaagcagtgcaacgacaatgagcagaatgatttttccggaattggttttcagccaatccacaacgattccaatcggttccatagtgttctgaagcgtcccttcataagtttgattcgcatgcattactggtgcgcgcgacttgcgttcgctgcgtctgcgatgcgtgttcgcaacttgtgttcgcacatatcctacagtgcgtggctgagtcggtttgagcgtgggtgtgcgggggcgtgcgcgagaacatgtgggaatgcgcgtggtgacatgtgtccggagccgtgaacggactaaagttgaggcatgggcaatgttgtggattatgtgcgccgcgagttccgcgggtttggcgaattggcgttcagcaatgtcgattccttggtgctttccgagctttcctacatgcgattgccgggcttggttccagcattcggcgaggccaagtcggtggcgaccgtgccgatccgtgacttgctgcgcgccgaaagctacgatgagatgtttgtttcgaattcctctgaaatgaatgattatcggctttcgttgctgcgcgcggtttgcgaatcgccgcgattccgcgggttgcgggtgggggagtatgacgaacgtttggatgagggcgagcagcagcaattcgctgcgatgaccttcgatttgggtgccgatttcggcttatatgttgcgttccgtggcactgacggcacgctcgtcggttggaaagaggattttaatatggcggtgcgctgcccagtgccgtcgcaagaatcggcatatcgatatgcggactcgattctggacaggacggaacgtttcctctcggcgaaaaaatcacccgacattatgatcggcgggcattccaaaggcggcaatatggcggtatatgcggccatgcaaatcacgcaaagcgatattgaagcgaccgacgaacgcgcgcaacggctcggactgctgccggcgctcggaggaagcgtgccgggacgcaactgcagaatctcccgcatcttctcgcatgacggtcctggaatgtctcaagtcatggtgcatagccgcgcatatcaggcaatcgcggcacgaatcgacaaaaccgtgccggaatcctccattatcggcatgctgttgcaatcgcaaatcaaaccaaccttcgtcaaagccgacgccataagcattctgcagcatatgggatcaagctggcaagtgacgcaatccggcgaattcgagcaggcaagcgagctgacaggcggtgcgcaactcatcggcaaaaccattgacggatggttcgaccgcgtaagccaggaacaacgggaacgggccatcaaccagatatacgacatcttcgcagccgcggggtacggtaatatcgctgatctggtggcgcattggacggattcgctgccgaaaatcgtggcagccgccagaggtaccgacgtgcaaacgcgcgaactcatcaaagacgtgttcaaggcgattccagccagtgcggcgaaagtcgctgtcggggaactgcgcaacgacaaggagggggatgcgtgatgggcaatattattgactatgcgcgcacggaaacgcgcagtttcgaggcattgccgttccgcgaggccgacgcattggtgttggcgcagctttcgtacgacgaagtaccggaatgcgtgctgcgattggacgatttggtagcgaaatacggtacgttgcaggcgcgtgcgaagcaattcgatattcggcgtccgatcgcatcgttgcgtatgctgcgcaagcccccgtttggcggcgtgacgattgcgcgtgccgatgacgagctgaaccacgacaagcccgtggccgaccatgatgtggagaacgtgggattggtcgatccgcaggtgacgcacgacttctaccatgctgtggcggcgaatccgcggttttccgacgttgagatgagcgcgtattgcgagcagttcgatggtggtgcgcaaacgcagttcgcggcagtgactttccggctgccgtcgggaacgctggttgtggcgtttcggggtactgatgattcgctggtcggatggaaggaagacttcaacatggccttccaatacccggttccagcacaggtttccgcagctgaatacctgaaaaaagtcgcctcgctgtgggatgggccgatactgctgaccggtcactccaaaggtggtaatctggccgtatatgcggccatgaacgccgaagacgagatcaaggaccgcgttgaacgcatttactcgctcgacgggccgggtttccccgaagaagtggtgaaaagtttcgaatatgcgagcgtgagcgaccgcattgtgaaaatcgtgccggactcctcggtggtgggcatggtgtttgaaacccccgaacgttgcgtggtggtgaaatccgacgtggacggcatcatgcagcatttcgccttctcgtggcagatgcacgggggtgaattcgccaaggccgaagatgtggccgacagttcggtggtgttcaacaagtcgctgaacggctggcttgcgggactttccaaagaacagcgtgagcatgcggtcgacgcgctgttctccgtgcttgaggcttccggggcgggcagtatttctgcgatcgtggcggccggtccgaaagtgattcctgaaatgctcggcacatatgttggcttgagcagtgcggatcggcgcaacatcaatcaggcgttggtgattctgttgcaggcggcgctcgctcgcaatccgaaagttcagcgaaagtgaagcgcgaatgaggcgtgagtactgtgcgaacgtgggcgggcactgttcgcgtagcgtacttgtgttgtaagcgtgaattcgtatacgacatttgccgaaattcggtctagacaacttgtacaataaaacgtggttatgaggcaacatgactaattattagggggtactgatgccacgaccacgtagggattcggaaatcctgccagcaaaagatcgtctcgaaaacgccttctgggagctgctttcggaacgcgagtacaacaaaatcaccgtcaccgacatcgtgcgcacggccgacgtgaatcgcaattccttctactatcatttctccggactgccggaattggccgactccgccattctgcacgccgtcgaagacacgccaatgccgggcgtgccagggcgggatttcaatcctgacaccgaatggcgcaagcacgtcaccgcgttgctgcgcgatcccgaacagcgtcagcgtctcgaccgattggccttgctggcaggtccgcacagctcgccggaactcgtttcgtcactcaaggaattcgggcgactcaccatgatttccgtacttggactggatgccgacaacctcgatctgaaaaccgatctcatgctcgatttcaccgtcggaggcatgctggccgtactgcagcgctggccgaaactgcatgaaaaactgccgctcgacaccgtattcaacgaggacgtcgccgtactcgcggcgggcatgttcatgtcaatgtcgaaagcggacatgctcgaatactggcgcaggatcttcagcgaaggattcgtacccggcatggcgatttcgcaacagcagccgccgtctaccaagtgaccgtcgaaagccggctgtgataatccagtggtagaaacgatatagcggcgtttttccgcggattgttccgtggaaaaacgcgaacgtgcgaaatgaacgaacgacggggaggttgtccatgatcaacgaagcttacaaggccatgctcggcggaaaatccgtgatccgcgagctgagcgaatacgcgaccgcgcgcggtgccgaaatcggctacgagaacgtgttcgactattcgttgggcaatccgagcgtgccctgcccgcaaagcttcaccgacgaaatgatcgccctgtaccaagaggcggaaccggtcgcgttgcacggatactcgccgtcgctgggcattacctcggtgcgcacggccattgcggaaagcctcaaccgccgtttcgacatggactatacgaccgactacatcttcccgaccacgggtgcggccggtgcgctggcccacgcactgcgcgtggtgaccaagcctggagacgaagtcatcacctttgccccctacttccctgagtaccagccgtatgtcaacggaaccggcgcgcacctgaccgtggtgccggccgacaccgaaaacttccaaatcaacttcgaagcgttcgaacatgcgctgaacccgggaaccgcggcggtgctcatcaacacgccgaacaatccttccggagccgtctattccgccgaaacgctgacccgactggctgaaatcctgcgcgccaagcaggtcgaatacgggcacgacatcttcctgatttccgacgaaccataccgtgaaatcgtgttcgatgggggtgtgcagccgtacccgagcaagttctacgacaacacgctctcgtgctactcgtactccaagtcgctgtcgctgccgggcgagcgcatcggctacgtggcggtgaacccgcgcgctaccgatgccgaactgatcgtgccgatgtgcgggcagatcagccgcggaaccggccacaactgcccaggatccagcgtgcagctggccgtggccaaggtggtggacgaaaccagcgatctttccgtgtacgagaagaacatgaacctcttgtatgacgcgctggtgcgcctcggattcgacgtggtgcgcccgggaggcacgttctacatcttcccgaaggcgcttgaggatgatgcgaatgcgttctgcatgaaggccaaggattacgacctgattctcgtgccatccgacagtttcggcgtgcccggctacttccgtatggcgtactgcatcgatacggaaaaggtggagcgttccatcgccgcattcgaaaagttcgtgcacgaagtctacggccgctgagccctgtgtgcgctcgctggaggaattcggacgcaaataagccaaaggggtgtgtatctgccttatatatggcagaaacacacccctgtccggagctatctcgcttatatatggcaggtcggttggctaaaacagccaaaaacgtacccccgaagtgctgttttgctgaggacgtctgccatatataagcgagataggcgttcttaagctgtgtggagtgtccgtttctgcagaatcggacgttcataggctggtttttggtgtttggatgtccgtttccggtgaatcggacagttgggctgctgtttttgggttctgtttgtccgtttctgtggaatcggacattcaaagcactctcagtgggtggcgatttcgtcgatcttggtgacgtggccgccgaactgggcgcgcatggtggagacgacgcgcagaatgtcgtccgcgccgccgcgggaagtctggcgggcatacagcgcggccgcggtggagggtgtcggcacgcccagttcgagcgcagcctcgatcatccacttcgcctcgccggattcgttggccaccggcggcatggattccagcgtcggatcggacttgaacgcgatcgccagcaaatccaacagccaggactgtaccacggaaccgtctcgccatgaagtcatcacggccgccggatccttgatgagatcggacttcaccatagtggcgaaaccctcgccgaacgcctgcatcatgccgtattcgatgccgttgtgcaccattttggcgaaatggccgccgccgaccgggcctgcgagcaccagtccggaatcgccttcaggcttgagcgcttcgaaaatcgggcgagcgcgttcgaaatcctcttcgctgccgcccaccataagcgcgtatccgcggtcaatgccccatacgccgccggaaacaccgcaatccatgaaatggatgcccctcggctcaagttcggccgcgtggcgcgcgtcatcggtgtaacgggaattgccgccatcgatgatcatgtcgccgggttccagcagctccgccaattcgttgatggtgctgtcggtcgcctcgcctgcgggcaccatcacccacacgatgcgcggcgcggtgagcgctgccaccatctcttcgaggcttgccacggtgcgatccgattcgggggagcggtcatatccgaccacctcgtgcccggccgccgcgatgcgcttcgccatattgccacccattcggcccagaccgatcattgccagctgcatgatgttcttctttctacggttttgtttgatatggaatttgattgggattggtgccatccacccgctttcagcatcttccgcaacgcagaaaagaagatgcggaaaacgaatggacggcaagttttttgtatttcagatatgttttttcagatatgatgcgcgcgaatcgcaatcgcaattcgtgtgcgaagtgttgcgtcaaagcaccagcgaaagcagcatgacgcaacccaagccggtgaccgacagaatcgtttccatcagcgaccaggtcttcaatgtctgaccgacggtcataccgaagtattccttgaccagccagaatcctgcatcattcaggtgcgagaagaatacggaacctgcgccgatggcgagcaccagcatcgccagatgcgtcgggctcatgccggtggcgagcggcaccataatgccggatgcggtgacggtggcgacggttgcggagccggttgccaggcggatgagcacggcgaccagccagcctgcgatcagcggattcatggcggattcggtgatcgaattggcgatcacgtcgccaatgccggaatcgacaagcgtctgcttgaaaccaccgccggcggcgacgatcagaataatgccggcgacggagctgaacgactgcccgaccatgccattgaccgcgtcgcgagtgaacttctgcatgtagccgagcacaaccatcgcgaaaatcgtggtgatgagcagagccaccagcggagtgccgatgaaggcgagcgcgcgtccccacacggtttcgctctggccggtcagatccacgatggaagatgcgagcataagcacgaccggcagcaggatgacggcgattgcggaagtgaaagacgggcggttttccgcggatttcggggcttctgcctcagcagtgttttctggggccgcgatcggcacccacttggcggcgagcttgccgaacagcgggccggagatgatcacggtcggaatggcgacgatcaggccgagcgccagggtgatgccaaggtttgcgttcagtgcgccgatggcggtcagcgggccggggtgcggcggcacgaatgcgtgcagggtggacaggcctgcgagggctggaatgcccagcagtacgaccggagctttggcgcggcgggcggcgaagagcaccaccggaatgagaatgaccacgccgacttcgaagaacatcggaatgccgacgatgaacgcgatcagtgccatggcccacggcagacgctgcaacggcgtcttggacatgatggtgtcgacgatggtgtcggcgccgcccgacttgaacaggatcgtgccgatgatcgagccgaatgcgataagcaggccgacgttggcgatggtggaaccgacgccggacgtgaaactgtcgaatgccttgtcgtattccacgcccgcgcacacggccatcgcgaatgagccggcaagcagggaaaggaacggatgcactttgcataccgcgataaggagaacgatgatggcgatgccgatgatcgccgcagcaataaggttcatgaatcctcctcgattcatggggttggcttgctagatttgtccgattctggagattcggacatatggaagcccattttgggtgcgtacatgtccgtttccggtgaatcggacagttgggctgctgtttttgggtcctgtttgtccgtttctgtggaatcggacaaacatgcaccggttttgggttttgtctgtccgtttctgccgaatcggacacatgcggactggggaatggtgggttaggcggcctgggttgcggtttgggcggctaccgtcgcggctacggttgtcgcgtaggcgttcagcgctttgatggcacggtcgaccatttcgtcgacgctgccttcgatggagatttccacgccgttctcttcgggggcaagcggctcaagaatggcgaactggcttggtagtagcgcgggcggcatgaaatggcccttgcgttcgctgagcctctgctgaatgagcttgtggctgccgttgaggtgaatgaagaatgtgggcacgtctttggcgagtacctcgcggtagctgcgctttaacgcggagctggacaccacggtgttttcgccgagcgcctcgcgtgccaccatccaggagttgatgacgttcagccatggccagcggtcctcatcggtgagtggaatgccggctgacattttgtcgatatttgcctgcgggtggaagtcgtcgccttccgcgtacacgtatccgagtcgttcatggatggcttctgcgacggtggatttgccgcatcctgcaacgcccatcaccactacgtgaatgctcatgttgctctccttgctattgacgatcctgtgccgctccgcaccaggaataagactactataaaccgtaaaagtagtatcagtcaaataaaaagtactatgaattggaaaaatcgtgtgacttgctatgctgaagatagtgcaaaatggcggtaaatcacgcaatcgcagatacgcaatcatctgcgattggtgattgccgtgcgtgtcgcagaatacgtgaaacataccgtgaaacaaagcaggcatggtgtgaagtggacaagggaggagcgatcgatggctgaaggcacggtaatcgcagaaaataccgtcggtgagctgatgcaggattcggtgagtcgaacgctcgccatcgaaatgcttgacggcgtgtggaaggctggcgaaagccttacgttggaagccttgcaaagtcgtttcggtatttccagaaccgtggcgcgagaagtcgcgaaaacactggaatccatgaatgcggtactcgtcaaacgtcgcatcggacttgttgcacgtccattcggcgaatggcaggcgctcaaccatcaggtgatcgaatggcgtctccactccacgcaacgcgaacggcagctgtcatccctcactgagctgcgactggccgtcgaaccggctgcagcagcttccgccgcacgtcttgcccccctcgacgtcaaggcgaaattccccgtgtatgcggcgcgaatgcggcagatcgccgaagccaacgaggaaggcgaagccgggcttgcgcaattccatgatcttgacgtggaattccatacgctgattctgcatgaaagcggcaatgagctgttcgccgcgctttccgacaccatcgccaccgtgctgcgtggtcgcgtggaactcggcaaatacccgatgaagccgaagtccgacgcacttgacgcgcatgatgccgtagccgacgcgatcgccaagggggagcctgaacgtgcacgcagcgccatgctcgacatcgtcgacgaagtggcacgtgccctcaatttcttctgattttcgcgccaaacttgctttcttcagtgaaaaaatcgcaattgcgattactatgcggccgactcttgccatgcgcgacttttcagacgtaaggcgacatcggaaatacggcatgaaggcagctctgccaacgtttctttcggtgaatatgaagatgccggggaatgcccccggcggcttggagccttccttgttgccaagagaaagcttcactattgcagcaaaattcgcatgcagaatcaatcagtcttggtgattggatttgcatgcgcagttgcaagcaagtgttactttacgctacttgcgggtggggtctttttgcaggagaaggaagatgagggcgacgatcagcaggattgcgatcgaaagcacgcccaccgaagcgttgccggtcagcgacgtggtggtcgcaacgaggaaggtgccgataatcgaagcggtcttgccgaaaatatcatagaaaccgtaatattcgttggcacgattctttggaatgatcttgccgtaatacgagcgcgacaacgcctgaataccgccttggaacaggcctacgagaatcgcaagaatccagaattccgttgcggaacgcaagaagaacgcggcgaacaacacaatgcagatataggcgaccacagccgtggtgatcatggttttcgcgccgaaacgaccggcaagcttgccatacgcgatcgcgctcgggaatgccacgaactgcgtgaccagcagcgccattaccagatgcgtagagtcgatgcccagctgcgtgccgtatgaggtgctcatggaaatcaccgtgttcaccgcgtctatatagaagaagaacgcaatcatgaacatccacaacggcttgttcctgcggattgcacgaaaagtggagccgagctctgcgaatgtgccgcggatggcctcaccggtctgacccgcggtagcgcggtagtgcacctgcttatagctggtgagcagcggaatggtgaacgccacccaccacaatgcggtgattacgaacgaagcgcgcgtgcatgccaccgtggaccatccaagcaacgacggaccgccgaaaatcagcgcgatacaggcgataaacggaatcgtggagccaatatagccccatgcgaaaccatgcgaggacacgcggtccatacgttcattcgacgtgatatcgaccagcatggaatcgtagaacgtgagcgaaccgttcaggccgaccgtggcgagaatgcacaccaccaagaaaacgagccagctgagcggcaacgccatcgcacagcaggcgaccacgcccgtcaggaagaatccggtaaagaacttcaccttcatgccctgcacgtcggccatggatccaagcacaggcatcatcaccgcgatgatcagcgacgcgatggtctgcgcgtacccccatgtcgacacgatattcgattggccggcggactgcagcagcgagtttgcgtagattggcacgactgcggtcgacagcatcacgaatgcggaattgccgacatcgtagacgatccacttcttttcgcgggtggtaagttttgcgttggggtccggcatatgctctggggcagtctctgaggccatgtcggacgtaggtgcggatgcgggcgctgttgcgcgttcggacatgattgttgactctttcgaataaaccgtcaattcactattgtatatattacagttcatcttaagcggctgtaaggggagcgctctgccgttacgcatgaacattgcatgaacattgcgactgatgtgtgatcgacataaaaaatctgaaatatcgaaatgctgcaaataatactgggaatactgaaatgacggagatgaacatgtgcagattgtagattgcaccatctgtatgttgatgtcgtatgttgatgtcgtgaaaaacgttcgcagaacggtatattggaacgtgtcaaaatactgggaaaacacgaactaagtttgctgtgtgtgactgccgccgcgctgttgcgtcggcatatttctgcgaagagtcgaggagtctgtatgagtggggaagttccggacatgcttggtgcgaacgctgaaatattgcgctcgatattgagccagccattgcctgacacgcttgacatgatcatctggcgtggcgtcacgaactccgcgcaagcgtcgccattcgaacgattcgcggcacgacttttggtggaagccggtgctgcgggcatccgagacattgctgccgaaaacgattttgatgtgatccgactgagcacgacgaaacgattctggctgcgctgcaacggcaacgatctttccaatgaacaattcaatgttgtgcaggcggtcgaatcggcgcttaaccgcatcgactatgccgacgacgaagcgcgcagggcggtgcacggaggtatgccggaagcgtgcatcgacgaaaacttctatattgcgaaatcgcaacagtatctgcgaaacgtgtcgggtgcgatcgtggcaatcgacggtctgcaggaaggtgaaaacaacttccgtagaatgaggggtacggaaggggcgcgcggcggaaattgggatatcagcaccagattcgccaatgtttgcgaaaatctcgaattgcctttccgcttgcattaccgatttgacgtcgatgcgtccagcggcgtgatggtagtgcgtttcagcataccgaacacggcgatcatgccggttgcgtcgcaatatcgcgacggattcgcctccgcgtatgccgtgcgattggcgggcatgcttgcgtgggcggcgttctcgtcaagcgtacgactgacgcaagtcgatctgaccggttgcgtgggggatgctgacggcattcccgtgatttccatgggattcgatcgcgtgccattcatgatgggtgcgctgcctgccatgaaaaacggacaatgcgacgtggttccgttggatgtcgatccgctggcgctgctcaatttgctgcgcccggtgcgttatgtgggtttctttgatgggaaccgtgccctgacgccaatcacaccgctggcaacgtcagccgtattcttggagaaacgtgtttccgaatggcaggatcaacgtgcgctgcctgaaggattgcggggattcctacgtgccgaccgtgcctgcgaacttgacgtgatgcatgacgaatcgccggtttccaccgatgatgtgaacgcgatcatggaagaaaacgaaggatcccccatggtcgccgaactccaattggaagccgcgttggcgcaacttggcgaaagcggtgaagcaggtggggtgtgcgaagcgggcggaactgacgagacaggcgtagcgaaaattggcgaaaatggcgaaattccgctctactgcagccgtccaggcgtgcgactcatcatctccctgctagacggcgacgaacacacgcgctactggaaactgccggatgctgtagtcgacgtacaccagaatcttggggaactcgccaaaaacaatggcgactatgagcgcgcggaacgtgagctgcgcgcctgcatcaaacttgccccaaccagcgtacgtttctacgaggaactatcgcaggtatacgcaagaaccgacgaatacggcaaagcggccgacgtgctcatcggcgcgttgaaaatcgcagtgctgcctatcgattgcgaagtactctactatcgacttggctacgcattgtggcagttgggacgtctgccggaagcgctcgcctgctatgcgatgatggtcaacggcggcacgccattccgtacggccgcgcgcgatgaggccgaagaagtgagtaggcagatgggattgccttcgccggatatgaaatatggggatgcgtgcgatgcgctgcgatccggcggcgtgccggttgcgccggaaggcaaggtgttagatacgattgcccgcgccgcgatttgcctgacggatgctggtttcccgctactggctcaggatgcggcttggatgcttggaatgcgcgatggcggtgatgtgatcggcgcggttgcgatgagcctgcgttttggagccgaagggcgttcgaagaactagcgcgacgacgccgggtggggtgtgctgggcggtttgactggctggcggctcgggctatgactggctggcggcgtctatgcgcggggcaaatggtggtttggatgtgctgtctgccgacctgacgcatgttgaccagacagcggcattccggggaatttaaggcgattgctatccacaaatttgcgattggctggggctggttgtatagttgagaagttgtgtgttctgccttgcattcagttgcggggcatcgaacgcgcagacttgcaagtcaatagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtcaagtgcatcaaggctggcaaggttcagcgcgttgaagcgtgaatcgcgaaataacagcttgaaaccccggtagaccaatggtcaccggggttttgctttatcttgatcccgccagggctttaagcgttcggatttctccactcgatggagaaatcttcccgcttacagtggcgtttgcgtccgtattcctccagtaggtggaggaatactcccattggttggctggtttgcgtcctgatttctccagcgactggagctttttgcccgctaaggggcttgtggacggggtgatttctccagtgggtggaggtttttgcccgctgaggggctggtttgcgtccgtattcctccagcgagtggggaatttgggcggtttgagtcgtacccagtggtagaagccgcatctgtcggcataactggggagaatggtgcgttatgagcaccacactggaaacaccgatttcatcaatcgagagcaaccgccgcagagtcggcgcgctgaaatcgcttggtgtggtgtcagttggcgacgccctgacctattatccgttccgcgtaaccgatccggttcctgcgcgctcactgcatgaagcgaaaatcggggagaaaatggcgttcgccgcgcatgtgctcgaaacgcgcgttttccccatggcacgtcgaggcttccgcctgatcgcaacagtcacggacgacgatttcgcagcgcgtcgcaacaccccaaaatcgttggcgtcgctggtcttcttttcgtatcgcaaatcgtatgttgactgggtgcagcgcaaactgcacgcgggagcgctgctcgtcgtcgcaggcgagccaagcgtgtacgacaatcgtctgcaattcacgcatcccgacctgctcaccatcaatcccgtgcaatcgcagtcggaaaacggggaatggaacgacggtttcggcgatcctgcgaatccgcctctcggcaatctgaaatacgatgcgcaaacgatcgacgaagcgctgaaacgagtttgccgtccacgaccggtatatcatgcaacttcgcgaatttccagcgaacatattcatgaatcggtattgaaatatatggatgcgttgcgcggagccgaatatttggtaacgcaaaatgcagggaatttcttagataatcctacgcaagaaggggattttgatattccccaaattgatcgagaaatacagattaaagtactcggtaatgctattcccgatattattccggaagattttcgtgaggaatatgggcttatgcatcgtgctgaggcattcatggcgattcatgatccggttgatcgcaagaatttcgataacgccttgcaaacgttgcgatatgaggaagcgctgatctgccagaccgcgctcgtcaaatcacgcgatgcatcgcgcaaatccaaggctaccgcatgccctgaaacgcggttgaaagacgatttcatcgcgtcgctgccattcgcccttacgaacggccaacagcaggtcatcgccgatatttccgccgatatggcgcacgattaccccatgcaacgattgctgcaaggcgaggtcggttccggtaagaccgtggtcgcggttgctgccatgatgcaggccgtcggatcaggcggccaggccgtgcttgtagcgccaacgcaggttcttgccgaacagcattatgcgagcatttccacaatggtatccaaactgggaaaaagcgacgcaaattcgagtgataatcagaaaaatctagatgatgccaatgcgcggcgaagcaataaacggtccgcgcaaagttcgaaagatggggaattcgacgcaaaaacaattcacaataatgctgtggataaaggtgtacaacttgcagaccttcttgatttggccgcatctgatgatgtggaaaccggattttccggcaaaggaaacgatatatttggcacaaaagatggggagattcctgtatttcttctcacgggaagtatgcgacttgccgaacgtcgtcgcgtgctcgcagcagccgcatcgggcatgccctgtatcgtcgtggcgacgcacgccgcattttccaagagtttccaggcgccaaacctcaccttggcggtgatcgacgaacagcaccgcttcggtgtggaacagcgcgaatcgttgaattccaagggttctacggcgcctcatctgttggtcatgacggccacgccgattccgcgcaccgcagccatgacctggttcggcgatctcgacatttcctcgctgaccgaacttcccggcggccgcaagccgattcgcacattcgtggtgccggaagacaatgcgtcgttgatgggtgaaatgtttgccctgattcgcaagcgcatcgacgcgggggaacgtgcctacgtggtctgcccgcgcattgacgccgatgccgaagatgcggacggcgcgctggcggcgtcagcggcttcaggctcggaaaccgcaggttcgtcggccgcggcttttgacgacgcctacgatcttggcgaagacgacgaccggcgcgcacaacgccccccgttgcattccgtggcggaaatcgtggagcgtctgcaatcgctgccgcagttcaaaggcattcgattcgccacgttgaccgggcgtgacgatgacaccacaaaatcgcaggtcatggccgattttgaatccggcataacgccgattctggtggcgaccacggtgatcgaggtcggcgtggacgtggcgaaagccagctgcatcgtgattttcgatgcggaccggtatgggctttcgcaattgcaccagttgcgtgggcgcgtcggccgaggcggcaccgattcgggggctttcctgatttcgcgtgcgcccgcggacagtgatgccgcccgccgtcttgacgtgattcagggcacgttggatggtgccgaaatagcgcaggccgatttggaattccgcggcgccggcgacgtgctcggcgacgcgcaatctggcggaaagtcaggtttgaagctgcttcgtgtggttaaggatgtgaagattattgagcatgcgcgggttgaggctacgaggcttgtcgctcaggatcctgatttactcgaacatgtgcagttggccggggcggtgcttgatttcacgcgcggcaatgaaacgttcctgaccagtaattagtttggtgcgattaattaatcgcctggcacgctagagtggtgcgtatgcgcgtaatttcaggacgattcaaaggcgttgcattgaccacgccgaaagcgggcactcgaccgaccaccgatcgcaccaaagaggcgattttctcgcatctcgattcatggggagtgttggacgatgcccgcgtgctcgatttgtttgcaggaaccggcgctttgggcatcgaagcattgagccgtggcgcacgagagctggtggcggtggaatcatccgctccggcggccgcattgatcgcgcagacgctgaccgcgttgaaacataaccgttcgtgggaacatggcatgagtgcccgcgtggtgaaggcgcgcgcggaaaaatacgcggcttcagcttcggccgttgaaccgttcgacatggtgttcatcgacccgccgtacgccttcgaaacgaatgattgcaaccatctgctcgccgatcttgccagccgtgaactgacttccagcaacacggtgatcatgctggaacgatccacccgttccgaagagcccacggctccagaaaactgggaaatcaccgatcggcgcgattatggcgaaaccgccgtctactacattgaacccagcgagccaatctcagataacggtcagcaataatcgcaagaaaaaacttgcgattattccgcgtaaaaacaagcgtttaaaagctagcgtttgcgcggatgggcggcggaaacctcccaaccgagcgccatcaaggtcttgcgatcggccttgtcgagcttggcgcaatccaacgcttcgatcaggtcgggacgcaactcattggttttctcgagcgcctcatcgcggcggaaacgatccactttcgcatgattgccggaaagcagcacgtccggaaccttgatgccacgccattccgcgggcttcgtgtactgtcggtgctccaacagcgcgttctcgcccgtatacgattcctcaacaatcgaagcggcattgcccataaaaccgggcagcagccgcgtgatcgcctccaacatgaccgacactgcgacctcgccgccgttcaacacgtaatcgccgatcgaatattcgcgcacgtcaatgccttgcgcgcggtaatactgcggaatgcgcgcgtcatacccttcgtaacggccgcagccgaacagcagatgatcggcatggctcagttccgtcgcatcctgttgtgtgaacagcggggcggaaggattcggaaaaatcagcacaggacctgcggaagattgtgcagtgtcggaatctgcagtatcgcaagaatcgccagtatcgaaggaatccgcagaatcctcaatattttccgtattttcgattaccgcaggctcaagctgcagcagctcgtcgaggcattcgctccacacttccggcttcatcaccatgcctgcgccaccgccgacaggagtgtcgtcgacggaatgatgtacgtcgtgcgtccagtcgcgcagattgtgcgcggtaacctccacaagccctttcgactgcgctttgccgagcagactgaggttcagcacttcaaaatattccgggaaaacagacacgatatcgatcttcataatgttcagaataccgggatgcctgccaagtggcaggaaacataaaaagtgggcactggattccaatgcccacttgaatggatatgtgatcgaaagcgcgtaatcatgaatgcttacgcaggatcgcaaacgatcacagtcccggaataagacctccaggcggatcgagggtcagatagccctcttcgaggtcgatgtccggcacgagctcgtccacgaatggcacaagcgcgctgttctcaaccacaacgccgtcggcatccttcaccggattggcgagacgaatcttcagcagccattgggccacttctatcacgtcaacgactttgccgaccaccacgcccggttcgagaccaagcatattgtcttcagccagtcgcgcctcaagaccgatgaggtctttcggataccactcgtcggcttcaagcatgtcttccggatcgtccgcctcgccatacagcacaatgccgttggctgcttcggactggtcgcggttgtcaatgccttcgaacttgataatccaacggtttttgaaggtacgggagttctccaccacatactcttcttcgccgtctttcgtgtacaacacagcaccgggagcgaaccggtattccggttcgtccgtaaagatctgcacggtgacttcgcctttgagcccctgcgcacgcccgatacgacagaccctcagcagctcgggctgttgagggtcgtcagaatgcatatcacgcaccacgctaggatctcacctgcgcacgtccatgatgtcgacgcgcaccttgtggtcggacagtgcctgcaccacggcacgaatcgcatttgccgtgcgtccgctgcgtccgatgacgcgaccgatgtcttccgggttgacgcgcacgcgaatgagttcgccacgcgcgttctcatgggacttcaccgaaacgtcgtcgggaaaatcgacgatgttcttaatcagatgttccacagcctgggcgagcatgatcactcagcttccgcagccggctcttcagccggagcttcctcggtagcggcggcttcggcttcagccttggccttggcgtcagcttcggactttgcagccttcagcttctgagcctgagcctcaacggcctcaacgcgagcggcggcatccgggccggcctcaacggtcttcagggtgccttcagcaccgtcaaggcccttgaacttctgccagtcaccggtgatcttcagcaggttcagcacctgctcggtcggctgagcgccaacgccgagccagtactgagcgcgctcggaatcgataacgatggtcgaaggctgggtgttcggattgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtataactaggggtgtgcgtttcgttttctgtgtggggcacggaatccgaaacccacatgttcctcacgtcacgcgatagttagagggcctcgcgcgcgcgaataacttaccaagtataaccgtggggtacggacggatgggtcttaggatgtttcccgctctatgcgactttccgaatccgtgcaaaaccgggaagtcgtttgtctgattctgcggaaacggtcaattatgcggcgaatgtgatgccttgaatgaccgaatcggcagaatcggacatttgctggcattcgtgagatgtttgcgtgggtctacatggcggaatcgtcggaatcaggcaggctggctacacttggaggttccgagtttgcgtatgtccgttcggagtgaacggtttgcatagggggagttgcctgaatgattatcgcgctttggattgcgttgattatttgcgttgtatggattgcgcttggcgagatgccggctggttgggatggccatttgccgctgccgtacttgattgcgttgattccgttgctgtggattccgacgcttgtgatcgccgtcgccggtttcgcgttgcatgagtcggctctcgggggagtcgctgcggtggtctgtcttgcgtcgctgctgcgcaaaatcgcatattggatggaaaatcttaattctcccaatactgcgcagagggttgccgaaaaacttgcggaaaagcgtgaaacatctcgtgaaacaggcaatgaagctgttacggaatccgcgaaacatggccgtttccgtgtgatgacgctgaactgccgatttggtcgcgccaacgctgcggcaatcgtcagtgcggtcaaaaaacatgatattgcagtacttgcattgcaggaattgacggacgatctggttgcgcaattggacgcttcgggattgtctgatttgcttccgtaccgtcagttgggggagagcaagggaacggacaatggcggattcaacggtgtgtggattcgtattgaaccaagcgacatgtctccggtcactgcggtgattcccgcggccgacgtgccgggcgtgtgcttcccgatcgattcgatgcgcggcatcacgtttgtttcggcacatccgaagtctccgatgcgcggatgcagggaatggtccgccggcatcatcggtttgggggagttggcgaccactcagaagcagggcgacatcaccgttgtgttgggtgatttgaattccggtaccgatcatccaagcttccgcaagctgctgaatgcgggcttcaaggatgcggccttgtgcgaggcgaagggccgtcatgccacgttcccatcatggctgccgtggccgcgcatcattctcgaccatgtgcttttcaccaagggattggacgcttccgacgtgagttcgttctgcgttgaaggtagcgatcatcttgcgcttgctgccacgttgacgttgaagtagttgatggcgattataaggtagtcgattcagctgaaaacagctgattggagtacgcaaaaaggggatgcgattcgtcttgaatcacatcccctttttatacgttaccgttttcgcgtcgcttgctttagtgcagcaagccggacagtccgccgccaaagttcggcggcagctcaccggcatcgcccatcaagtcttgcaatccggcgggaagtgcaggattctgcggcttcttggcaaaagcggaaccgccggaagacttaccgtcggagttcttgccggcaagcttgtcgcgcaatgccttctcttcagcctcgcgcttcatcggattgccggacttaccgcccttcttcttgcccttcttgcctttacccttgcctttgcccccgcccatggcagggccgccaaagccaggcatgccagcgccggccttgttgctcatacgcttcatcatcttcgcggcctgctcgaaacgctgcaacagcgcgttcacctgcgaaacggtcacgccggaaccgtaagcgatacgagctcgacgagaaccgtcaataatcgaaggatcacgacgttccgcaggagtcatcgaacgaataatggcctcagtacgatcgatttccctctcgtcgaactgctcaagttctttacgatgcgcggccatacccggaatcatgccaagcagattcttcatcggaccaagcttgcgcacctgctgcagctgatcgaggaaatcatccaaaccaaaggaaccatcggaaatcttgatggcggccttacgagcctcttcctcatcgaactgcttctgcgcctgctcgatcagggtaagaatatcgcccatatcgagaatgcgggaagccatacgatccgggtggaaaacctcgaaatccttcagaccttcgccagtggaagcgaacagaatcggcttgccggtaacggaggcgaccgaaagcgcggcaccgccacgggcgtcgccatcaagcttcgaaagcaccacgccggtgaagtccacgccctcatcgaacgccttcgccgtctgcacggcatcctgaccgatcatcgcgtcgattacgaacaggatttcgttcggctgcacggcgtcgcgaatatcgcgagcctgcttcatcagctcttcgtcaacgccgagacggcctgcggtatcgatgatgaccgtgtcgtacagcttctgcttggccagcgcaacagcgtcacgcgccaccttcaccggatcgccggtggtcagacccggggaagcaacggcttcgccaccgtcggactgcacgcccttttccggagcgtacacgggcacgcctgcacgttcgccaaccacctgcagctgcgtcactgcgttcggacgctgcaaatcggccgcgaccaacagcggagtgtggccggaatccttcagccagtagccgagtttgcctgcgagggtggttttaccagcaccctgaagaccggcgagcatgatgacggtcggcggattcttcgcaaaattcagcggtcggtcaacgccagcgccaagcacggccgtcaactcttcgttgacgatcttcacgacctgctgggccggattcagcgcctgggaaacctcggtgccgagcgcacgctcgcggattcggccggtgaaggaacgcaccacgtcgagcgccacgtcggcgtcgagcagcgcgcggcggatttcgcggatcgtaccatcgatatcagcctcggaaagcttgcctttgctcttcagatgcttgaacgcattcgagagcctatctgtcaaagaactaaatgctgccataatgtccctcagtctagccgtcccgcgggaaatttcgcattccaattaatggtgttgatgatgttcggttgatattcggtgagatgcttgatgctatttgcatgagaaatgacaatcccgtctcttccaataggagaagacgggattattgcttattaagagcgctgcggattatttgagggtccaggtgggaccctggggagtgtcttcgatggcgattccggctgcgcccaaggcatcacgaatggcgtcggcgcgggcgaaatccttggccttgcgggcttcggcacgctcctccaactgttcggaaaccaaacggtcaagcgcagtatgctcagcggaatcggcaccggctccggcggtgccgccggccgcaccctcgcttacccacggttccgccaacggatccaaaccaagcgtatcgagcatcgcacgcacattcaccaaaacagcgcgaacttcatccttcgcaacatccgaatcaacacgatcggcaagcttcgaaagcaacgtgttgccagaacgaatcgccgtgaaaatcgcagcggaggcgccggaaacattaatatcgtcattcattgcggcgacgaaatcagccggcagctcatcggcggaaaccgaaacgatctcctcacgggacggctgcccgccaacggcggcaccggcacgttcgatgaaattcgacacacgatcgtacgcggactgagcctcggtcaacgtctgatccgaccattccaacatggaacgatactgcacggaaccaagcgcgtaacgtaccacccaagcggaattttccgccaaaaccgccggcacggacaagccgttgcccagcgacttcgacatcttctcacccttggcggtaacccatgcggaatgcatccaacgagccgccgaatcgtaaccggcggcacgagtctgcgccatttcgttctcatggtgcgggaaacgcaagtccagcccgccgccatgaatgtcgaacatatccttcaaatagcggtggctcatcgccgagcattcaatatgccaacccgggcgacccgtgccgaacggagtattccaacgcgcgtcaagcggatcggaatccttcggagccttccacaatgcgaaatcacgcggatcatgcttgtcttccgacatgtccgcaggatcaaccggattgtatttgtcgttgcccgtattgtcgaccgacggacccatggcatcggccacttcggaagcggcatcagccacagcggtctgcttctgatgcgtcaactcgccataatgaggccagctggcaacgtcgaaatacacgttgccggtcggattgccgttctcgtcagtcaccacgtagccgtggccgttgtcgatgatctgcttgatcagatcgatcatgtcgatcatgtggccggtcgcacgcggctcatatgtaggaggctcaacacccaacgtgttgtaagcctcagtgaattcacgctcgtaaatgtacgcacgctcccaccactgctgaccggcggccgcagccttatcgagaatcttgtcgtcgatatcggtgacattgcgcacgaacgtgaccttgtagcccaaacgctcgaaccagcgacgcaccacgtcaaacgcgacagccgcacgaatatggccgatatgcggcgagctctgcacggtggcgccacacacgtacatgccgacctgaccaggcttgatcggcgtgaaattcgacacggcgtgcgatgcggtgtcgtacagcttcagatcggcagcggcgctcgccactgcgtcaactgcggttgcggcgctagaaatgttgatattctgcggttcttgcgtgttcgtcataaccacgagagtattgccagaatcggacatgcatgcgagatgaaaatgaacggcaaaacggtttttgttggatttgtgaacatcgtttacgtaggtgatgcaacaatagaacgtatgacgcaatcgcaggtgctgattttgcaacacgttccgtgggagagaccgggacgcattttagacagtctggatgatttgggactgcagtatcaaatcatcaatgtcgccaagcagaagaaaccggatttgcctgattttggcgaggtttccggcgtggtgatcatgggcggcccgatgggtgcgctcgactacgacaagtatccgggattaaaggccgaggccaagctcgcgcgggctgcggtcagcgttggcaagccggtgttgggcgtgtgcctgggacatcagatcatcgccaccgcgctgggggcgaagctgaagtcgggagatgctccggaaatcggttttgcgccgattaaatgcatcgacaagcatgattatttctcgatgtggaacaaaaccgtggatgtgctgcactggcataacgacgtggtgtcgttgccggagggcgcgcagccattggcacgatccgcgaagaccaaggtgcaggcgttccgttttggttccgctctgggcatgcagttccacttggaggttacccctactctgttggaggagtggcttgacgagtcaagcatggtcaaggatctcaaggctgccggcgggtcgaaatcgcagttgcgcgaggcgttcgccgaatataatccgcagttgcagccgcttgcggatcaggtgttttcgagttttgccgctcgttgtaattcgtatgggcagaatttggctcagtcgcagcagggctgatcgccgagttgcgtgcggctccgattgctgcgtagcgctggtggcgattcgcaagttgcggcattgcctgcaggtttgggagatgttcccgctacattggtgacttatgccgacttatgatttgggacttgaacacgtttcgcttgcttttgcgaccaagaatattttcaacgatgtaacgcagggtgtttttgaaggcgaccgcatcggcatcgtcggtaagaacggcgacggcaagtccacgttgctgcatttgttcaaaggcacgcaggagccggactccggtcgcgtgaccattcgcggcgggcttacgctcggcatgctcgaccagcgtgacccgctcgacgacaacgccaccgtgcgcgaagctgcgctcgaaggccgtgaagactacgaatgggctgcggaaaccaagtcgcgcgaaatcgtcgaagcattgcttggcggcatcagcttggaagcgaaaatcggttcgctttccggcggtcagcgtcgccgcgccgatttggcacgcctgttgctcaaggattgggatattctcgcactcgacgagcctacaaaccatttggatgtggtgaccattcactggctggcggaacatttgaagaaccgttggccggccggatccggcgcgctgctgctcgtcacccatgaccgttggttcctcgacgaagtgtgcgaatccatgtgggaggtgcatgacggcgaaatcgagccgtttgaaggcggctattccgcatacatgctgcagcgcgtggaacgcgatcgccaagccgacgtgcgtgaaacgaaacgtcgcaatctggctcgtaaggaacttgcctggcttacccgcggtgcccgcgcccgttccaccaagcagaaattccatgtgaaggccgcgcgtgagctcatcgccgacgtgcctccggtgcgcaatacgctggaattgaagcaaatggccacatcccgcttgggcaagcaggtggttgacctgatcgacgtgacgcagattttcgaacatgtgcaaggcgaggccgatatcgatcctgacgttgccgacatggaagcgtcggcatcgcgcgtcgatgtggtgccggccatgtatgccgagccgcaagtgcatggttccgtggaagttgccgtcgacgatctgactgatccgcgattggtggatgccggtgttgcagcggcgcaagttgctgcagctgcgaaagaatcgcaagaaattcaggaatcgcaagaaaataatactgatgattctgcagaagaaattacttctgcagcgcaaaaaattactgttaccggtcgtaagattcttgacgacgtgacatggctgattgggccgggcgatcgtttcggcatcgtcggcgcgaacggtgccggaaaatcgacgttattgaagattcttgacggcacgatcacccccactgtaggtcatgtgaatatcggcaaaaccgtgaaattcgcggtgctttcacagcgtctcgacgaattggagaagctcggtaaatacaagatcaaggaagtgctgagccgttacaagccgagctatatcgtggacggcaaggaaaccacgccggggcagatgatggagcgtctcggattcgagtcggcgcagctgatgacgccgatcaaggacctatcgggtggtcagaagcgtcgtatgcagttgctgctgatcctactggacgagccgaacgtgctcatcatggatgagcccggcaatgatctcgacaccgacatgctcgccgtgatggaggatctgctcgacacttggccgggaactctgatcgtcgtctcccatgaccggtatctgctcgaacgcgtcaccgatcagcagttcgcgctgatcggcggcaaggtgcgccacctgcccggtggcgtgcaggattatctggacatgactgaggccatcaagaacggcaagaatccgtttgcggacgaaaaggcaggtgccggcaaaggcaagaggggcggttccgctgggactgccggttccacgaccgaaggcaccgcaggcaactccgcaagtgggtctgcgactgctgaaaccgcatcttccgcgccttctacgccgaaactttccggcaaggcctttcacgaagcctccaagcgcgtatcggcaatcgagcgcaaactcgccaaactcgaagagcagaaagccgatcttgagcagcaaatggccgcgcacgaccccagcgactacgagggcctaggcaagctcaacgaccagcttcaagccgtcaccgacgagtccgaagaacttgaactcgaatggatggaactctccgaacagctcgagtagcattcgtatcgcccgcgtcaattaccggacagggtgtgcatgttgtggcggcggcgcagctcctccagcgtttccggtgaatgttggccattcgtgcgacagcgatgcgtggcattccatgtgccaatgtcatattcttgttattgcaggaaaccttagctgttcttgtcggagagaccaatggaggtgccttatgaatcaagtgatgcgaagaagcgcctgttgcttgttgtccagcttgttgttgtggtcatgcgttggctgcacgaaagctgcacatgaaagtttcggtgatggctccgtacagagcggcagcgagcatgatgatgccgcaaaacaggcatataaagcatttactgtggacgctctggatcgtgtcgccgtcgatgatctcaatagctcgggcaaactggttctagtaaacaagttgggtgcgaaatccgtacatggcgatgatgctatttcatttacaaaaacagttgatgacagcaatatgtattatgtcatctccatgtgtaagcagaaggagcaggctccttattcgtttgttctctacaaagatggacagccacacaccctaaccactagggaggcctgtacatctaacggaatagaaacgatctctctcccggcgaagaatttcccagatgccacctcattgtccattatcaatatcggcaatacggatcttgttgtttccgtatatgaagtaaaggaaccccatcatgaataatttcagtcataatgctccctgtcgtcctgccatcatcatagtttgtgacatcacaatgaatgctactgggctagttgttgcaaaactggctcagtaggtagatggggtagtaggtaatattgtggttggtttcgatgttgccggggccgaaaactaatccttggtgaaggtgataactttcctctgccaacacattattaagcgctcgatgaaccttgtttgatatcttcttgcgcctggcgaacgtctatgagactgttgttttgcgcaaaagatgctactgcagctggcatgactccaatgatcagatattttctgaatatcgcagatctgacaacaaaaagggctttcccgcgttgaaacgggaaagccctgtaggtttgggattaggctgattggatcagcgaccggtgatttcggagccgagcaccttttcgctcaaggccttcggaccgcgcgtcactgcgaccgcgccggaacgaaccagctcgataatgccgtaatgctccaaaagccccagcagcgcatcaatcttgccttcggcaccggtggcttcgatggtcagcgattccggattcacatcgaccacgcgcacgcggaacagacgcacgatctcaagcacgtcggaacggttggattcgtcggcagttaccttgataagcaccagttcgcgctccacagtggtgttcggatccaaatccacgattttcaacacatgcagcagcttgttgagctgcttgatgatctgctcgagcggcacctcatccacatcggcggtcaccgtgacacgcgaaatgtcaggacgctcggtgggggagacggacagcgagttgatgttgaacgcacgacgggcgaacaggccggcaatacgcgccagcacgcccggacggttctctacgagcacggaaagcgtatggcgcttggaacccggctgagatgcaggatacattggtagacccttccttactacttactcgtttgctcgtttactcgttgtcggcagcggccttcgggcgctgcagcggcttgattccgggcatataggtgacattgtcgttggaatcgccagctgcgaccatcggccacaccatagcgtccttccacacgcggaagtcgataagcaccgggcgatcgttgatttcgttggccttcttgatcgcctcaatggcttcttcttccgtgaacgcacgcatgccgatgcaaccgtacgcttcggcaagcttcacgaaatcaggaacatccacgatttccggcgtattctctccatccatcagattggtggcggaataatgctcgccgtagaacagggtctgccactgacgaaccatgccatacacggaattgttcagcagcgcgatcttgactggcgtgtgatcgtggaacgcggtcgccagctcttcagacgtcatctggaaggaaccgtcaccgtcaatcagccacaccggcttctcgccctcatggaaacgttcggaaccgacacgagcgccgatggcggccggcagtccgtaacccatggtgccaaggccgccggagctcagccaagaatgcggcttctcgaaatcgatgagctgcgtggcccacatctgatgctggcccacaccggtaacccaaatcgtgtcagaatcagccaggtcggaaagctgcttgatgacccactgcggagcgagcgaaccatcggtcggctcgtcccacttgatcgggtacttttcacgccaatcgttgatgatctcccaccaatgcgaagtgtcaggcttgccatgcacggcctgctcgcgcttgatttccggaatgagatccttcagcacggttgccacatcgccaacgatcggcacatccggctgacggttcttgccgatttccgccggatcgatatcaatgtgaatcacacgcgcacccggagcgaaagcgtcaagcttgccggttacacgatcgtcgaaacgagcgccgatcgcaacaagcagatcgcaacgctgcacggcaccggtagcggcaatcgtgccatgcatgccaagcatgccaagcaccttcggatcggaatcaggcacaacaccgcgtgcgggcagcgtggtgacgatcggagcgttcgtgacttccgccagctcctgcacgagcttgccggcatcggaacgtgccgcgccgccgcccacatacagcaccggacggtacgactgctcgaacagcttcgcagcgtcggaaagcacacggccgtgcgccttcgtggtgggattgtagccgggcagaatcatgcgctgcggccacgaatagtacatatcgccggtctgcgcggttttggtgacgtcgaccaccaccggaccagggcggccggaacgtgccacatagtgcgcttcagccagcacacgcggaatgtcctgcgcacgcgtgaccagataggagtgcttgaccaccgggtaggttgcgccgacgatatcggcttcctggaaggcgtcggtgccaatggcgttcacgccgacctggccggtgatgaccaccatcggcacggaatccatgttcgcgtcggcgatcggggtgatcatgttcgtggcgcccgggccggacgtgacgatgcacacgccgacctgaccggtcgatacggcatagccttcagccgcatgacctgcggcctgttcgtggcgcatcagcacaaaacggaagctggtttcatcattgattgcatcgtataccggcagaatcgcgccgcctggaacgccgaaaacatccttgacgcccagatcttccagcgaacgtaccagcgcttcggcgccggtcatcttctcgccgtcaacaatggtctgcttttcagtggttgcggctgccttgggcatgccgctgaatgcctgcaggggcgtaggtaacaccatgttccctctcatattcgctcgtggaactttcttacaggggtatgctgccgcgtttcggtgcacgcaatcagccgaaccccatcatcggaaagcggcgcaatcgcttgtggcgacttgcgaatcgcaatccttcgctagtaatcagtctatgctatcggctgacaggagaatatgccggattcgtgccatattctggcgtattgcgttccgcggcggtatgagagggcggattcgtagctgctttttatctacctgcgactacttactggtgttttcgccgttgctgccgttactttcgttgccgctgtgcttgtgatgatgtttgcgatgcttacggacgttttgtgcttcaggcttgcgattgtccagtgccttccaaccttcttcggctgcggcgagttgcgccttgcgtttgctggtgcctgtgccggtgctgatgatttcgtcgctttcgcccagcatgacgttcgcagtgaacacttgcgcatattccggaccggaaaccgacatctggtagcgcggttcgccgaagcccatgccatgcgctttgacggtaagcgaggttttccaatcgagagctgggccttccgtcgcgacttccgcaagcgtttcgtcaacaagatgatgcacaacgcgacgtgcctcgtcaatgccatgctgaatgaacgtcgcaccgatcaacgattcgacgatatcgcacagaatcgagcttttatcagcgccgccctgatcgctttcgccatgaccgagcagaatgtacgggcctgcattgagcttttcgcgagcgattttgctcaaggattcctcggaaacggctttcgcgcgcattttcgcaagctgcccctcgttcatgtcggggtgtgccttgtacagggtttccgtggagacgagctcaagcacggcgtcgccaaggaattccaaacgttcgtagttttttgcgcccggattctcgtgcgagaaggagcggtgggtgagcgcttcgaccagcaggtcgggttcgagcgtggtgccgagcgcttcaagcagtgcgttggcggtcatctcgccttcggaaacggcggatgcgtcggcgttgttctgggtcataatcgtcctcggtttcgtagtgggtatgcgacggcgaagctcgccgcgctgttcgggacgttgcgtacgtggcaacaagccagcgaatctggccgattgctatgcaaacaacgatcccgttcagtctactctccacccatgtcgaggcggaaatgcagggaaatgcgcggatactaggtggatgcgatacttggcggatgcgaggtgagatggtcgggtgcatacgaatgcatatggccaagtgcgcagcctgaaatatacaaaaccctgccacccgtcgatggcagggtttcaatgcttcatgccgttactcggcagccactcacttggtgtggatggagcggacagcctcgcggtacacgcggccgcggtaggcgccgcagctcgggcaggccatgtgcggcagcgccggagcgccacagttcgggcaggtaacggtctgggcggccttggccttccagtttgcgcggcgagaatgagtattcgcgcgcgaggtcttgtacttaggcagtgccattgtgtttcctctgtttcgttcgaacgattgagcttaagcgttcagtatcttaacttgtgctccgtacaaattgcaaaacccaagcaaaatcagccctgccagcacccggatgaaccttactcgttgccttccagccgggccttcaagccttccaaagcggcgaaacgaatatcggtcacatcgtgatgatggtccggatcctcgttcagatcggcgccgcactgagagcacaatcccaagcaatcaggcttgcacagcggctgcaacggcagttcctcgaccaacgtgtcgcgcagaagcgtctcaatatcggcccaggatccgccttcaagcagcggatacgaatcctccgactcgtcttcgccggcgataatgtcgacttcctcttccttgacgccgcccttgccgtttttgccgcccttgccggacgcaacgcttgcggacttgtcttcatatgggaagaacgaagtgacgttcaccgtccaatcgcgcttgatcggtttcagacagcgggtgcattcggcgtgcacgggggcactgatgcgggcgttgaaaatcaggccgtcgacaatggagtcgaacgagccgacaacggtcacatccgcaccctcctcaacgccgacgatctcatcgccgatgccgctcggtgcggggaacgttgcgtcgatctccttgctttgcccggctcgcgaggcgacttgcgccacggaaatcgcccacggggaatcttcgatacgtgccatgttcagccttccattcagctttccggatagtcgtttgcgtcaagatgcggcacatgcgtgcttgcttcgcgctggcgatcatacagtacgttcaatcccgcctgcacgtcgttgccaagcttgccgagctgctgttgcagcgtttccatcaccgtggtgcagtatttgtcagctccctgcgtgagatggtcggccctggcttgcgcttggtcgagaatagcacgcgccttctgccgagccagttcggtcacgttttcctgcccggcgaggaattgcgcctgctcgttggcctcacgtatcgtgtctgccgcacgcgattgcgccgaagcgacgatggcgttggcttgcgtttgcgcgctttccaaacgtcgttccgactcacgcatcaacgccgaggcgcgttccagctgcaccggcatcattttcttcaactggtcgagctgttcggtgaattcgtcgcggtcgacgcgcacgctgccggggaagaacagtatcggtttcgcttcgtccaatgccgattcgagtttgtcgataatgtcgtacacggtggtgaattcgtcgcggctcaaatcgttggaatcgtccagcggcgcgttgggattgaacgtgttgcgtaaatccggcagatcagacatggaaatcaacggtttgaccggctcggcggcgcgtgccgtggcttgtgccttctgaccggattgggccgcccgatcggtcgggcgttcggcggtcacgtcgtcgtcaaactggctgccggccggatcgtacgcattcgtttcttcacccatcatgccctcttttcattattgagcgcttctccgagtagcggaatcacgcaatcaggcaccatgccggtcacatcgccgccgtgacgtgccacatctttcacgatcgaactggagatatgttccaaatcgggcgccgccggcaaaaacagcgtttccacgtcggcaagcttgcgattgaccagcgccatacccaactcggcttcataatcgccattctgccgaagccccttcacgataaccgtcgcaccgaccttcttgcaatagtcggtaatcagtccggttgttgaagcaaccttgatattgcggcaattccgctcttcaagcgccttacggataatctcaacgcgggtctcttcggaaaacatcggtgttttcgccgcgttcaccgccactacgacatgcacttcatcgaaaaaacgcgcgcaacgttcgatgacgtccaaatgtccggcggtcactgggtcgtacgacccggggcaaactgcaattgtcatagcctcaagcgtaccgcgattgcgtgaaattacgcgaagtgtcggcgaatatgtgggttttcatggctatgatggaggcagtggtgccgcggttgcggcgtatttgaggagttgattatggcatgttcgatattcgatgatcgcgacggcttcattgacgaggccgacccggtctcgccgctttccaatcccgacgcgggtaccggcactgcggtgctggaacgccccgaagaggagacgaagcttgatgatggcggcaacggcgatgcggatcgtttcgcccattatgtgtcgcgcgatcgcattgccgagtcccgtcgcaccggccgaccggtggtggcgttgtgcggcaaggtgtgggtgccgaagcgtgatccttcgcagttcccggtatgtccggattgcaagcgtatctacgacgaaatgatgaattccaatttctaatcgttttttatctctttcatcgtatggtgatcttggaatttcgttgaaatttctgaagattgccgaaagtgattacatataaaaaatctgccgagacaatctcaatcatcgaaaaataatttcgatatagagaccatctcggcagattttttattgttgttgcgtcttatatctgctgatatatccgcgtttagcgcaacgaaatttcgtcgatgcgacgcaattcctcatcgctgaacgtggtgttcttcaacgcgccgatattgtcgagcagctgctgcgggcgggaagcgccgacaagcacggaggtcacgtaaccgtcgtgcagcagccaggcgagcgccatttcggcaagcgtctgcccgcgttcggcggcaagatcgttcaggtcgcggatctgctgcaggcgttccggcgtcaacgcgctttctttgaggaagcggccgtcgtgcgcgatgcggctgtctgcgggcacgccgttgagatagcggttcgtgagcagaccctgttcgagcggcgagaacgtgataagacctttgccaagctttttggcggttttcttcaatccgttgcgttccacggtgcggtcgaaaatgctgtaacggttctggttgatgatgaacggcacatgcagctcatcgaggatcgcggtggccttttccagcgtcggaccatcgtaattgctcaggcccacgtagagtgccttgccgctttgcacggcggttgccaacgcgcccatggtttcttcgagcggcgtggaggaatccatgtggtgatggtagaaaatgtcgacatagtcgagaccgaggcgttcgaggctttggtcgagcgaggcgagtagatatttgcggctgccgagatcaccgtaggggccgagccacatttcgtagccggctttggtgctgatgatcagttcgtcgcgatgatgatggaaatattcgcgcagcagacggccgcagttcttttccgcactgcccggctcgggaccgtaattgttggcgagatcgaaatgtgtgatgccgttgtcgaatgcggtgaacacgatgtcacgcatagtggcgtacggcgtgatatcgccgaaattatgccaaaagccgagcgaaaccgctggaagtttcaggccgctctcgcccacatgattgtaggtcatggaatcgtatcgagcgggtgacggcgtgtagacggtggtcggttcaagcatggttcctccttgaaaactctgcgtattccgctgtgcgctgtgttgtttgagttggcgcatgtcgtaagtttgtcgacgatactatcgtcgcacttcaagtaaacttgaatgcaagtatcgtcgatagtgtgttttccgatgattgacaatcgcaaggaatcgcaaaatcgctagaaaaacctagaaaatcgtagaaatgagaaggggaatggcaacatatacgattcgtgaagtcgcgcaacgattccatgtgcagacgtcaaccttgcgctattacgaggatcaggggctgctgtgcgacgtggagcgcgacgatgcggggcgacgcgtgtacaccgactcgcatatcgggcggctcgaggcgatcgcctgcttcaaacatgcgggcatgagcatcgatgaactcaaacgcttcttcgcatacgaaaaagacgagcgtgcgcacattgcggacatgctggaattgttggaatcgcggcatcaagcgattttgaaacagcgggccgcgctggaagaggcgtacatgcatgtgttgcgcaaactgcacttgtatcgcgatattcagcacagcatcgaaacgggggcgccatacccggattgggcgaattatgatggcaaggattttcgcgccgacgatcagtgaagttcggtggactgacgaagatcagtgaagactggttggcgaagggcggtgacgcccagttggcgaaaaagcggaaaataaaaggtgtggaaccgcaaactacggttccacacctttagaacacctagcagaacgtctaatagagactgctgcgactcgtttcagccctacttcagcagagtggccacggatggcagcagggcgcgcaacgccttgccgcgatgggagatggcgttcttttcggccggttccatctgcgcggacgtgagcttctcgccggcttcgacggcacgcgccggctgatcgtcgggcacgaacagcgggtcgtagccgaagccatgctcgccatgaggctcatgcagcagcacgcccggcatttcgccggtttccacgatttcctgagcgatcgcataacgaccatcggcgcctgcgcctgcttcggtttgcggcaccaccagcgcggccgcgcaacggaaacgcgcggtacgcttggcatccggaatgtcggcgatctgcgcgagcagcagcgcgttgttggctttgtcatcgccatgcttgcccgcccaacgtgcggaaagaatgccgggggcattgcccatcacgtccacaatcagaccggaatcgtcggcgattgccgggcagcccgtacgtgcggccacatcacgggccttgagcagcgcgttctcttggaaggtcacgccatcttccaccggatccggcagattcagcgaaccggccgacaccagctccacctgatctgcgtccacacccaggcaatcttccagaatgcggttgatttcaacgagtttgccctcgttatgcgttgcgacgatgattctcacgttccgattcctttcgttgctgttcgttgcttcgttgatgtcggcttgcctgacgtgcgtttgacgtgccctgacttgcctaacctacgattggtttgcgaggccagcctgcggtcggcttacgtccgacttgcagccttcagtcctgtgcgagcgcggactgctgtgcggcctgcagttccttgttgcccttttccgccaggtcaagcagcgcgttcaactcggcgcggttgaacgggcggtgttcggcagtgccctgaatttcaatgaattcgccggaaccggtcatggccacgttcatgtcggtcatggccttgctgtcttcgatgtacggcaggtcaagcatcggtgtgccatcgatcacgcctacagacacggcggaaacgctgtctttgatcacgcgctcggcggacctgatgtgcttgtgcttctcggcccagcgcatggcgtccacgagcgccacatatgcgccggtgatcgacgctgttcgggtgccgccgtcggcctgcagcacgtcgcagtcgatctgcacctggttttcgccgagtgccttcatgtcgaccacgccacgcaggcagcgaccgatcagtcggctgatctcatgcgtgcgtccgccgatcttgccgcgcacggattcacgatcggtgcggtctgcagtggctcgcggcagcatcgcatattccgcggtgacccagcccaagccggagtccttgcgccaacgtggcacgcctgcggtgaacgtggccgtgcacatcactcgcgtattgccgcattccacaagcacggatccttccggaacatccgtgaaatgacgggtgatgcgcaccggacgcagctcatccaccttgcgtccgtccgtacgaatcatcgtttcgcccaacaagtctttaatcgctaccatcgctgacttctctgctttcgattgatcacacgatcaacaatcgtttgtattttccgaaaaaacagtatcaccagccgaaaacccgtctttccgtcttgaactcgcctcttgctgcacctcaatttgcctatcccaatttgcgtcgtgcccgaatttgcgcgcatctcacgtttgtctcacgtaatacaggcatgtaagcacgtatgatggaacgaaaacctgtgcttggccacggcgaggcctacacttatggtcagtttcaccaaaagtcagaaaggctttggaaatgctggattattcacctgcactcatgaccgacatgtacgaatacaccatgcttgacgcgtgcctgagggacggcaccgccaatcgcaagtgcgtattcgagattttcacccgtcatctgccgcttggccgccactatggggtggccgccggccaaggtcgtattcttgacgcgcttgaaaatttccatcttgacgataatgatctgaaattccttgcagatcgcaaagtagtgggccccgaaactatcaaatggcttgagaatttccatttttccggttcgatcaagggatatcgcgaaggtgagatgttcttcccgaattcgccgattctgcaagtcgaaggcacgttcggcgagtgcacgctgctggaaacgctgttgctgagcattctgaattacgattccgcggtcgcgtcggccgcgtcccgcatggtcagcgccgcgaaggatcgcccgtgcatggatatgggcgggcgccgtacgaacgagtgggccgccgttgccgctgcccgtgctgcggtagtgggcggattcaagggcacggccaatctgctggccgcgcaaatgtatggcttgaatgccatcggcacggccgcgcactgcttcacgctggtgcatgatgatgagcgcagcgcgtttgaatcgcagattgccgcgctcggcaagaacaccacactgttggttgacacgtacaacattgaagaggccgtgaagacagctgttgacgtggccggaccagaattgggcggcgtgcgcatcgattccggcgatctggcgtcgttggcgcagcgcgtgcgcaaccagctggatgcgttgggcgctaccaacacgaagatcaccgttaccaacgatttggacgagtatgcgctcgcttcgctgcagaccgcgccggtcgattcgtatggcgtgggcaccatgctcgtcaccggatcgggcgctccgacctgtgcgatggtgtacaagctgactgaacgcgagaattccgctggtgacatgcagccggtggccaagaagtcgaaagacaaggccacggttccgggccgcaagctcgccttccgttcgtacgagtatgcgctggccgactgcgaacatgtgatttccggctccgaagagcagctggccgcctatcagccggaagaaggctggaaggatctgctggtcggctacgtgagcaacggcgaaatcaactccgattatcagggccacgaagccatcgtcaacgcgcataattaccgcgcccaggcgctggccgaactgccgatcggcgcgcaaagcctcatgaagggcgacccggtaatccctaccgaaatcaccgtcctttgactcgtgctaccatcatgctggttgcgtacggcaatcaatctcgtaatcaaccagcatgaaggggtaggattacatgcgagcattttctctggttacgttgagtccggaggcgtttgacgatttttccgcacatcacgcggacggcaactttcaacagacctctgccgcaggccgtctgcgtgccggccaagggatcgaagtggaataccttggcgttcaagaaaacggcacaatcgttgcgggagcgctgttcgaaacgcatcgcagccgcctttccaccttcagtgtggtgcacgacggccccttatgtgactatcgcgatcgcgaattgaccgaatatttcatgacccaactcaagcagcacgcgaaggcgaaaggttccgcacagatggaaatcgtgccggaaatgccatactgcctgcatgactcgcgtggcggcgaactgccagccgaccaaggtggtgctcctgctgatgatgccgtggaaacgttgaaaaacctcggcttcatgcatgacggcttcaccatcggctacactgcggtgccgcgctggcgttacctgaaagacctgactggcattaccgacgaaaagtcactgctcaagtcgtatgacaagcgcacacagtggagcgtgaaacgtgccgcatccatgggcgtgcatgtgcgcgagctaggcgaagacgagctgcaggtgtttgccgacatcgagcaggccaccgccgaacgccgtaatttcgaatatcgcggtgaagcctacttccgcaagttcaagcaagcttacggcagtaaagcccacttcatggtggcgcagattcacatcggcgaatacattgccgacatggaatccaagtgtgacgccttgcggaagaaggtcgatgtgctgcaggccaagtacgacgagcatccgaccaccaaaacggaacgccagctaggggaggagtcccgaaacttggcggcggcggaaaaacgtttgaccgaggcggccgagtacgccaaagacggtgacgtgcttccggcggcagcatccctattcgtggaacacgctcgtgaaacggtgtatctgttctcaggcagtgtggaaaagtacaagccgttctacgcttccgcgctcattcaacatgatgccatgctgcatttgtgtgtggaacgcggtgtgacccgctacaacttctacggcatcaacggcgtgttcgacgatccggaagatgagggtcgtggcgtactcgaattcaagcaaggcttcaacgggtacgtcgaggaactcatgggctcattcgtgcttcccgtacgcccgctgaccttcaaactcaagaccgccctccgcgaactcctgcgccactagctattagctcaccttccgcttggaggattctgggtgggggcttataggtgcgcgagggttatgtgaacgctgttgacggcgactgtaggccggactaggttatcgcttttggtgaaaagggattttagccagttgggatagtgaaaggtagttacggatcgtgatgcgcgaagtgaatgcgagtgaggaacaagagcaagaatcgtctgaatggaatgtgcgcgagctgagcggtagtgagtttgatgagctttccgccgcgagcagatacggcggattccagcagacttccgaaatggcggcattggctcagtccgacggcatgcaaacgcaatacgttggattggtggattcgcacgatgctccggtggctggcgcgttggtggctttttcgcaagggcgtttcggcgtggaaggctcgttatggcttggcccgttgtgcaatgggaataacagagagcagatgaccgcgttgaccgaaggtttgcgcgaggctgccgaacgggttcacgccatcagcctgacgtgctggcccaaccaggtgtattgcgttcgtgattcgcaaggcaaggccatggccgaacccaatgatgagatggtgcgggagtacgagcggctgggttggaagcatgctggctttacccgtggatacgatgccctgatgaaccgttggaattacgtcaaggacttgagagagttctcgaacgccggcgagctgctcgcttcgtatgcgaagaacacgcgtcgtaacgtcaagatcgcgcggaacagcggcgtggaggttcgacgcctgaatcgcagtgagctgaacgtgttccacgatatttgcgagctgagtagcgaacgccagcatttcgccaaccgtagccttgattacttcgaacgcgtatatgatgcgtttggagacaaggccgagttcatggtggcggaagtgcatcttgaccgctatttgcaatcctgggaggaaaagctggcgaagttctcgaaagacgtggaacgctgggagcgttcgcttgagcatacgaagtacccggatgatgtgcgcaagaagctcgatacggctcagaagaatgtggagtccgcacgtcgccgcattgaggatgcgaacgagcgcatcgctcgtgatggcgaggtggtgccggtcgccgtaggtctgttcatgtggcatgaacgcgagctggtgtatttctccagcggatccgacgatcgttacgccaagttctacgcgcccaccgccttacagcatgagatgatgtcgcgttgcttggaacgcggagtgacgcggtacaacttctatggcatttcgggagtgttcgacgatccggaagacgatggacgcggcgtgctcgagttcaagcagggcttcaacggctacgttgaggaactgccgggcgaattcacgcttccggtgagcaagctgcgctacggcgtgagcgatttggcccacaaactcctgcgccactagctttagggggtttcggccatgcttggcgcgacgcggatttgcgtggggtgagactttctggtacgctttgtgtcttgtgcgcggatggcgtgtgcttccgggcattgccactttagctcagtcggtagagcggctcactcgtaatgagcaggtcgacagttcgattctgtcaagtggctccagcgccctagatgtgaaagcatctagggtttcgcgtatcaggagcgtttcgccccgatatggctacttgcgcgagtggcggaattggtagacgcgcaggatttaggttcctgtgtctttgacgtgtgggttcaagtcccatctcgcgcactttcagaaaacggcggaattccgccagttcttggtcattgtagtccactcaataagcctttttgagaacatgttgaaaacattttgcccgtttgcgtcccaattcttccactgactggaggatttgggacgttggggagctcgtttgcgggtggattcttccactgactggataatttgggacggtggcaggcttatttgcgggtgaattcttccagcgggtggaggaattgggacgctgaggggcgcgtgagcggagtgtttcttccagtgggtggaagaaacaggacggtgatgggtggcttggtggcaggggatgctcctaagatggcttcgggtaggaagagaaagagatgattagggattaggggagtgtcgtgtctgcgctgattcagcctgttgcgctactgctgattattctcgccggatacttgttcaaacgtgccggcctgttcgaagatcgcgattaccgcattatgcagaccattattttcaatctggtgctgccaggcgcgatcgtctattcgtttgctacgaatccgcatgattccagcatgctgttgatttcgctgttcggcctgattgttgcgttcattccgccggtcgtggttttcttgacgtcccgccaccgaccggtgcagaaccgtgcgttcatgatgttgaatggttccggcttcaacgttggctgcttctgtttcccggtggtgcaggcgtttcttggcacgggcgcgatcgtgcccgccgccatgttcgacattggcaattgcgtaatggttgccgccggtacgaatgtgatgacgcaaacgctgctgcacatcaagcctggcatgccgcttaccgaacagtatcagggcaatgcgcccacgctcccgtatgtgaagccgaaagacaaggatgccaaacgtcttgcccgcaaggcgttggcccgcaacgtgttcaagggtttcttcggttcggttccgttcgacacgtacttggtgatgattattctcacgctcgctaacgtgaagattcctgacattattgccgcgctcgtgcagccgctttcgaacgcgaattcgttctgcgcaatgctgatggtgggcatgcttatggatttgccatctggcaagcaggatgtgcttcagttgttgaaggtgattggctggcgactgccgtttggtattgcgtttgctactgcggcttggctgctgctgccgtttggcgctgagattcgtgaggcggctgcaatgtgttgtttggcgccgattgcagtgttttccacgctgtttaccgacaaggtgcttggtaatgcgaagcttgctggttttacgctgtcgattactgcgattatcagtttgctgctgatgaccggcgctcacttcttgttcgtcgcgctcgcataagagcggcaaggagatctttaccgggtgcgggagattgtttgtgaccccgcagagcacgaagtcgttgaatgcttgcttgctggtagttgcagtgccgttttcttgtcgttcactgcataatgcgatcgtttcgtttattacatgtttggaagtgttacgaagacttgcaccggaaccatgcatacgatttcagtaatcgtcgaaaatgcgcatgtcgaagacggaaggttgtcggaaccgcgctatattgcgaatcttggcgaatgtgttaactcaggaaatatttttgtgttgttctgtcttcttttgtgagtatcttgtgaggtgaagagatacggaatgcgacacgcggaaatccgcagagaagccgcaatcgcatccgcttcatagtgatgatgaaaggacctatacaccatggccatcaatcctcctgttgacgccaccaagaccccggagtgggccgcactgcagaagcactacgatgagctgcagtccgaaggcatcagcctcaagcagtggttcgccgatgacgccgagcgcgtcgagaagctgagcttcgacgcgggcgacctgcacttcgacctgtccaagaacctgatcaagccggaaaccctgcagctgttcgcagacctcgccaaggccgtcaagctcgacgagcgcaccaaggccatgtacaccggcgtgcacatcaacaacaccgaagaccgcgccgtgctgcacaccgcactgcgccgcccggccgaagacgaaggcaagtacatcgttgacggacaggacaccgtcaaggacgtgcgcgaagtgctcggccgcatctacgcattcgccgacaaggttcgctccggcgaatggaccggcgtttccggcaagaagatcgaaaccgtcgtcaacatcggcatcggcggttccgacctgggtcccgtcatggtgtacgaagcgctgaagccgtacgctgacgcaggcatctccgcacgctacatctccaacatcgacccgaacgatctggccgaaaagaccaagggcctcgacccggagaccaccctgttcatcgtcgtttccaagaccttcaccaccctggaaaccctgaccaacgctcgcgaagcccgcacctggctgctcgacgccctcaaggccgccggcgcagtcgacggctccgacgagaagaacgccgaagccatcaagaagcacttcgtcgccgtctccaccaacctggagaaggtcgctgagttcggcatcgacccggccaacgccttcggcttctggaactgggttggcggccgctactccgtggacgcagccgtcggcacctccctcgccgtggtgttcggaccggaacgtttcgaagagttcctgcacggcttccatgagatcgacgaatacttcgtcaacaccccgttcgagaagaacgtggtcgtgctgctcggcatgctgaacgtgtggtaccgcaacttcttcaaggtcgcatcccacgccgtgctgccgtacgaccagtacctgcaccgcttcccggcctacctgcagcagctgaccatggaatccaacggcaagtccgtgcgttgggacggcaccccggtcacctccgaaaccggcgaaatcttctggggcgagccgggcaccaacggccagcacgccttctaccagctgatccatcagggcacccagctgatcccggccgacttcatcgcgttcgtgaacaccccgaacccgaccaaggacggcgaccaggacgtgcacgagctgttcctcggcaactacttcgcacagaccaaggctctcgccttcggcaagaccgctgacgaagtgcgtgcagagggcactccggaagagatcgttccggcccgcgtgttcaccggcaaccgcccgaccacctccatcttcggcgtggcactgaccccgttcgcactcggcgagcttatcgccctgtacgagcacatcaccttcgttgaaggcaccgtgtggggtctggactcctacgatcagtggggcgtcgaactgggcaagcagctcgccaagcagatcaccccggccatctcccaggatgacgaagcactggccgctcaggacgcttccactcagtccctgatccagttctaccgcgcaaatcgcaagttctgatttctctaaggattaaatagccttcgaaagggctctgcacgggatgcagagccctttttgctacccctggccatcttcaaaaggtctggcgggtgaggtatttttgaatattgctgtgccgggattcaggacgccgcataatcctgattcccttcgggtccagccgagaacaatcgcaagattgaacggaatgttgcacaaacgcaagttaccgtgattttcggcggattggcaatccttcgcaggcagacctgcggagaacatacgaggcagaacgaaattgaaaaatcgtgaagcccttacctgtgcgctgatatgcggcggcgactcgaggaaacacaatggttaacgctattgaggcatttgacgccaagcacatgaagccggccgaggaaatcccggcattccgtccgggtgacaccgttgaagtcaacgtgaagatccaggaaggcaacaactcccgtatccaggccttcaccggcgttgtgatcgctcgtcagggcggcggcgtccgtgagaccttcgttgttcgtaagatcagcttcggcaccggtgtggagcgtcgcttcccgctgcactccccggtcatcgactccatcaaggtggtccgcaagggccgtgtgcgtcgcgccaagctgtactacctgcgcaacctgcgcggtaaggccgctcgtatcgttgagcgccgcgacaactccgagaagtgagtttcaaacgcaaataaagcgtgaaattggccctcagcctcacggcaggagggcctttttctattctagaccgctatgataggggtcagtgtgcaaaccggacgataaaggaatcatgtatgaggcatgccaaagaagaaaacaatagcggcgacagctttggcttgcgcgacaccttggtctggtgcggaattcctattattatcgtgctgctgatacgcattttcctgctcggattctacgtgattccctccgggtccatgatgaacaccatcgaaccaggtgaccgcgtgatcacctcgaaactcaccccgaaagtcttcgatctgaaacgcggcgacgtggtggtgttcaaggatcccgaccactggctgcggcaggaagacagcagcaaactcggcggtgactacctcatcaaacggctcattggattgccaggagacaccgtggcatgcgaagggccaggtaagccgatcaccatcaatggtgtggcgattgacgaaagcgcatacattcgccccgacgtggatcccagctcattcgcgttcaacgtgaccgtgaccgaaggacacgtgttcgttatgggcgacaatcgcgccaattccgccgattcgcgctatcatcagggtgattcctcacatggacttgtgcctatttccgacgtagtgggtgtcggactcgcgaaatattggccgttgaaccgcatcggcgggctcgatgcgcaccatgaagtgtttgccgacgttccggaaggaggctcggcggcctgatggcggtttccgtaattcccacattggatttggaacgtgctattgccgaacaaggctacgatgtgatcgtcggctttgacgaagtggggcgtggatctctcgcagggccggtaatggttggtgcggctgcgatttgggcgcgtgacttagacgggccggctggagcttcgcaaggaggctcgcaagaatcttcgcatctggaagtgccgaaaggcgtggccgactccaaaatgctgaccgaacacaagcgcgaagccatcttcgacgaactcaaatcctggtgcgcatcttgggcggttggcgccgccagcaacaaggagattgacgagtggggcatttcccatgcactcggcgtagccgcgttacgtgcgttggcacaggcggaggcgaagctcggcattgacggcaacggcatgctctccggcaaaccggtgaaggtcggcgcgatcctcgacggaccgaacgattacatcaccaagacgctgaacaccttcgacgcgcccgaagtgccggtgccggcgaacgttaccaccaaagtgaaaggcgaccggtattgcgtcgccgtggccgctgccgcggtcatcgccaaagtcacccgggatcggctcatggtcgaactgggagcgcaaccccaatatgaaccatatgaatgggcccacaacaagggttacggttcggccgcacaccgtgacgccatcgctgaattcgggcccagcgacctgcaccgcctgtcctggcacctcgtctgacatacggcatctcatccgcagtccgcgattacgctaatccttgcggatgatgcatgccggaaggaaacctgtaagttcatcccgccgtctgatggccggggccaatccgtttccgtaccgtaggaaacatggaacacatacttcaggcgaccgatctggtcatggattattcgacccaacaggcgacaccaaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctagcgcggttgagcgacgctgaccgcaccaaactgcgccgcagcgccttcggcttcgtcttccaatccggacaactgctgccggaactgccggccatcgaaaacatcgcgttgccgatgatgctgggcggcgcaagctaccagcaggccaccgacatggccatgctatggctggaacgattgggattgcgccagctcgcgcaacaacgtcccggcgaaatgagcggcggccagatgcagcgcatcgccatcgcacgtgcgctcgccgcgcagccggcagtcatcttcgccgatgaaccgaccggcgcgctcgaccagaccaccggccacgaaatcatgagcattctcatgcggaccgcacgacagaccggcgcggccgtggtcgtggtgacgcacgattcgaacgtggccgcattttgcgatgccaccgttaccatgcgtgatggcaggttgagctcgccgcagcaatcccaacctaccgccggaggcgcacgatgaacatgttccgattatggcgattgttccaccgctccggcacccgcggcacatccggccgcacctctgcgctggccatcgttgccttcgcatccgccaccgccgtcttcctaaccgtgctcggaggcctgcatggcttcatctggcgggcctccgccgaccacacgttcggttgcatgatcgattccaacaggtgcgctcccggtacatacgaaacatggtccaaagccctggcgcacgccgacaagctcgtcgccacggtcggcgacggccattggacggccgaccaggccacagccgtcatgaacacctattccgacggctatgtgatgctcgccgcattcgccagtctgctactcatcgtgccgttcgtggcgctcgccggctcggcggcccgtctcgcggcctcccgcagggacgcacgtctcgccgcactgcgacttgcgggcgccaccaccgcgcaggtcacgaaactcaccgcgctcgatgcgggtggccaggctctgcttggcgcgctggtcggcatggccggctacttcgcgctgataccagcgatcatgctgctcgacttccaaaaccagcatttcaccttcgaacagttgtgggtgggactgcctgccctggcggctgtgaccgtcggagtcacgctgcttgccttggtctccgcgctggccgccctacgccgcgtggccttcaccccgcttggcgtgacgcaacgtaccggacaacccatgccgtccgcatggcgcgcactgattttccttgccgtgttggccgtaggctacctgctgctcaacagcatctccgcattcgcgcacttgggtcagatggtggtctatgccatcatcttcggcgtcttcttcctcggcttcgccatggtgaacgtcgtcggtacctgggtggtggcgatgcgcgccagatcgcgtgcgaaacacccgaaggacgcggccactatgattgccatgcgccgtatcctcgacaatcccaagcgtgcttggcgcaacgtgtccggcgtggcgctcgctgtgttcatcgcggggatgacgtcggtgtgcggattgctcgccaccggaatcggaggcaaccacgacccgttcgacccatctgtgctgtacatgcgcgatatagcgatgggtggtttcctgacgctcgcctttgccgcggtgctcgccgccgtcagttccggcgtgatgcagacgagcaacgtctacgaccaggccgacgagtaccgcatgcttgcgttggaaggcacggatgaggcgacgctcgacaaggcacgcatgatggaagtgatcaccccgctcaacacggtgatggccgtttcattagggtgctcggtgttgttgctgtttccgattctggcaacgtcgttgctcaatccggcttcgttgcttacgttggccgcgggaatcggcttgtgttatgcgctgatggtgctcggagggtgtgccgcgaatcatgcggcgcacgggctcggtcatgccggctaccgtacggacgattgatggtctcgccgcggcggtcgtggataccgcggcgaggactggcgaggtcagccgagcagcaccgcgatgattgcgatgaagatcggtgaggtcagtgtcgagaagagaatgccgtcgcgtgcgaacgagagacccacgttgtaccgcgccgcgtagttgtagacgttctgcccggtcggcagggcggcgagcaccacgcacgcgtacaatgtggcgccgcggaagcccatcacgaaatacgacagcaggaacgcgataattggcatcacgatgttcttcaataccgccaccgtgaacaccgcgggaatattcgacttgtcctgcagcggcttcgtgccgtgcaacgacatgccgaatgccatcaaaatcattggcactgcggaatcgccgatcatgtcgatcggatcgtaaatacagtccggcaccacgaaatgaccggtttttgcggaaatcgcggatacggcgatgcccagcagcgaaccgataagcagcggctgatgcagcggctgcttcagaatctccctcgtggagaccttgcctttggtggtcacatcgagcacggtcaggccgatcggtgtgaacaccgcctgttgcatgaccagaatcggcgcgaccaaagcgggattgcccagaatgtacgtggcgatcggcagaccgatgttgttggagttcagatacagcgaattcaacgcgccgatggtggcatccgccgccttcagatggaagaacagcctattgaggatcagaaacaccaatccgaccagcacggccgagaagaacgccacaacaatggaggagtggaatatctcgaagattctctccttggccaggatggcaaacatcaggcacgggctcgatacgaaaaagctgaacctgttgagcaccatctgcgcggtaggtccgcctatgcgcatgcgcgcggccacgtaaccggtgccgatgacgatgccaatgacgcagaagccttccaatgcgcttaacagaccaggcatgacactcttcctttcgctctcggccgttggtttggccgctatccagtgttgcaccatgcatatggataacatccgatccgtctcaaaagcgttgtcgaacggcgatgtcggttccggtggtgctggataatgggcggtatgaacgaacttgagattggattttccgcttccgccaccaggcaggagcagctgaacgagctgatgacccagatcatgggaacctattccgtgagcgacgacgaagggccgttgaccgacgcggtcgaagcgtttttgaataaacagcagcatctgacagtgcgcaggcatggcgatacgctggtcgcatccacgaattttgggcgtgagcgtcgcgtgatcctcgccgggcatctcgacacggtgccggtgatcgacaatttcccgccgcgttggctggaaccgggcgatccgctgattcgcgaggatgttgccgccggccatgggcgggagcgcgtgatatgggggcgcggtgccaccgatatgaagggctccgacgcggtgatgatgtatttggcggctgcgttgacggatgcgaaatacgatctgacatacgtgttctacgaccacgaagaggttgccgccgaaaagaacggcctacgcaaggtggtcgaggcgcatcctgattggatttccggcgattttgcgattatcggggagccaaccgattgcggtattgaaggcggctgcaatggcacgatgcgtttcgacgtgatcacgcacggcattgcggcgcattcggcgcgagcgtggatgggcaagaacgccattcatgcggccgctgagattctgaaccggctgaacgcttatgaaaatcgtgcgattgaagtggatggcctgacgtatcaggaaggcctgaatgccacgctgatttcgggcggcaagggcacgaatgtgattcctgatgaatgccacgtgcatgtcaactaccgttttgcccccgacaagtcgttggctgaggcgaaggcgctgatgattggcgcggatgccggtgcggaattgggcaatggcgagcatgttgccacaggtggcgtattcgaaggcttcggcattgaaatgaaggacgagtcgccttccgcacgtccggggttgacgtcgccgctcgcgcagtcgctggtgaaattggtgcgcgagcgcacggggcgtgagcctctggccaagcttggctggacggatgtggcgcgattctcgatgctgggcattcccgcggtgaatctgggtgcgggcagtccgttgctggcgcacaagcatgacgagcagctgccggaatcggatctgctgctgatggccaacttgcttgaagactggctgaagtagctgtctgctgcctttttctgcctcctgtttctgcctgctatcggctgtttgttgttttccgtcttctgtctgcacaagtcggatcggctgtctgcacgagtcgtaatctgtgtctgcatttctcgcgaatcgtgatttctttcgacttgtgcagacggagcaacgacttgtgtagacggggcctgggatttgcgggcggggaaagcaggcggtgagttgcaggatccggaaaatttcccgtcatgtcacgttccgttgttttttgtgtcatacttatagacggtggttctgcaaatcaccaatgcatccgatggcgttgatcccctcgcgtgaagttcatgtgtgtccgcgagcgctggtgtccgccgtcgcatgatgaggacttttgacggaagttgcttcctacgggcgccatgatgcgcggccacggtgagagcgtggtgtgagaaccgtatgaggcctaagcgtgggcggcgcgattgcagcgtgtcgtcgaggagccattgtgcctaataccagtgagggcttcgatcaggtcgaagcttcggcatcgcctgagcatgccgtgaatgttgtgaaattcgagtcggtccagtccgatcctgccccgcgtcgccgtcgtggcggtcgtcgcgtggtgcgtggcgtgggagctgccggtgcgtccttggagttgaaggtcgaggagcatgcttcggctccgctgttcgaggagccgaagttgccggttgcgcaacctgcgcatgataccggtgattccgctgattccgagggtatgacccgtccgacccgtcgccgtcgtcgtccggtccagtccgatgatgatgttcgtgagattgccgacgaacggccgacgcgttctcgtcgccgtcgttcggtgcaggttgaggatgagcaggacgaggatcgtccgtcgcgtcgtcgcagccgtttcgccgatgatgcggatgagtacgatgagatgccgcgtcgtcgcgcttccgtcgatgattcccatgatgaggagtcgtctgtggagcgtgccttggatgccgtcgatatgttgccggaaggccatgaggtccgccacaatccgcgtccgatgatgtctctgcttttccaggagccggttttgccgtccgttgcggattcccgagacagggcagacgacgatcgcgacgattcccgtaatgaccgcggcgagcgtaatgatcgcaatgcgcaggaccatgacgatgagcaggatgaggatcgtccgtcacgtcgccgtcgccgccgcaatcgcgacgttgccgacgaagagcgttccgaagacaatcgcaatgaacgcgataatcgggataatcgcaatgatgatgcggacaatgatgaggaaggcggatctcgcaagtcgcgtcgttcccgtcgtttgaacgcgcaggagcgtcgtgccgcagctgaagtcgaacagatcgaagaggatttgatcctcgacgatattacgtatgcgccgattgatgacgaaacccgcaatcgtcatgacgatgatgacgacgagcagccgacgcgcacccgtcgtcgccgtcgcagccgcggcaatcgtgaggaagccgacgaacagcagcgggatagcgatgaaggcgagtcccgtcgtcgccgtgaggacgatgacgaggatgaaggcacggtgacccgtcgccgtcgtcgccgtcgtggcggtgcgaagacggatgagacggaagagccgctcgtgcgtcgttcccgcaagcagcagtacatcgacgagatcaccgacgtcgaaggttccacccgacttgaggccaagaagcagcgtcgccgtgacaatcgccgtgagcgcagccgtcaaagccagctcatggagcaggacttcctggctcgccgcgagcatgtcgaccgcctgatggtggtgcgcgaacgcgaacgccacacgcagatttccgtgatcgaagacaatgtgctcgtcgaacattacgtgtccgacattcaggaagtcgccactgtgggcaacatctatctgggccgcgtgcagaacgtgctgccgagcatggaagccgcgttcgtcgacattggtcaggcgcgtaacggcgtgctctatgcgggtgaggtgaactgggattccgcacggttggaaggccagcctcgtcgcatcgaactcgcgttcaagtcgggggacccggtgctcgtgcaggtcaccaaggatccgatcggacataagggtgcgcgactgacctcgcaggtcacccttgcgggccgtttcctggtgctcgtgccatccggtggcatgacgggcgtgagccgcaagctcagcgagcgtgaacgttcccgcctgaagaacatcgtgtcgaaggtcgcgccgaaagacatgggcgtgatcattcgtaccgcagcggaaggcgcctccgaagaggcgatcaccaaggatcttgaaagcctggtgcgccagtgggaacgcatcacctccaagcgagacgaattcctgcacggcaagcgtccgaagctgctgcaaggcgagccggacgtggcgatccgcgtggtgcgagacatcttcaacgacgacttctccaagatgatcgttgaaggtgaccgcgtgtacggccgtatcgaggaatacctcgacaccatggctcccgacttgaaggacaagctcgaaaagtgggatccggccgaacatgaaggcaaagacgtgttcgacaagtggcagatcgactcccagctgcgcaagggcatggaacgtcaggtctacctgccgtcgggcggctcgatcgtgatcgaccgcaccgaagccatgaccaccatcgacgtgaataccggccgtttcatcggccgcggcaagagtcttgaggagacggtgacccgctgcaacctcgaagcttccgaagagatcgcacgtcagctgcgcctgcgtgacatcggcggcatggtgatgatcgacttcgtcgacatggtcatgccagccaaccgtgatctggtgctgcgcagactggtggaatgcctggcccgcgaccgcaccaagcatcaggtggccgaagtcacttcgcttggcctggtgcagatgacgcgcaagcgcatcggacaggggctggtggaagccttttccgaggaatgcccgacctgcaagggccgcggattcattcttcacgacgagccgaccgtgtccgcggattatgacgatccgtacgccctgaagggcggcgacccgttcgtcaagaccaacaagcatggtcacggcacggacgtgcaggtgccgaaaggctcctcgccggacgtgaaggccaaactcgcacagatcgcggcggctgccgtggccgccaacaatgcggaactgggcgaggaagcatagaagaataaatgattattccggtctgtcaacctgacacgccggaaacagacttgcggttgtacgcgggtatgtgtaaattagattgctggtgtctggccgcgaggctcgaacgtgccgggcagtaagctttccaagttaataaaggaacggatatgtacgcgattgtgaaggccggcggccatcaggaaaaggttgaggtcggtgacgtcatctacgtcaaccgtctcgaggctaagaagggcgaaaccgtggaattcccggttgctctcgttgtggacggctccaaggttgtcctcggtgccaaggatctcgccaacgtcagcgttaaggctgaggttgtcaacgatgaggccaagggtccgaagatcagcatcatgaagtataagaacaagaccggcgttgctcgtcgcaagggccatcgccagcagctgaccgctgtcaagatcacggctatcgcctgattggcgcagggttagagtcaaggaccgaaaggaacagacatggcacataagaagggcgcgtccagctcgcgcaacggtcgcgattcaaacgcgcaatacctcggtgtgaagaagttcggcggcgaagccgtcgtggccggcaacatcatcgttcgtcagcgtggcaccaagttccacccgggtgagaacgtcggcatgggcaaggaccacaccctgttcgccctcaaggacggcagcgtgaagttcggcgtgcgtcgtgaccgcaaggtcgtcgacgtgattgccgcctgaaatacgcgcaattaacgcttacaagataaagccgcgcccgttatggacgcggcttttctttattttgatgattgctgaggattggtttccttcagcccgtcccaaacgtcacgtaacgttgcatacagttgcataagacatatcaaacggacaataatcggaccgtttcgaacaaacgattaaggtagatacatgagtgatttcgtcgatcgcgtgaccgtccatgtgaagggcggcgacggcggcaacggttccgccggcatccgtagggaaaaatacaagccgttggcgggaccgaacggtggcaacggcggtgatggcggttccgtgatcttcatggccgaccagaacgccaacagcctgttggattaccgtttcatgccccaccgcgaggctggaagcggcaccatgggcttgggagacaccaaagacggttcgaaaggtgccgatctgatcctgcccgttcctgtgggcaccgtgattttcgaagccaaagggccgcaaggcaagcctaagcatccgggcgagcagctcgccgatcttcgccatgccggagacaagttcgtggtggcggccggcggcaacggcggtcttggcaacgccgcattggccaaccgcacccgtcgcgctccgggattcgcgttgcttggcgaaccaggcgaggaacgtgacgtcattctcgaactcaaatccatcgccgacgtggccttggtgggcttcccctccgcaggcaaatccagcctgatcgcagccatgagctccgccaagccgaaaatcgccgactatccgttcaccacgctcgtgccgaacctcggcgtggttatggccggagacatgcggtacaccatcgccgacgtgccgggcctgattccgggcgcatcccaaggcaagggcctcggccttgaattcctgcgccacatcgaacgcaccgaaatcatcgcccacgtcatcgactgtgccacgctggaacctgaccgtgatccgatgagcgactacaaggcgctcgaacatgagcttgccgaatatgccgacaagctggaactgccgttgggcgcaatcccaatccccgaacgcccccgaatcatcatcctcaacaaggtcgatatgccggaagccaaggaattggccgaattcgtcaaaccggaattcgaaaaactcggtctcaatgtgtatgtcatctccaccgcatcccacgaaggtttgaaggaactcaactgggcgttggcggccatggtcgccgacatgcgcaaggaagtcgccgaacgcgaacaggccgaagaagaagcgcgcgtggtcatcaagccgctcgaagagccgcgcaaccgccgtcgccgcaacgacgaaggcggcaccgtgcttgacttcaccgtggaacgcaaggaagccggcaacggcgacgtctggtacgaagtgctcggcaccaagccggaacgttgggtcatgcaaaccaacttcgacaacgacgaagcagtcggctacctggccgaccgcctcgccaaactcggtgtcgaagacgagctgcgcaacaagggagccaagcctggcgacgaagtacgcatcggcaagggcgcgcgagccgtggaattcgattgggatccgaccattgttgcgggcgcggaaatgctcgacggcgcccagcttggcgcacgaggcgtcgacctgcgactgcaggaacaggacggccgttcgcagcgccgcaccaacgcggaacgccgtcgccagtaccacgaaatgatggatgcgcgccaagccgtgcgtgaagccatgatggccgaacgcaaggccggacactgggccgatccttccgtggacgacgaccgccatgacgaaaccagcctcttcggacgcggtgaaaccaccgattccgaaaacgtggaacaatagaagcagcaaaacgcccgctgatgtgccgattggcatgtcggcgggttttcttttcggccattcgaacgcctggaggaaccatgaacacgccatcgcaagcccaagtgcgccgcgccatcgccgaagcgcaaaccatcgtggtgaaagtgggatccagctcgttgaccaaaccaagtggccacctcgatccggaacgactcaacgcgctcgtggcggccctcgcacgcgtgcgactcatgggcgggcgcgtggtgctcgtctcctccggcgccatcgcagccggattcggctccctcggcttcgactcacgcccaaccgacgtggctgaccagcaggcgtgcgcggccgtcggacaaggcctgctcatggcccagtacgagaacgctttctcacaatacggactgcgcgtcgggcaaatcctcatcaccgtgtccgacaccatcgcaccacagcaataccgcaacgtgcgacgcaccctcgaccggctgctcgacctcggcgcggtgccgatcatcaacgaaaacgattccctcgcgtccaacgaaatccgtttcggagacaacgaccgactctccgcattgatcgccaacatcgtagtcgccgacgctttggtgctcctcaccgacgtggacgcgctctacacggcacccccaagcgaacccggatcgcgacgcatcagctacgtgccgaacgtggaggacgcgctcgccaaagtgcaggtcggcggcaccggatcaaacgtgggtaccggcggcatggtcaccaaaatggaagcggcgcgtgttgcggcggtctccggcattcccgcagtgctcacctgcgcggcaaacgcaggcccggccatgatgggcgacccagtcggcaccgcattcgcccccatcaacgaccgtggatcatcacgccgcctatggatcgggttcgcagcacacccgcaaggcacgctcgtggccgatgccggcgcttccaatgcggtacgcggaggggccgccagcctgcttgccgccggcgtactcgaagtgcggggcgattttgccgccggagacgcggtgtggatcgacgatgaagcgggcaatcacctcgcaaaaggcctcgtaggattcgattccgaagaaatcccgcaaatgctcggccgcaataccgcccagctcaagcgtttcctcggcgaagaatacgcccaccccctagtccaccgcgacaacctcgtcttggtttaatccctttccctcttttgttcggtgccctgtaaatagcaatatgccgcccctaccggtcagcagggaaaaggaattccaaaatgtgctaaaaggctgttgtttttcgggcgggagggatagcatggcaaacatgactatggctgactggcagactctttccgaacgtattaaccgcgtggctccgagcgctactctggccgttgattccaaagcgaaagcgatgaaagctgaaggaatcgacgtcattggatttggtgcgggcgaaccgaactttccgactccggctgcgatcgtcgcggctgcggccgaagcggtgcaggatccgaagaactatcgttacactccgacggcaggtttgccggaattgcgcaaggcgatcgcagacaaaacgttgcgcgactcggggtatggagtcgatccgaatcaggtgatcgtaaccaatggcggcaagcaggccgtgtacgaatcctttcaaatcctgctcaatgatggcgacgaagtcatcattccgacgccgtattggacgagctatccggaagccgtgaaactggctggaggcgtgcctgtcgaagtgttcgcgggagctgaccgcaatttcgagccaagcttggaagacctggaagcggcacgtaccgaacgtacgaaggccatcatcgtgaatacgccgaacaatccgacgggtgccgtgtggaatccggaaaccgtcaaggcgatcggcgaatgggctgtggaacaccatgtgtgggtgatctccgacgaaatctacgagcatctgaactacgatggtgcaaaaaccacgtatatcggcgctgcagtgcctgaagtgcgtgatcagctgctggtgctcaacggcgtggccaaaacctacgctatgcccggctggcgtgtcggctggatgatcgctccgctcgacgtggcgaaggccgcatccaagctgcaggggcatatgacgtcgaacgtgaacaatatctcccagcgtgccgcgatcgcagccgtgtccggatctcttgacgccgtgtacgagatgcgtgaggcgttcgacaggcgccgtcagaccatcgtcgccgcgttgaacgatatcgaaggtgtgaactgcccgacgccgaccggcgcattctatgcgttcgccgacgtgagcgcactgctgaacaagccgctcggcaccagcaaaaccgcttatgcgagcacgtccgaactggctgcggcgctgcttgacgaaggtcatgtggcggccgttccaggcgaagcgttcggcgctcccggctacttgcgattctcgtacgcgcttgccgacgacgacctcgttgagggcatgaagcgtatgaagcagtgggtcgaggactgatactggcctgactgagacttttcacacgattcgcaccgcggtgacatgccgggtgcgaatctttttttcgttgaaaaatagcggttttgggacatttcttgaaaaaccggttggactaagtcgcaaatacccgctattatttcgacttggcggttttgccgcttacttcttgcgtggtttttcgcacaaaatcctcgccagcaagtagaaacggcagagtacacctagggaagtggcgcaattggtagcgcaacggtctccaaaaccgtaggttgtgggttcgagtcccgccttccctgccaagcttcttacaacaagctcagcggaggattattatggcgaaggcaaaaaatagcgaaaaggccgttaagccgaacatcttcatgcgtcttggcttgttcatcaaacagattatcgacgaactccgcaaggtcgtgaccccgaccagcaaagagctgttcttctgggcactcgccgtgttcatcttcgtgctgctcctgatggcactggtcaccggcatggacttcggtctgggcaagctgaccctgtggatcttcggctgatcaacgacttgaaggtgaaactgcatgactgacgaagtgttttccgacaacctcgacgaagctccagaagctgatctcgaggccgtagctgccgttgaggagctgcaggccgagggtgaaagcgttccggaagtcgctgaggccgagccgactgctgaagctgcttccgaagagtccgcggaggacgagggcggcgaagagctggatgctggcgccaaggccgtcgaagacttctccaacagcctgcgcaccctcgaaggcaagtggtacgtgctgcacacctactccggctatgagaagcgtgtgaagaccaacgttgaatcccgtgtggcaagcttcggcatggaagataagatcttccagattgaagttccgatggaagaagtcgaaaagcacaccgaaaagggcaagaaggtcatcacccgcgtgcgtgttcccggctatgtgctgattcgcatgcttccggatgagaacgcccgtcgtattgtgcgtgaaaccgaaggcgttaccggcttcgtcggtccgaccaaggaaccggcgccgctgagccgcaaggaagtcgtctccatgatggctccgatgatcgcttccgaagcgctcaagaaggctggtgacaagccggccgccaacaagaagcgcgtccttgaagtctcctacgccgttggcgatcaggtcaccgtcaccgacggtccgttcaccaccatggcagctgtcgtctccgacgttgagcccaccacccagaagctcacggtgctcgtgtccatcttcggtcgcgacacgccagtggagttgggcttcaaccaggtagaaaaactgtcctgataagtctttgaaagaccccgcgcattgcggggtctttttttgtctgggggagtgggcacaataggaaagcttgtgtctggagggtttggcgtgcctgaatgagggtacggaatccgctagcacagcacagcaatatacgttgcggaaggaaccggacgcgggaaacctactccggtgccgctaccaccgcttctacagaaagaagaaccatacaatggctcctaagaagaaagtctcggcgcttctcaagctccagattcaggctggcaaggccaacccggccccgccgctgggcccggcactgggttcccatggcgtgaacatcatggacttctgcaagcagtacaacgctgccacgcaggacaagatgggccaggtcatccctgttgagatcaccgttttcgaagatcgttccttcaccttcattctgaagaccccgccggcggcagctctgctgaagaaggccgcgggcatccagaagggtaccgaaaacccgctgacccacaaggtcggctccgtcaccaaggctcaggtccgtgagatcgccgaaatcaagatggctgatctgtccgcacgcgacgtcgaagccggcatgaagatcatcgagggcaccgcccgctcgatgggtatcacggttaccgactgagaggagagggacaaatggtaaagcgttccaagaagtaccgcgaagcttctgagaagatcgatcgcaacaacctttacaccgctaacgaagccatcgctctcgtcaagagcatgccggagtacaagttcgatcagaccgttgaggccgtgctgcgcctgaacgtggatccgcgtaaggccgaccagctggtccgcggttccgtcaacctgccgaacggcaccggtaagaccgccaaggtcctcgtgttcgcccgtggcccgaaggccaccgaggctctcgaggctggcgccgacatcgtcggtgacgacgatctcgtgcagaaggttgccgacggcttcctggacttcgattccgtggtggctaccccggacatgatgggcaaggtcggccgcctcggccgcgtgctcggtccgcgtggcctcatgccgaacccgaagaccggcaccgtgaccatggacgtcaccaaggccatcaaggacatcaagggcggcaaggtcgacttccgtgttgacaagaatggcaacctgagcttcctcatcggcaagctctccttcaccgagcaggctctcgacgagaacttcaaggctgttgccgacgaaatcaagcgtctgaagccgtccaccgtgaagggccgctacgtcaccaaggcgaccatcacctccacgatgaacccgggcgtcccggttgatccgacggtcatcgcctgagcaatatagcttgtagatagcttctatatagcttgcaaaagacccgcatcctgccccaacgcgagatgcgggtcttttcatatatatcttgcgattatctatctcatttaataaataatgatcctgcaatcgtctgactatcaaagaatctcaatgaaaccagatatcagatagatattaaaacagagaagtgatgttcaacggtcgcgcatacggccaatcgcaagcgccgtcgtcaaaacgtatgcgtcacgcgggtcggtcgcatcccaaccggtcgtttccgcggcacgcttcaagcgataacgcaccgtattcggatgcacattcaattccttcgccgtgttttccaacgaactgccgttgcgcaaaaacgtggaaaccgtcacaaacgtcggatcgtcgggattctcgccatgaagcacctgatacacgttctgatacaactcttcacgagcgtaatcatcgcccaacagcgcccgttccggcagcaactcatcggcacgcaacgggcgggacggcgacgccaaagcgggagccgcctgcaaggaaaacagggtttcacgcaacacgtgcgaagcgccggcgacaccggaacgcaccggactcaaatacaccgattcgtcatctttgaaagcgggcataatcgacgtgcaggtcacttcggcagtggcggcgccactctgacagacaagcgccagcagaaaactgccgtatgtgccaacaatcacatgttctccgcccagatcgcgcaccgccttacgcgcaacgagcgaagccgaagcgggactcgtttccggtgtgccgccaatcgcgaaacaatcgaaatccccacgccaaccaagcacattcatcaacgaggcgacgcgatcatccgtaagagaagtcatcaggcattcgaaagcgagccgttcgatggttgaatcgtcggtgtgccctgccagaaggtcgagaatgtctgcctgatcggagttcataagcgtcaagtgtagccgcccaactggcgaatcgctgaacggaaagcgtcaacgaggtgaagttcattcggggagtgccgctattatgccgcttatgagcgaagtcaaacaaactggaaagcgtagcgagcgtatcggcacattcctcagctggatgctggccgtgctggcatgcctttgggtggcatggtgttgcgcgatcgggccgttgtattggttcggcgatgggctttccgacttcggctggctgaatgtgctgtatttggtggtcgctttcgcgatatggttttcgatagttgtcgcattggtcagattcggccgcggccgtcgcgtacttccgcaatatttcgcacgacggcatgaaaaactatgcaacgagattgcaggaacgccgaccaccgtgcttggcattatgttgcgacacttgcatgatgccgcgcacagccgcccagggcgcgccctgcatgcagtgatcgtatggacggggcgcaaactcatccgctgcaccgactgttggtggaaactcatgctggtgttcgtaatcggctggctgtggattccaaccacgctattggccgcgttcggcgccgacattcgctcgcagatccgtgaattcagctgggccttgaaccagtggacgggcttgaaacagccatatatcggcttcttctcgttcgtgcccatggatatttacccgaccgcgcattacatgtggccggacaatcccacatatctgaccgaccagcacaatgtcgtgctcaccgtgttctacggtgccgcagcggcggtttcgcgctacttcaccgactccaacgatgcgggtatcgtggtgctcgcagccttgcaatggctattcgccgcattctgctgttcggccaccgccaaccggttcttcaacctgccgtggcgcaggcttggcgtcggcacgttcgacttctcgcatccggaacgccacgattgctggaatatgcgcgattacgcgcatcctgaagcaggcgttgtggcacgcccctccagactgcgggccggtgcgaaaacacgattcatgatactgctgttcttcatggtgtgcccgcttgcggtattcgccacgatttccctgacgaaatcgccgctgttcgctttcgcattcgtatggtggtttggcgtgtggtacgaactgcacatgacgcatatcaaagcgctgcccaccatcaacggcaagccgacgtacctacgcaaacgctcgatcatggccttcaccatctcaagctgcgtgatgctgatcagcgcgaaatacgcgtggtacatcattctcttcaccctgatcctggcacttatcaacgatcgcaaacgttggaaaacctatcttgtggcacttctgctgccaaccatcctcattcatggcggcatcgtgttcctcaccaacacgggcgccatcatcggcggcgaccccatcgaaagccgtggcatccaactgcagcagatcgcgcgcgtcgccaaatacaatccgaaaggcattccggcggacgcggcgaaaaagcttgaaccggtcttcaacctcgaccagatggccgaagcgtacttccggcaggacgccgacccggtgaaatcctccggcatccaatcgaagaaagtcagttacaagtggcgcaccgtcaccgaagacgacatgacaaacttcaacgaggcctggcttgaaatcgttgtcgcaaatcctgttatcgcgctcgacgcgtttttcgccgaatgcttcggctatttcgacgtgaccgacctgccatacgtgtcgatggactactacgtgaacaacgattacgtgcagaacgacaatgcgtggatccacctgtataaccacgattggcgcgatgcggtggccggcttcgcgaaaggttggggcaatattcccgtgatcggctgggtgacgcacggcaatctgtacgtaacgctgatgctgctggtcggcgctgccgaagtggtgttgcggcgatggcgctcgctgtcatggcatctgcccctgctgctgctcatgggcgtgatgatcaccgctccggccaacaatttcgaacggcatatgctaccggtcgcgttcgtattcggtttcgtatgcctgcaattctggcgcgagtcgcgtaatgcgcgatcggctgccagcgcgaacgtggccagtgcgcatgaggccagccaggtgcggcaggacgagtagcggctgcgttggctgctgcatgagctgttgcgttgcggcgacattgcgtcggcgcgccgcgctgtagtaggtaggaggtaatgatggcgattttggattcggctgcgatcatgccgcgtacatgcgttgcggcggatcaggtgcttgttttggatacggtgggatccaccaacacgtatgccgcggatttggtgcgtgcaggtcggctgttcggcatggatggcattgcagggaacctcgtgtggagcgggcgtgagatcgtggttgtcgcggcgaacgagcagacggccggtcgcgggcggctcgaccatacgtgggccagtgtgccgggggagtcattcatcgtgtcgctggtggtgagcgtgccggttgcgattgtgcgcgattcgtccgtcaatggttggctgcagatgattgccggttgcgagatgcgtgaggcgattgttggtgcggtatgcgatttcggcggcacgctcgatgaagatgttttgctgaaatggccgaacgatatttttgctggcggcaagaaacttggtggcgtactcgctgaaatggtgccgattccggattgcggggatcgcgttgccattgtgatcggcgtcggtttgaatcttgccgtcgctcaggaacgattgccgatagataagtccacatcgttgcagttggttgcgcgcaatctgcctgatgcgatggtgttgcgcgatgcgattgccgtacgttgggtgcaaggattgcgctcgcggttggctgatttcgaagaggaccctcaccgtgaggctgtgcgcgcccgggaagcgatgaccccgatctgctggacgctcggcaagcagtgcgaggctcattttgtggacggaaccactttgcagggcagggctgtcgcgttaaacgacgacgcctccctgaccattgaggatcaggaaggcgtattgcatcgggtgagcacggccgacgtaggcgtgctcagtaagtaaaaaattacttgattgctgaaatttgccgcaatctcacttcagcttggcaagacctgcgaccacggcggaagcgataacggccttgaccgcatcgcctgcgacgaatcccatggaagccacggccacaatcggcagtgcgatgccggtaatggcggactgcacgatgaaaccaagcagatagtcaagcgcaatgcagccggcgacacaggcaaacaggtaacgtgcggcggtcagcgcgccatgcttcagcgaatcggtgcgcgcctcacccttcagcagcgacgtgacgatggccgccggcaggaagccgatcaggaagccggcgctcgggccaaccaatgccatggtggaagcgccgccggcgaacaccggcagaccgaccgcgccggctgccagatacatgagcatcgcggcgccggcctgcttccacggcagcatcagcgcggccagcatcaccacgaacgtctgtagcgtgatcggcaccggcgtgcccggaatcggcacggcaccggccgcggaggcggtccacatgagcacggcgaacagcgccggcttgaggatggatccgacagtgccgctggtggcggttttcagcgtggttttgagtgtcagcattgcgttacgcacgataattctccttggatgtgattgcattacgttgatgaatcgacgattgttgacagccgaaatgatggcaagcgcgaaagtgacgaaaatgcaaggtttgtcaacttatgcccccaatcgtaggcttgccaagtttcggtaacgtttgtggagccttacaaaaagattgcgtgtcttttgtgggaaacgagttcacgatttttcgttcgcgcgaccaaacttgacgttatgcctaaaaatgtcaacaaacttctggtggcgaatcgcggagaaatcgcgcttcgcgtagtgcgcaccgcccgtgagatggggattcccacggttgcggtgtacgcggagcaggatcgccatgcacaatacgtgcagatggctgacgacgcatatctgctttccggagacacgtataaagacacctatctcaacgaggatctgctgatcgacattctgcagcgcagcggtgccgacgcagtgcatccaggctacggattcctttccgaagtggccactttcgcacagaaagtgatcgatgtgggtgcggcttgggttggtccgaatccgaaagccctcgtggatttgggggataagatcaccgcacgtcgtgtggccacgttcgccaaagttccgccggttcccggcatttcccagtcgatttccgacatgcgattgctgctggatttcgcgcatacgcacggttatccgctcatgcttaagcgtaccgatggcggcggcggtcgcggcatcacgctcgtgcacaacgatgacgagctgcgcggtttctacatgaatcatgatgcgctgcagggcggtgatctgaacgaatatttcgtggaacgattcatcgacaaaggacgtcacgtcgaaacgcagtgcggccgcgactcgcacggcaacttcaccgtgtattccacgcgcgactgctccgtgcagcgccgcaatcagaagcttgtcgaagaggcgccggcaccgttcctttcctccgaggtgaccgaccagctggaaacctactctcgccgactgttcgaagccgtcgattacgaggggcttggcacctgcgaattcatggtgaccgaacagggcaaagtgtacttcctggaagtcaatccgcgtctgcaggtggagcataccgtcagcgaggaggtctgcggacttgacctggtgcgcgagcagctgaccatcgccaacggtggggaactgaccgtgaaccatccgcttcgtggacacagttttgaactgcgcctgacctgcgaggatccggcgaagaacctcgcgccaagctccggcacgctggcctcgttgcgctggccgtccggcccgggcatccgtgtggattccggcgtggtcgaaggcgacaccatttcgccgaaattcgattcgatgatgggcaaactcgtggtcaccgcatctgaccgagcggcagcagtggcccgcgtgcgccgcgccttgagcgagctgaaggtggaaggcgtgccgactccggcaagcttgttcgaacagattttcaacgacgacgaattcaccgccgaacacggtgttgcatacgatgtcagcaccaaatggctggaacgcaagtacctcaacaaggaagccgcatcatcgcaaggcgggcagccggcgtccatgtctggcgcttccgaggtcgacaagaaggaatccagcgaaaccttcgtcatcgaagtcaacaatcgcagagtgtcgctgaccgtgccgaacgacatcgtcgccaacctgacgggcggtgccaaagcgcgtgacgcgaaacgtgccatccagccgctgcgtgggcagggactgcatcatgcgcagaaaaaacagcaaagcaatgacggccaatccggtgtgatcgcaagcccgatgcaggccgtcgtgacgcgtatcaatgtggccgaaggccagcaggtggccaagggcgacctgctcgtcgtgctcgaatccatgaagatggaaaactacgtgtatgcgccggtcaagggcgctgtcaccaagattttcgtgggacccgcggcgggcgtggaagccggcgaaacgttgatgaccatcgacgtgaccggagcgaacggtacgaaagccggcgaaaacggcgcaactggcgctgctgttgacggaaccgcaaccgacggaactatggaagggggtaagtgatgactgatatcatcgcaagcccggccgtcaaagaagccgtgaagatcgtaatggaacagcaggagcgactcggcaaaaacgcggccgaagccgtctccgcggccgacctgccgggcgcatctcagccaatccgcgcatccgtgcttcgtgcggcgcaactcgcgcacgaagcggaagatcatgcccgcaatcgccagcatgtcaaaggcaaactgacggcgcgcgaacgtcttgacctgctgcttgacaccggttccttcgaggaaatcggacgattctgcggcggcgacatcaacggcggacgcgcgggagcggcggtcatcaccggtttcggcgaagtgttcggacgcaaagtggccgtatacgcacaggacttttccgtgcgcggcggcacgctgggagtcgcggaaggccgcaagatctgccgattgatggacaaagcgctcgacttgaaagtgccgatcatcgcgcttatcgattcgggcggtgcccgcattcaagagggcgtggccgcgctgacgcaatacgggcatctgttccgtaaaacctgcgacgccagcggtttcgtgccgcagctctcgctgattctcggcccatgcgcgggtggagccgtgtactgcccggcactgaccgatctgatcatcatgacccgtgaaaactccaacatgttcgtcaccggtcctgacgtggtcaaagcggccacaggcgaagtgatcagcatggacgacctcggcggcggatacgtgcacaacgccacctccggtgtggcgcactacctgggcgaagacgaagccgacgcgatcgactacgcacgaaccgtgctcgcctacctgccgtccaactccgacctgcagccgcccacctacgcgtacgccgcaacccgcgccgaccgtgacgtggccaagcgacttgccaccatcgtgccggacaacgaccgccagccgtacgacgtgctcgacgtgatccgctgcatcgtggactacggcgaattcgtgcaggtgcacgagctgttcgcaagctccgcagtggtgggattcgcctgcgtgaacgggcatccgatcggcattgtggcaaaccagccgaacgtcaacgcgggcatcctcgacgtggattcctccgaaaaagtggcacgcttcgtgcgtctgtgcgacgcgttcaacctgccggtcgtcaccttggtggacacccctgggtacaagcctggcgccgaacaggaacatgcaggcatcatccgccgcggtgcgaaagtgatctacgcctacgccaacgcgcaagtgccgctggtcaccgtaatcctgcgaaaagccttcggcggtgcctacatcgtgatgggatccaaagccattggagccgacctcaactacgcttggccatccagccaaatcgcagtgctcggcgcatccggagcggtgaacatcatccatcgcaaagacctgcagaaagccaaagacgcaggcaaagacgtcgaagcgctccggtccaaatacgtggccgactacgaacgcaccaccgtcaacgcgaatctttcgctggaaatgggtgaaatcgacgccatgatcgaccccgagcaaacgcgcgaaaccatcatcgaatcactcaaactgctctccagcaagaagcgtgtgcgcaaaaccaccaaacaccatggcaaccagccgttgtgacgggtgcaaagtgcgcggatgaatcgtaagcaaacgtaaacgcaagaatcaatcgcaagaacacatcgcaagatttttgaaataagtaaggaacatcatgaacactttttttcttgatcgactgaacggtgagccgcacgcgctcgccttcgccggacaatccaccccatggccggtggcactcaccgaccaaagcgccaatccggtgctcaacgaagcgctgcacgcccatgccgacgcagcccaggcactgctgtacccggtgtcagccgacctgctcgccaccaccggccgcccggtcgacctgtttggattcgaaccgaatccggcacgactcggcgctgccgcagcggcttccgcaagcgttccgggcattgctctcgcccagttgggtgcgctgctcgacgctgcttctctcggctacaatcccgccgttgccaagccggttgccgtgctcggtcactcccaaggcgtgctcgccgtgcacatggtgcagtcgattgtcgaagcgggttccattgaggcggcttccgcgcaaattgatgaaattcttgcgattgccacgctgatcggtgttgccggcacccgtcaggcgcgtcagcttggtcttgccgcacgtcacggcgaagccacgccgatgctgtcggtcaaagacatcacccgcgcccaggtggatgcgctgatcaagcgtgtttccggtgcccgcggcccgattgccgtggccgtcaccaattccgccacgcattatgtgctctccggctacccagaggatctggccgcgttcggcgtggaagtggccaaggagcacaagcaccaggccaagctgcgcgaagagaaggtgcgtggcggccgtgtgttcgaaccggtgctcgaataccttgacgtgaccctgccgttccacagcccgctcatggccgatgctgtttcacaggctgtttcatgggcggaatcctgcggaatcaatgccgaccacgctcgcgagcttgccgccgaagtgctgctcaaccatgtggattgggccgcccgcgtgcgtgcgctcatgaaatccaccgatccgagtgccctgtgggtgttggattttggtccgggaaccaccgttggcaaactgttctccactgttgcccaaggcactggtgtcggtgtggtggaagcctccaccgtggctgatcgcggcgagctttccacgctggaaaccttgcctgagcgcacccagaactggacccgcttcgcaccaagcatcatccacacctccgctggagacaaggtgcgcaccgcattcactgaactgaccggcaaggctccggtactgctcgccggcatgaccccgaccaccgtggaaccggaaatcgtggcagcggccgccaacgccggctactgggcggaacttgcaggcggtggccaggtgaccgccagcgtgttcgaccgtcatgtcgccaagctggaagaagagcttgaagaaggccgtaccgttgaattcaacgcgatgttcatggaccgctacctgtggaacctgcagttcggatcccagcgtatcgtgccgaagaagcgtgccagcggcactccgatcgacggcgtggtcgtgtccgcgggcattccggaacttgacgaggccgtggaactcatccacaatctcaacgccgacggattcccgtatgtgagctttaagccgggcaccgtcgaccagattcgtcaggtggtgcgtatcgccaaggccgtcgctccggtcaaggtgctgatcgaagttgaaggcggttccgcaggcggtcaccattcgtgggaatcgttggatgatctgctgctgagcacctatgctgaagtgcgcgaacagtcgaaccttgtgctcgtggtcggtggcggcatcggtacgccggaacgtggcgccgactacatcaccggcgaatggtccgccgaatacggtcgaccgctcatgccggtggatggcgtgctcgtcggcaccgccgtgatgaccgccaaggaagcgcacaccagccctgaagtcaagcagatgctcgtcaataccccaggcattcccgccaagggagcagacgccgatccgttcgctccgctgggcgaacagtgggtgccgagcggccaggccaagggtggagtcacttccggcctgagccacctgcatgccgacatttacgagctggaaaactcttccgcacgttgtggacgcctgctggtgcgcgtgatgaagcatccggaagagctggaaagccgccgtgaggaaatcatcgaagcgttgaacgccaccgcgaagccgtatttcggtgacctgaaggccatgacctatctcgcatgggcgcagcgtttcgccgatctcgctttccctggggtcgacgaaacctatgccgatcgcttcctgcacttgctgcagcgtattgaagctcgcgtcaccacgcaggaaagcggcgaattcgcatcgctgttcgcatcccgtgccgatgtggaatccgatccgcacgcggccatcgccaagcttgccgaagcctatccgcaagccgacgaactgaccgtcaccccgatggatgaagcttggttcccggtgctcgtgcgtgaatatccgaagccaatgccgttcgtgcccgtcatcgacaacgacctgctgcgttggtggggtcaggaccagctgtggcagtccgaagactcccgatactccgccgattccgtgcgtattattcctggtccgatctccgtcgcgggcatcaccaccgttgacgaaccggtcgccgacattcttggccgtttcgaagcggccatggttaagcgcgtttccgcagaatcgccgatcgcagctaaaaccgcgttcgcccagctcggcgtggcatcttccgcagaagaattcattcgcaaatccccgaacatttcgtgggtgggccatcttatggcaaacccggcatacggcaccagcaacggtgacgccaactatgagattcgcaagatttccagcgaagggagtgtcgaaaagtacgatctcgacatccatctcgatacctactgggacaacgatccggacggtggcaagtccaagcatgccgtacgagacatcgtcatcccgctgaacgtagacggcaacgaatccgggctcttcccggtggtcgaccgtgaccgcctaccggaacacgtgtaccgtatgcttgcagacactgccggcattggtaacaccgccattactggcgacaagcttaccgccatgcctgttattgaacaggtggctgacaaagcctcctatccgttcggccaggcgcatgccagctacacgctgtccgccaacctcggcttcgaccatgaagcggccaccggcggcgcgctgccaagcaacctggtgccgtcgcgcatcgcaccggacgcgctcgtcgggccggcatggcccgccatctacgcggccctcggatccgtgtacgtcaacggcttccctgtgatcgaaggcctgctcaacgcagtgcatctcgaccatctcatcgaactggaagtcagcgaagacgaactgctcaagcatatcggcgaacaaatcgcgctgaccagctgggccgaagactacttcgaatcggcatccggccgtgtggtgaccatccacgtcacccacagcacgcaagacggcaccgtgcttgccaacgaaaccgaacgtttcgccatccgtggtcgtgcatactccgacgcactgccgccggaagcaccggactatggtggaatcgacgcggaaatcgaaagcactccgcgccgactgctgcgccgcgtcaaggtgaccgctccacacgagatgaccgccttcgcacgtacttccggcgatttcaacccgatccacacctcgcatcgtggcgctgctgtttccggtcttgcggcaccgctcgtgcacggcatgtggctctccgcaaccgcacaatacgcggtgcaggcgcttgacggcaagggtgcgcactatgaaatcgcaggctggacctacaacatgtacggcatggtgcagctcgacgacgaagtggaaatctccatcgaacgcgtcggacgcgtggctcactccggcatggtgctcgaagtgaccagccgtatcaaaggcaacatcgtgtctcgtggcaccgccatcgtgcgtgcgccgaagtccgcgttcgtatacccgggccagggcatacagcggcagggcatggtgctcgacgagcgtgccaagtccccggccgcacgagacgtgtgggagcgtgccgacaaggtgacccgcgagaagcttggattctcgatccttgccgtcgtgcgtgacaatccgaaggaactgaccgccaacggcgtgacctaccgccatccggaaggcctgctcaacctgacccagttcacgcaggtggcgctcgccaccgtggcattcgcccagaccgcacgtctgcgcgaagccggcgccgacatttggcctgcctatttcgcaggccactcgctgggcgaatacaacgcgttgagctccttcgccggcgtgattccgctggaaaccgtgatcgaactcgtgttccaccgcggctccaccatgcatcacctcattccgcgcgatgcgaagggccgttccaactaccgtatgggtgcgttgcgtccgaaccagttcggtgtgggcgatgacggcgtgcgcgagtacgttgaatccgtgtcgaaggcttccggcgagttcctgcagatcgtgaactacaacttggctggacagcagtatgccgtggcaggcaccatcgccggtttgaaggcgctgaaggccgattccagccgccgcgtggccgaatatggcggcaagccagcgttcatgctggtgccgggcatcgatgtgccgttccattccacgctgctgcgcaagggcgtgccggaattccgtgacaagcttgacgcgctcctgccgcagaccatcgattaccgtggccgtctggtcggacgctacattccgaacctggttgcggctccgttcgaaatgacgaaggaattcgcggccaagattctcgaagtcgtgccgtccgagcgcattcaggccgctttagatgatccgcagatttgggattcctatgctgctgatgatcagaagctcggccgattgctgcttacggaactgctgtcttggcagttcgcctctccggtgcgttggattgagacgcaggctctgctgttcggttcctccgagcagggcggtcttggtgtggaagagtatgttgaggttggtctcggcaatgctccgacgctcgccaatctgggttccaagacgttgcgtctgccgcagtttgccggtcgcgatgtgacggtatacaacgttggtcgcgatgaaggccgcgtatacatgactgattccgattcgttggttccggaagaagatgctgacgattctgcggttgcgacttctgcttcttctgcggctgctgctccggctgttgcctcagctcctgcggctgctcctgctgctgttgcggaagttccggttgctgcagcttctgctcctgcaggtgctccgtcgggtgccgccgttgcggatgttgcattcaaggcatccgatgcgattgccacattgctggcttactcggctaaggttcgccccgatcagatcggcgaaagcgataccaccgatacgctgaccaatggtgtgtcttctcgccgtaatcagctgcttatggacatcagttccgaactgggtgtggcttccgtggatggtgctgccgaagcgacggtcaaggcgctgagcgctttggtcaacaaggtcgctccgaactacaaggcgttcggtccggtgctgtctgacattgtgcgcgaccgtgtgcgtggcatgttcggtgccgccggtgtgaagctcggccagatcactaagcgtgtgaccgatacatggcagcttggcgaagggtgggcttcccatgcggtggctgcgctcgtgctcgaaacccgtgagggggccagctctcgtggcggtgaccttgcctcgttgagtacggatgccgtttccaatgcgaccgctgccaacgcgctgatcgatgcggccgtgcagaaggttgctgccgataagggcatcgccgttgccatgccgagcgccggtggcgcagccggcggggcagtggttgattccgccgctttggacgcgttcgcagccaaggtgaccggtgccgatggcgtgctcgcctccacggcgaagttcgtgctgaaccagctgggcatagtcgctccggttgccgaggaaactgctgatgagaacgcggctgttgtggctgcggtcgaagctgaactcggtgctgactggccgaagcaggtcgaacctcgtttcgacgagcgcaaggccattctgttcgacgatcgttgggcttccgcacgtgaagacttggcgcgcgcctactacaacaacgatgaatccgcattgaacggcagcttcatcggtctcggcaagaccattgccgacgaagccgcttggtatgcaggcaagagcgacaacgcggatctgaaggccgcattcaatcgtgtcgctgccgaagcaggagaaaacgcttccgaatcggcagaaaacagccgtttcgctggagatatcgcagtggtgactggcgtggctccgaactccatcgcagcccaggtggtcaacggcctgcttgcaggcggtgctactgtggtggccacctcgcacagcttcaagccaagcgtgaaggcatgggccaagcagacctaccgtgagcatgcggcgggcgatgccaagctgtggctggttcccgcgaacctgtcaagctaccgtgatgtggacgcgttggtcgcctgggtcggcaatgtgcagaagaagacttccggtgcgaccaccacgattctcaagcctgcttacgagccgagcctgttcttcccgttcgcggctccgccggtgcatggcaaccttgccgattccggcgaactgttcgaatctcaggctcgcctcatgttgtggggtgttgagcgtgcgattgccggacttgcgaagatcggtgccgacaccgatgtgcagcataagttgcatgtggtgttgccgggatcgccgaaccgcggtattttcggcggcgacggtgcctatggcgaagtgaagagcgcattcgatgcgattgtgaaccgtgcgcgcgccgaaaaggtgtggtcgagccgtgtgaccttcgcccatccgaagatcggctgggtgcgcggcacgggcttgatgggcggcaatgatccgctggtcgaagtggtggagcgtcacggtctgaagacctattccaccgccgaaatcgcggtcgaactgctgaacctttccacccgcgaatcccgtatcgaagcagccaaggccccgcttgacgtggacctgaccggcggactcggcaacgagccgatcgacatcaaggcactgcgtgcggaagccatggaagacgcggcccaagcggaagcggcgaatgccaagaacgcaatcgcaggcaacgaatccgataccgcggccaagacgctcatcaaggcactgccaagcccgcgtgctccgcgtcaggccaaggtcgatcttgccgattggcagaacgtcaccgcccgtccggaagacgaaatcgtcatcgtgtccgtgggtgaacttggcccatggggctccggccgcacccgtttcgaagccgaactcggcatccattccgacggccaggtggatctgtctgccggcgcggtgctcgaactggcatggaatatgggcctgctgacgtggaacgacagccccaagccgggctggtacgacgttgatggcaacctcgtgcctgaggaggatatcgcggaacgttaccatgacgaggtcgtggcccgttccggcgtgcgtccgttcgacgaaggcatgggcaacgactacaaggacggcaccgacgaggaagaggccgaggtgttccttgaccacgatgtgaccttctcggttccgactcgtgagattgccgaagagtacgtcaagcttgatgaagcgcacaccagcttcgcggccgatgcggaatccggcgaatggaacgtgacccgccatgccggctccatgattcgcgtgcctcgtcgcgcggccatgacccgtacggtcggcggccagttcccgaagggcttcgatccggtcaagtggggcattccggcttccatggtcggcgacgtcgacaagatcgccttgtggaacatcgttactacggtcgacgcctacctgtccgcaggcttcacgccgaccgaaatcctcgaggcggtgcatccgtcgatggtggcctccacgcagggcaccggtttcggtggcatggcgtccatgcgcaagctgtacttggatcgcttcctcaaccatgagattccgaccgacattctgcaggaggctctgccgaatgttgtcgcagcccacgtgatgcagtcctacatcggcggctacggcaatatggtccagccggtttccgcctgcgccacggcagccgtctcccttgaagagggtgccgacaagatcgcgctcggcaaggccgacttcgtggtcaccggtgcgatcgacgacatcggcgtggaatccgtgatcggcttcggcaacatgaacgccaccgccaattcggaggaaatgtacgccaagggcatcgacgcgcgcttcttctcccgtgccaacgatcgtcgtcgtggcggattcgtggaatcccagggcggcggcaccatcctgctgacccgtggcgatatcgcgttgaagctcggcctgccggttgccggcgtaatcggattcgtgcactcctacgccgacggcgcgcacacttccattccggctccgggcttgggtgcgcttgcagcgggcatgggcggcaaggattccaagctggtacgcgatctggcccgtctcggcgtcaccccggacgacatcgccgtggtttccaagcacgatacgtccaccaacgccaacgatccgaacgagtccgaactgcacaacacgttggcccacgccattggccgcgccgacggcaacccgctgttcgtgatctcgcagaagacgcttaccggtcatgccaagggcggtgcctgcatcttccaggtcaacggtctgacccagctgttcaagtccggcgtgattccggccaatgccgcccttgactgcgttgatccgaagctcatgcgcgacgaccacatggtctggctgcgcgaaccgttgaaggtcggctccgtcaaggcgggcctggccacgtcgctcggtttcggccacgtgtccggctttgcggcgatcgtcaatccgggcgcgttcgaagcggcagtggccaacaccgcgggcgtcgaggcactgaatgcatggcgtgatcgcgccaacgagcgtttggctgccggccagcgtcgccttgaggaaggcatgatgggccgcgccgcgctctacgagccgatcgacaaccgtcgtttccatgaggatagccgcggctacaacgcgcacgaggtggagaaggccatgctgctcgacccgaacgcgcgcctgggcgcatccggctacttcgaagcctgattcccgcgtctgagcgcctgaaatttctggcgctcagacgcgcgatcatcaaaatcccgtatctgtcgcaatctcagtatttcgcggcagatacgggattttcatattcttgaatcactctactttccgtctgcacgatttccgtttggtgtcgtattttcacttgtgcagacgcgaaacgaggggcgcgcaatgcgggtggcagaggatgaagcgcttaggtaggatggtgtccttgcatgaaagcgaagtgtcgcccgcctgtttcgcggaagtcgacatggttcgtttcttcctgaaaactttcgaaaggctggaaaatgctgggtttagggcatgacgtcgtggatgtgcctgcgttcgccgagcaactgggcgaaccggggtcgcgcatgcgaaacctgttctccatgcgcgagctatggcagaccgctcaacgtgtgcaggtcaaaagggacggtgaggcggtgcatcttgcggcccgatgggcgggcaaggaggcttttctcaaggcgtggtgcgaagcgatttcacgcagggcaaatgccgatggagacattgcctatccgtacacgctcgacgattttccttgggcgcgcatcgaaatacttgacgattcccacggcgtgccccgtgtcatgctctcgcccgaggtgcgacgcaagttgcggcaatcgttgggattgccggttgatggggatgatcaatcgtgcgcaatccatatttccatgagtcatgacggatccgtcgcatccgcggtggtgacgatagaagcgtgaccgcaagtgattgcgtcaatcgattgacgtcaatcgcgacaacacctcgaaccggtttgataaaaccgtaaaatcacgctacactggtgccaacgtcgtggcaacgaacgctgcggaatccaactcataacaacgaagttccctgggaagaggagtcaaggaatggcacggtccaaatccgacaaagcatttgacgagcgcgtcgcacaatatagtgaggaactgcgcgaactattgacggatctgtatggggagcaggccgacgaagccttccgcaacctcaccgagctgatggccaaagcccacgatgcacgtcccgccgatctgaaacgcctcgacaccaagcgtctcgccgatccggaatggtacaagcgcggcaacatgttcggcatgaccatgtataccgacctattcgccggagatctaaagaaactcgcaggcaaggtgccgtacctgaaagagcagaagctcacgtatctgcaccttatgccactgctgaaaatgccgcatccgcagaacgacggcggttatgcggtggaagatttcgacaccgtcgatccgtcgctcggcactaatgaagacctcgcggcactcaccaaaaaactgcgtgcggccggcatcagtctgtgcctcgacttcgtgatgaaccacaccgcatccagccatcgttgggctaaggcggcccaagcgggcgatccgaaatatcaggattactactactgctacgacgaccgcaccattcccgaccagtatgacgccgtggtgccggaagtcttcccggccactgcccccggcaacttcacctggaacgaacagatgcacaagtgggtgctcacctcgttctacccgttccagtgggatctgaactaccgcaacccgaacgtgctcgtgtcggtgctctccagcgtgctcggcctcgccaaccttggcgtcgaagtgttccgcatcgacgcggtgccttacatctggaaggaactcggtaccaactgccgtaacctgccgcaagtgcacaccatcgtacgcatgttgcgcatcgtgctcgaatgcgtctgcccggcagtagtgctgaagggcgaagtggtgatggcccccaaggagctcgccgcctacttcggtacgccggaaaagccggaatgccacatgctctacaacgtgtcgatcatggtgaatctgtggagtgcgcttgccagtggggacgtgcgtctgctcaaagaccagctcgacaagctcaacgcgctgccggaaaactgctggttcgtcaactacctgcgctgccatgacgacatcggctggggcttggacgaaccggtggaggagagcctcggcatcgacccgctcaagcacaaggaattcctgtaccacttctacgagggctcggtgcccggcagctgggccatgggcgagctgtacaactacgacgaggcgtcgaaggatgcgcgcagctgcggcaccacggccagtctgtgcggtgtggaacgcgctctgatcacgcatgacaagccgttgctcgacatttcgatgaaacgcgatttgatgatgcattccgccatgtcgttcctgcgtggcttccccatgttgagctgcggcgacgaaatcgtgcagctcaacggctgggaatacaaggaagatcctgaccgcgtcgaggattcgcgtaatctgcatcgcagccccttcaattgggagaatgtggccaagcgcaagcagactggcaccctgcagaagcagatgtgggacggattgaagagcgttcgtgagatgcgcgacgatcccgctttcgcgcccgaagcgtgggtcaccacttgggacgcgcataatgatgcggttcttgcggtggtgcgccatgttgaaggacgcactgttctcggattgttcaatttctcgtccgcacgtcagatcgcacgtcttgattcggatggcgatatcgtgcttcccgctgaggtcgcgttggaaccgtaccaggtttgcgtggtcgaaaaataattattgcgatttcgacttgcgattgttgagggaatgtgtataatagctcgagtcgtttcgtgttgacttcggtcggcatagacggtgcgcggatgtagctcaatggtagagcctcagtcttccaaactgattacgcgggttcgattcccgtcatccgctccacacaatcgttagagaagaagaaaggcgtgcttaatggcacgccttttgcatacctgccgtgcgattgcttcgacgactgggtatgctggacgtgtcgtgacagcggcgtgacggtcgcagcaggcggtaatcgcaatacaacggagcgggtatggcacaaacgcaaggcaacaaggtgacggaagtcgtcgacggcgtgatcgaacaggtcgacgtttccaagcatccgacggcgtccattgaagcgtctgatctttccttggccgacatcgaacggcgcaaatcgcatccggggcattgggcgctgttcatcgcgctggtgctggtggctttgatcgcgccttactggtggggacgtgtcatcgcagtcaaggatgcggcttggatggtggccaatctcagcttcctcgatcccaaaggcgtggcgctgatttcgtggacggtcaccattatggcgatggccggtttgggattgatggttgcggatgtgaagaaatggctgtggggcacggttttcgtggtgggactcgccgccgaacagttcgtcgccggcgtatgtctgctgagcttcaacttctggaacgccacttatgtgatgtatggcgattcctcggggcttgccaacgccgcgaatcttggcattatcgcggccggatgcggtgtcgccgtctacgcggtgctgtgggttggactgctggtctgcatcaaaaaggaatcgaaattcaatgtgcttacgcgcagttgggcgtcgtttttgctgtttttcgtaattgagagcatttcgctcgcggtggtgctgttcggcgggctgctgaacgtggtctgaagcgtcgcttgcggcatggtctgatttggtctgcccctcgtgtatgatttccctttggcgtatttcgcccgcggatagagagcgcgtcggtattggaccggcagcaccgcgcagcaacataaggaggatgccgtggcacttacggctgaggaaaagcaggaaatcatcaagacttacgctacccacgagggtgacaccggctccccggaggtccaggttgctctgctgaccaagcgtatcgctgatctgaccgagcacctcaaggagcacaagcatgatcaccactcccgtcgtggtctgctgctgatggtcggcgatcgtcgtcgtatgcttgattacctcaagcgcgtcgacatcaaccgttaccgctccctgattgagcgtctgggtctgcgccgatagttacattcttccgcccgaatgccttccttggcgttcgggcgtttttgcatgacagccgcgttgaggaaaagacagtttgaaagcccaaggtttagggcgcatgaggtctagaatctaaagatgaggaagcgacgaaggtaacgtcgcgtcacgcatgcagaaatcggttggagtccgctgaagaggactgccgatagttggtaaaagaaaagaaaaaggaggaaccctatggagggtcccgaaatcaaggcggttgaagccgtaatcgataatggttcatttggcaagcgcacgttgcgcttcgagaccggtcgtctcgcccagcaggcggatggtgccgtcgccgcctatcttgacgatgattcgatgattctgtcgaccaccaccgccggttccagcccgaaggagaactacgacttcttcccgctgaccgtggacgtggaagagaagatgtacgccgccggcaagattccgggctcgttcttccgccgtgaaggccgtccgagctccgaggcgattctggcttgccgtatcatcgaccgtccgctgcgcccgctgttcccgcacacgctgcgcaacgaagtgcaggttgtggaaaccgtgctcgccgtcaacccggacgatgcctacgatgttatcgctctgaacgctgcttccgcttccaccatgatttccggtctgccgttcgagggtccggtttccggcgttcgtctggctctgatcgacggtcagtgggtcgctttcccgcgttggagcgagcgtgagcgcgccgtgttcgaaatcgtggttgccggccgcgtggtggagaacggcgatgttgccatcgctatgatcgaagctggcgcaggtaagaacgcctggcacctcatctacgacgaaggccagaccaagccggacgaggaagtcgttgccggtggtcttgaagccgccaagccgttcatcaaggtgatctgcgaggctcaggccgaactcaagaacatcgctgcgaaggaaaccaaggaattccagctcttcccggagtacaccgaagatctgtacaaccgcatcgacgaaatcgcccacgctgatctcgacgaggctctctccattgccgagaagctgccgcgtcaggatcgcattcatgagatcaaggaaggcgtcaaagccactctcgccggtgaattcaccgacatggacgatgccgaaaaggaaaaggagatcggcaatgcgttcaaggagctgcagcgccagatcgtgcgtcgccgcatcctgacccaggattaccgcatcgacggccgtggcctgcgcgacatccgcaccctgtccgctgaagtggacatcgttccgcgcgtgcacggttccgcactgttccagcgtggcgaaacccagattctgggcgtcaccaccctgaacatgctcaagatggaacagcagatcgacgcactgtccggtccgcagtccaagcgttacatgcacaactatgagatgccgccgtactccaccggtgaaaccggccgcgtcggctccccgaagcgccgcgaaatcggccacggtgcgctggcggagaaggctctcgtgcctgtgatgccaagccgtgaagagttcccgtacgccatccgtcaggtctccgaagccattggttccaacggttccacctccatgggttccgtgtgcgcctccaccctgtcgttgctcgctgcaggcgtgccgctgaaggctccggttgccggcatcgccatgggcctcgtgtccggtgatgttgacggccagcacatcttcaagaccctgaccgatattctcggtgccgaagacgcattcggcgatatggacttcaaggtcgcaggcacttccgaattcatcaccgccctgcagcttgacaccaagctcgacggcattccggcagacattctggcctctgctctgcagcaggccaaggaagcccgtaccaccattctcgaagtcatcaacgagtgcatcgatggtccggccgagatgagcccgtacgcaccgcgcatcatcaccaccaccgttccggtcgacaagatcggcgaagtcatcggtccgaagggcaagatgatcaaccagattcaggaagagaccggtgcggagatcgccatcgaagatgacggtaccgtgttcatctcctccgaaggtggcgacggcgctgaaaaggccaagcagatcatcgaccagatcgccaacccgcacgttcctgaagccggcgaaacctacaacggcaaggttgtgaagaccacctccttcggtgccttcgtgaacctgaccccgggcaccgacggcctgttgcacatctcccagatccgtaatctggccaacggcgagcgtatcgacgccgtcgaagacgtgctcaaggaaggcgacaccgttgaggtagtcgtgcagggcgttgacgatcgcggcaagatctccttggccattccgggcttcgaagatcaggaatcctccgctccgcgtcgcgagcgtttcgatcgcgatgaccgtcgcggcagccgtggccgtcgtgatgatcgtcgttccgatcgtgacgatcgtgattatgatgatcgtccgcgtcgtcgtcgttctgatcgtgacgatgaccgcgactatgatgatcgtccgcgtcgtcgtcgttccgaccgcgacgaccgtgattacgatcgtgatgatcgtcgttccgatcgtgacgatcgtgattatgatgatcgtccgcgtcgtcgtcgttctgatcgtgacgaccgtgattacgatcgtgatgatcgtcgttccgaccgtcgccgcagcagccgccgcgacgaccgcaacccgcgttacgcagccgacgagaactacgacgagtaccgtgccgatcgcgaagagcgttccgagcgtcctcgccgccgcgtccgccgcgactttgatccttttgaggactgatgtcctcaaggatccctcgcagcatagctgactgactgaagtgccctgtaccgaaaggtgcggggcacttttcgtttcatgcagaatgcataaaaatgagacacgggtatgagttttgccataacgtacctagatgtatgcaagaatggtttgaagagccattaacgagggagtcgtcatgggcgttggcattatcatcgctgtcatcgttgtacttattgtgctttgggccgtcagcgcctacaacgggctggtcacgctacgaaatcgtgtgaagaacggctgggcgcagatcgatgtgcagctcaagcagcgtaccgatcttattccgaacctggtggaaacggtcaaaggttatgcggcccatgaatcccaagtgttcacgcaggtcacgcaggcccgtgccggcgtggtgcaggccgcgcaaagcggtgacgtggcgcagcgcatcgccgcggaaaaccagttgagtcgcgcgcttatgaatctgcaggttgtgtctgaaaactatccgcaactgcaggccaatacgaatttcatggatctgcagagtcagctgaaatcgttggaagagaagatcgcttacgcgcgccagttctacaacgatgtcgtgcagaagtacaatacccagaccgaggttgtgccgaccaatattatcgccggcttgttccatttcgaacaggctccctacttccaggtggacgaagcggatcgtcaggttccgcaagttaagttctgacatgcatgtaaagccccgtccgataacgatggggctttactgttcaattcggttggtacggccatctgttgtacggccatgtgagggaagaagaagcgagaaagagggattatggcggccaaacagcatgcgtcacgagcggtgcgcagcttcggtattgcaatcgttgttaccgttggtattgtagcggccttgctgctgttcatggcatcggatgacggcggggccgatctgagctacaaaacgctcgactatgatgtgcaggtgcagagcaatggcgatttgaaggtcacccagcatatcgacatgaaactcgccgaccgcagcgacgacgacgtcgatcatccatggaagcagctgtatcaacagtacacgttgaaggaaagcgatctgactaatatcaccgatatcagcgtgcgcaatgcaacaacgggggaagcctaccagcagggcgatatcgcaatcccaagcagttacagcaccgacgaatgggatcgagaacatgcgaagcagtggtatatcgccgatgtctcgcaaggcgacagcaatccgcagccgttcgatcccgcaaaagatggtcttgtttccggcaataccgacgatcgttccaagaagatcgaaatcgggtggaacattccctccatcacatcggcaagcagcctaaaattcgacgtgaccatgaccatgcagggcgtgaccaccgcctatcaagacatggccacgttccaatgggagccgttcggcgtgagcaatcagattcccatcggcaaagtcaccggcaccgtcacgttccccgaaggcattgacgccgataattcgtgggcttggctgcatacggaatgcacgtcggaaacggagcgagacaagaacggctcgctgaaatttaccgtatatgacgtgcgtgccggcgactatgttgacgtggtcgccatgttcgacgttggtgtgaccggtggcgtgcaacgcaccagagataccaccatcaaaaacggcattatgaaaagcgaagctaagcaggaacagcagtggcgcgaccaacagcgcaaacaagcgcgcatccgcctgatcacatggatcgccattgcagtggtcgggctggtcttgtgtgtgatcgccatcatcttcgggttgcgcagcttcaaccgttcgcaatatcatggcggcgtcgagtattggcgcgacgaaccggaaatgagtcctgccagcgctgcggagctgctgcatatggtcgacaacaagcattcgagcacgctgacgagccgaaagatgtcggcttccgtgctctcgctcgcttcgcgtggagcaatcgctatttatccgggaccggccgccatgtatcggggcattgatatgagccaggcgaacaatgctgacattgcacggatgatcgccaacgatcccgctcgaacccgcgatgtgggcaaaaccagtacggtggtgatacttcccgtggtatttgataacgtgcaatcgttgcagttgcgcccgagcgagcaggccgcgctcgacttgctggtgacggcgtccgaacgcatcggctctccggtgttcgatctggatcagatgaacgagaatttctccgattgggagaacggctacaagcttcaggagaaattcacgaatacgtgcgacaacgaattcgccatgctgggcgccacgtcgatatgcggtgggggagcgtttgccgcgggcatttgcgctgtgatgctggcattcctgtccatgctgtatttcggagccatcggcaatcttgcgttgttcgcggtgatttccgcgccgatgatgttcgcttccgtgttcgcgttgagctacctcagactgaaggggcttaccgacaatgggcagtatcttgctggccaggtgctcggattgaagcattatatggaggatttcagcgaattcaaggatcgcggtgtgacggatatgacgttgtggggccggtatatggtgtatgccactgcgttcggcatttccgaaaaggcgatgaagcagctgttgaaggcatatccgcaattggctgatccgcattggcttgataataatgcttccgattcgctgctgtattggagttatcgttcatggtatttcgaccatcgttacgccgatcctgcttcgtttgatacgaattcgatggatttctcgcaattcagcgccaattttggtgatattggcgcgcagttggaatcaggtttcgctgatattcaatcgacgatttcggcggcgtcgccgtccggaagtttcagtggttccggcggcagtttctccggtggcggtttcggcggttcgtccggcggttccggtggcggcagtttcggcggtcgctgatctgcggcattacgcgcatgtttggtgggtttgttgtctgctgaggcgggtcggctggtaaggttgcattcggaaagacactctgtacgttgttgaaggagatcgggatggctttgttccgtaatcttggaccgttccgcaccacggccatcggccatggtgaaatgccgttgaccattgaaaacaatcgtggtcacgatgtcggtatcgaaacattgcacgcctcgttggatgccggatgccgtcacatcgacaccgcttgggcgtactacacgccgggcgaagaggaacagaccggcgaaaagctggtgcgtgaggcgcttgactcgtggaagggcccgcgtgaggaagtcaccgtggccaccaaggtgggcttgcgccgcgcttgggagggtgacaagccggtttggccgcgtgacggcaagccggagcatctgatcgaatacggcaagcagtccgcgatggcgcttggcgttgacagcatcgatctgctgtacctgcaccgtcatgatccggaagtgccgtacaacgagtcctgcgaaggcatcaaggcgctgctcgatcagggcgtggcccagtgggcgggtgtttccaacgtgagcatcgaacagttgaagatcgcgcaggagatcctcggcgacaagcttgtggccgtgcagaaccagtattctccgattcatctggacacccaagatacgcttgactattgcgccgagcagggtctggcgttcgtgtgctggagtccgttgggcggctaccgtcacccgtacgacgagcacctgttcgatccgttccgcgaggtggccgaagcccgtggcgtgagctaccagcgtgtggtgctcgcatgggagctggccaagggcgaccacatgttcgtgattcccggcgcccatcgaccggaaaccattctcgattccctcaaggccgacgagctcgaactcaccgaagaggaactcgccaaactcggctgagtgtcagattcgcaacgttttgcgtcaaggcgtccgtctccacgatggacgcctttgtttttcagcatgtgtttttcctcgtatgtatttcccggatgcggcaaaagtgtcccgtgaatagtcgagaatatagagcggaaaaatcgagtaagaggaacaagcgtgcaaagaagaaacaagcctgaagtattggctcccgcgggcaatctgcgaggactgaaaaccgccgtcgattacggtgcggacgccgtctactgcggaggtaaggcgttcggcatgcgttcggcgccgaaaaacctgagtttggaggatttcgaagaaggctcccgttacgcgcatgagcgtggcgctcgcgtgtatgtgacctgcaatgtgttgccgcgcaacaatgaagtcgaagcgatgcgcgaatacatcggccagctcaaagacaccggcgtggacgcactgatcgtttccgacattggcgtgatgctcatggctcgcgaagtggcgccgaacctggaactgcatgtgagcacgcaggcgggagtcaccaactatcaggcagcgaacgccttctaccagttgggtgcacgtcgtgtggtgcttgcccgtgaaatggatctgcaggccgtgcgagacattcgcgcacgcattcccgacgatctcgacatcgaatgcttcgtgcatggcgcgatgtgcatggcgttctccggtcgttgtctgttctccaattatctgaccggacgtgacggcaatcatggcgaatgcgctcaaccgtgccgctggaagtattccatcgtcgaagaaaagcgtcccggccagtattttccgatagaacagactaaggaaggcgcgtatctgttcaattcgcaggatatgaacatgcttgcgcatatcgacgatctgcttgattcgggcgctaccagtctgaaaatcgaaggtcgttccaagagcgcctactatattgcggcgatgacgaacgcttacaagaccgctgttgacgcatacatggtgcaacgtggttttgaagacgaggatggcactgtgctgaagccgttccacgatcgtgtgattcgtccgtccgatccggattacggcaagccggaaaccaccgattcgattatggaacatgcggatggcgcgttcgcaggaaagccggatattgcagccgttcccgtcgcttctgccggcgaaccggatgatctgagctaccatgcccgcagcacaaggcgtaagtcgaacacggctgccgaaatcctgccggaaggctggtatcacgccggcgtgcgccccgcggagcatgtgtcgctgcctgactggctgctggacgagccagacaaggtggcgcaccgcgactattccaccggcttctactatccggagcacaaagtgcagcaaagcaccgatcgttccgcgtatttccgcgcatggctggtggtcggcgaagtgctttcgtggagtccggaagacggcggtcgcgtgaccattatgagccgcaacaagatcgaagccggtcaagaggttgaattcgtgcttccgggcgcggctccgctcgcctataccgttccggctggcggattccgcgacgccgatgggcattgggtcgaagccatcaacaatccggcgcatgtgttctccatgccatgcccgcaggaagtgccggtgaacgcggccatccgatcgcgcaccaaaaagccgacgctcaaagcggaataattgcgaaaaacatcgtacaggtgtagaaaatcagcagaaattagttgaaataattgtagaacaatcaaggaaaacagaacaatatgactgacaggcagtatgacgacgcgattcttgacagcaacgcgatcgccccgaccgacgtggacggcaatccgattccggtgaccattccgatcatgcttgcgccgggcgtcaaagtcgtgtacaccacgcgacttggcggcaccagcgaaggagactatgcgcactgcaatctcgggggtaaaaccggcgatgatccgaaccatgtgctcgccaatcgtgtggcgctctccaacgccatcgatgcgaaactgagcttggtcagccaggtgcattccggcgttgccgtcgatgtggacgaattgttcgtaatgaaccgtccgttcggtttcgacgtgtccggcagcaaggacgaaaccgctcagcaggtgggcgaagccgcggataatccggcagtggtcgaggccgacggccaggtgaccgcgcagaagaacgtggcgctcggcatgttcgcggccgactgcttgccggtgctcatggccgatgcggaagccggtgtgatcggtgccgcgcattgcggtcgccgtggcctgcagagcggtgtgatcggtgccaccgtcgaaaagatggtggccaagggagccaagccggaacgtattgtcgccacgctcggcccgtgcatctgcggcgactgctacgaggttggcggagacatcgccgacgaattcgacgcgcagttccctggaaccttcacactgagccgtttcggacagccgggcatcgatatcgcggccgccgcgctgcaggagcttgccaaagccggtgttccagctgataacatcgtttcctcccgcgcccgcgtcaacgcagccacccagtatctttccgaagacgaggaattggcggaaatctgccagtctgatggcgaaggagaaccgcagctcacggaacgtttcaagaaaatccgccgtagcctgtgcacgctggaaaatccgctctggttctcgcatcgccgtgccaccatcgcaggcaaagcgcacgaaggccgtatgcttgcgctgatcgtacgcgaatagtgggagagcggcgcgctgttgcggattgcgtgcagaacgtaaggcaaagcgcgttgcaaaccgattcgggggtttacggtgggacgtatgagtgagagagagcagatgcaggaacagaagatgccggttgtggccgtggtgttggcggccggtttcggcacgcgattcgatgagaacaatcccaagcagttggtttcggtgggggataagccaatcgtctgctggagcatcgaggcgttcgagcgcaacgatcgcgtgagcgacatcatcgtcgtggtcaacgagcgtgtcagcaatatggtgaacatgctgatcgacgaagccggttataccaaggtgcgtgccgtgattccgggtggctccgagcgtgtggacagcacccgcgccgcgctcgacctgctcaagcaggcgggcattcccgatggcgcgaaaatcctcatccacgattccgtgcgaccgttcgttgaacagcaatccatcgacggctgcatcgacagcctcgaccagttcaacgcggcgaccgtggcgtacgcgtccaccgacacgattctgctgaccgaagatcttggagagcgcaaggtggtgcgctccgtgcccgatcgtacgaacgcattccgcgcgcaaaccccgcaggccttccgtttcggcactatcaccaaagcctacgagctcgctactgccgaccctgacttccacccgaccgacgacacccgcgtggtggtggactatctaccgaacgagccggtcgccatcgtcgccggatccgaaacgaatctcaaaatcaccacacaggccgacatgccgattgccgagaacatcgcgcgcagcctcgacccggaacacgccaaacaagaagcgaaagcgcgcatgcacgcggtgttcgccgaagcgttctcgcaaatgcataagcattgatcgtaaacgaacccacctttcgaccacgtacactggaacacatgcagcagatcaacatcgtcatctcaggtttcaccccgtacgacggcatcgacgtgaatccagccgtactcgttcccgaggcgctcgccgaatattggaatgatccatctcaatccgtggcgctgtctgacgatcttctgcaggatgtttccattagcgtgacgacggtggcgcttccggtcagtttcgccaatgcctggcccatgttgctggatgccatcgaacagacgaatcccgatattgtcatcgccaccggtttgaagcggtccgcccgcggcgtgctgctggagcgatgcgccacgaatctgatggatgcggccaagcctgacgccgacaatgtgattccgccgcgccgtccgatcaatccagaaggtccggcagcatattggacacgcttgccgttgcgttcgattctgcgcgatttcgccaaacatgagattcccgccgcgttgagttcggatgcgggcacgttcgtctgcaattcgctgttctaccatctgctcgactggtctgccgcgcaggaaaagcgcattctgtcgggtttcgtaagcctgccgatcgtcaacgagcagccacatccgcaacatggactgtcgatcgcgcagcaaatcgccgcaggtaacgatgtgatccgcgaatcggtgcgttattatctgcagccatcctcaagtgagattctgctcggctgaacggcgtcggcgtttcctcgaacgatttctgtgctctctgtgagaattatgcgactgccgtgtgccgaacgtttttcctgcgctaaagttcaagacggataggcgcgggcaagatgcgcgatggaagggaattcgtgaaaggaataccatggttgagcagttcccaatcgtgttgagggggtacgacaaggaaagggtcgatgaagcgttcgcttcggctcaggagacggtggaccgtctgcgtgagcaggtcaaggccgacgatcagaccatccttgaactgcaggcacagctgcaggaagagaaaaacaagaaggccaacccgaattcgttcgcatctctgggcgccaacgcgcagcagatgctcgccagcgcggaacagaccagcgccgagctgcttgaccgtgccaagaaagacgcttccgcggcacgcgccacggtgcagcttcaggccgaaaccctgctgaacaacgccaagctcgacgccaagcgtattctcgacgaggccaaggccaaggctgaagcggtgctgtcgaaggccaataatgatgccggcacgctgaagtccaacgcccagcgcgaagcggaccagctgcgtggcgaagcgcagaaggccgtggtggcgcaacgtcagaccgttgatctggaattgaccaactcccgtgaggagcacgacaagcgtctcgcatcggagcgcgccacgcaggagcgtgagctctccgatatgcgcgccgaagccaccgagcagatcgcggcgcagcgcaagaacgccaatgacgagattaaccgcatgaaaagcgagaccaacgaccagatcgaatccgcgttggccgaagccaacaagaagctggccgacgtgcgtgagcaggtgtccaagatgatgacggacgcgcagcgccgtgcctcggaaatcacggataccgccaaagccaaagcacaggagatcaccgacgaggccgaagtgcatcgcaccaagaccatcagccaggtcaatgccgaggtggagcagatccgcgccgacatttccgcccaacaggatgaggctacgaagaaggtcaacgagctgctcgccgacctgaacgaacgccgtgaaactgccaagaagcagtccgacgagctgatctccgaagcgcagcatacgcgcgatgaggccgaggcatacgcttccgacaggcgtgaggcagccgataagcaggctgccagcattctcaagcaggccaccgaagaggccgacgagcagatcaacgagcgtcgtgaggcagccaagagcgagcttgaaggtgtgcagcagcgcatcgccgacctgcagacccgtgaggcgcagatcacgcagcgtgtcagtgaactgcgtgccatgtttgccaacgcgttctccggtttcggcgcgaacggcctgtccgtggtcaattccatcgacggtgaacagcatgagtccgcagctgaagctgaaactccggcggaatcgcacgacgagagcggcgaaactgttgcgggcgaaccggaagtgaccttcgacgaggatgttgtctccgacgaacagcagaataatgacgactttgaagaaccgtccgaagacgagcagtctgaccagggcgaggaagcacaggaggaacagaacaatgactgacatcacgccgttgagcgctgatgcattggcaacgctggttgaggatttcgaagccagcgaccacaaccgtatggccatgaacgcggtcaccgcggcgggcgtcaacaaggtggcgcgcaactatgaccgcgcccgcttgatgcagcgcaggttttccactattgtcgacaatggtaccgccacccatcaggatcgttccggccgttgctggctgttcagctcgctgaacgtggcccgtttcgtggccaagaagaacatggggctgaaggaattcgagttctctcagaactatgccatgtactacgacaagctcgagcgcgtcaactacttcctgcaggacgtggccgaactggtgaaggccggcgagccgtccgactcccgcctgattcagcatctgctcgccgacgtgatgggcgacggcggtcagtggaccatggccatgaacgtgtacaagaagtatggtgccgttccgaaggatctgttcccggaaactgaatcctccaagaacaccggcgaaatgaacgtgcaattgcgtcgcctgttgcatacggccgtcgcgcacatgtatgccgatccgacttcgatcgaatcggtgatcgccgaagcgaccgccgccggccaccgtattctgacgattcacttgggcgagccgccgaagagcttcgactgggagtggaccgacaaggacggcgagttccaccgcgatggtgagatcacgcctgtggaattctggcagaagtacgtcggttccgccgatttggaaagctacgtgtgcctggtcgacgatcctcgtcaggagcatgtgaagggcaagaagatcggtatcgagcacttgggtaatgtggccgggggagacccgaccgaatatctgaacgtgccgaaccagttcatgaaggattgcgtgcgtcagattctcgaagagcagggcattccagtatggttcggtgccgactgccacccgatgatggatcgtgaaaacggcgcttgggccactgatctgttcgaatacggcaaggtgtatggtgtcgacttcgatctgaacaaggaagatcgcgtgcgctttgccgattccgcgatgaaccacgctatggcgttcgttggcgtggacgttgccgaagacggcacgaccacccgtcgttggcgtgtggagaactcttggggcgacaagatcgcagacaagggctacttcaccatgagcgatgattggttcaccgaatacgtgtacgaggtcgccgtgccgaaggcgctgctccctgccgaatatcaggccgctcttgacgaacctgccaccatgctccccgcatgggatccgatgggcgctctggctgactgatacgtaaaccgacaagccgattgacgaatgccgactgcatgggacttcgcaaaaagtccagcatgcagtcggcattcgtgttattccacttttatccgttaaggtaacttcggtgattatcatccaagcacagtatgcatgaagcaggtatgcaggcataaggaggagcagaagagatgtcaggtcttcgcggtccagatagttcgagggatgcacaattgttggatgacgctgtgtttccggagaccgtggatgtcaatattcgacagttggacccgattcccgcccctcgatattttctgaaggaaatcccgcttaccgacgagatgagcgatctggtgttgaagtcccgtcaagaaatccgcgatgtgctgaatggcaaagacgaccgtctgcttgccatcgtcggcccctgctcgattcatgatccgaaagccgcgcacgaatacgccgaaaagctcgcggccgtcaaaaaagagctggaagaccggctggtcatcgtgatgcgcgtgtatttcgaaaagccgcgcaccaccatcggttggaagggtctgatcaacgatcctgatctcgacggccagttcaacattcgcaagggcatgtggctcgcacgcaaggtgctggccgatgtgctgggtcttggactcccagcagccacggaatggcttgacccgatcaccccgcagtacatctgcgacctgatcagctggggtgcgatcggcgctcgcaacaccgaaagccaagtgcatcgcgagctcgcgtcgggcatgtcgatgccgattgggttcaagaacgccaccgacggttcggtcaagccggcagcggactcctgcttcgcggccgccttcgagcatcatttcctgtccatcaatcttgacggacgtgtgatttccgccgaaaccaagggcaatcccgattgccacctggtgttgcgcggttcttcgcacggtccgaactacgacaccgaatccgtggcgaaggcgttggccgatctgaaggtttccaaggcttccggaccgagcgaacacggcatcgtcatcgacgcggcgcacggcaactgcggcaagaacgaagtgcgcgaagctgaagtggtcgaaaacatcgcatcccgcatcgcaacaggcgaacagggcatcagcggcattatgatggaaagcttcctgaaagccggcaatcagaagcccgctccgctcgaccagctggaatacggcaagtccatcactgacgcctgcgtgccgtgggaacgtaccgaacagctgctgcacacgcttgccgaagcggttgaaagccgccgcaagcttgccgaataatcgcaaataagcgtaaataatcgtcaatagaaaaaccgtgcaaaaaccgcgtaatctgcgtgatcgcacggtttttgcattgtgattgctattcttgggaaagatagtgatttggaaagatagtgatttccaaggagagcagtgagatgcagcagcagctgaacacgcctgaagagcttcgtgccatccgtcaggccatggatgaaggtaagaatccgctggtggttacggatgtgccgcgatgggaagatcaggttggcatcagtcgcatcgtgaaccgccgagtgcttgaatttgaggtgcttcccacaccggcgcaggtgttgggcgatctgccgctcagcgatcaggcgcaggaaatcgtcgcctattctcgagatgagattcgcgcctgcctatatggtcaggatgatcgattgctggtgattgtaggcccatgttccgtgcatgatcctgctgcagcgctcgattatgcccgtcgtttggccgcgttgaaagacgagttgggcggcgaattgctgattgtgatgcgcgtgtatttcgaaaagccgcgtaccacagtcggctggaaaggtctgattaacgatcccgacatcgatggcagctgcaatatcaagaagggtttgctattggcccgccgtacactgcttggcgtattggacgccggtttggctgcggccacggaattcctggaaccaaccagcccgcagtacatttccgacgcggtcagctggggtgcggtcggcgctcgcaacaccgaaagccaggtgcaccgtcagctcgcttcgggcatgtcgatgccgatcggcttcaaaaacgccaccgatggttccatcaaagcgccgaccgattcatgttttgcttcggcgcaacagcacacgttcttcggcgtcgatcacatgggccgcgcagccgtggtcaaaacgctcggcaaccccgactgccatgtggtgttgcgcggttcgagcagcggtccgaactatgacgccgaatccgtggcgaacgccatgaagctgattcgtgagaaaatgccggcagaatccgcggccgcgcacggcctgatcgtggactgttcgcatggaaattccggcaaagacgagcatcgtcaggccgaagtggtgcgcaatatcgcaagtcgcatcgccgacggtgaagagggcatcaccggcattatgatggaaagcttcatcgagggtggcagccaaaaaccggcaccgcttgccgaactgacgtacggtcaatccatcaccgacaaatgcttaagctggcagaccacggaacagctgctgcgcgaactcgcgcaagccgtgggcaagcgccgctggaagtgagcgaagcgaaaagaagcgaaaccgagcgaaaagcgtgaagcaatcgaaaggaacgaacgcatgagcacaatcgccatcatcggcgccatggacgaggaagttgccaatatcgcatccgcattgagcgacattaccgtaacggaggaagccggcgtcagcgtgacgcgcggtaccatcgaaaccaacaaggacacgcgtgtaaacgttgctgcaacggttggcggcatgggcaccgtcaatatcgccgccaccacgcagcatctcatcgacgcggaccagcctgacgccgtgattttctccggcatcgcaggcaatctcaacacgcatctgcacatcaacgacgtggtgcttggcggcacgctgcgctacctcgacactgacatgcgtctcgtcggccagtggaagccaggaactgcggaccagccagtggaggaattccactccgacgaccgcctgatcgaagttgccgataaggtgctgaccgatctgaacgtgcatcacattaccggcatcatcgccaccggcaactatttcgtggacggtccgaagaaagtggagcaggtgattcgcgaaaccggcgcggacgcggtcgaaatggaaggcgccgcggtggcacatatcgcggcacgcaacgacctgcccgtgctagtcattcgcgcgttgagcgacaatgccgacacggattacgtggaattcaaggaattcgacatttcagaatatgccgatactgcggcgaaaatcgcagtgaatatcgtcaagcgcatgtaagcgcagcacggcccgtccagcgcatcgattgctggacgggccgtctcatatttcggtatggcgaatctcatgaaagtgaactgcagggaaacttccgatggcgtgagggaatcgcgcacgggaatcactttcgggaaccgctactgttgaagaagaatgacggattatcggaaggttaacgtatgacgctggagcacgtggcgatggcgatggcgattgcgatggcgatggcgattgtggttgtcgcagtggtcgcctttctgctggggcgtgtccggggcgtgcggctcgaggaggatgagatcgactcgaacgatccaagcctgttcggcgcgcagaagaacatgtcgctgttcggtccgcacgtgcctgtgcagcccacggaacgccagcttattgccgtcatgccggaggcgttgatcgtcgtcgattcgctggcgtcggtcaaatatgtgtccccgggcgcgcaacgtttcggcattgttgaagaccatgcgatgacgctcgccgaaatccgagatattctgcgattggtgtcgaccgacagcgtggtgcgtgagcgtgaattgtcgattccgttggatcgcgccgctcgcgccgccgcaaagaacaccgacggcaagggcattgaggcaggcaagttccgcccttccgacacgctgtatctgcatgtgcgcgtcggccagatttccgatgatctgtttgcgattttcatttccgacatgagcgagcagcgtcgtttcgaaatcatgcgtcgtgatttcgtgaccaatgtttcgcacgaattgaaaactccggcaggtgcgatttctctgcttgccgaaacgattggcgatgctgcagacgatcccgatatggtgaagtatttcgcaggccgcgtgtccaaggaatccgaacgattgacggaattggtgcatcgtttgatcgacttgcagaaggcgcaaagcgcggctgcggtgctgaatgcggaacggctttccgtgcttgctttggcacgcgaggcgattgtcgaaaaccaagtgaatgctgaatcgaagcatatcagcatggtgctttcgctgaatggcaagcagaagctggtgcacgtcgagggtgccgaaaacgctgttgaccgggatgacgtgttcatcaacgccgaccatgaaaccatcaaaaccgcggtgaagaacttggtggagaacgccatcaactattctccggaacacaccaccgttgcggtaggtgtcggcagtggcgatggcaaggtctcgattcgtgtcgtcgaccagggcatcggcattccggaatcctcgttggatcgtattttcgagcgattctaccgtgtcgatcccgcgcgctcccgcgaaacagggggtacaggattgggtttggccattaccaagcattgcgtgcaggattgcggaggcactatcgccgtgtggtcgcgtgaaggggagggatcgaccttcaccatcaccttgccccaggcgaaatcggagcaagacgaggaatctgcgaaatctgaaaccgcggaaattagtgaatcagcgcagcttccaatcgaataattcaagcaaaacgaataattcaagcaaataaccaaatcaatcaacgttccaatcaacaagagcacacagaggagaagcaccaatgacgcgcattctgatcgtcgaggacgaggaatcgtatcgagagccgctggtctaccagctcacccgcgaaggctacgacgtgtccgccgctgccaccggtgaggaaggattggaactgttcaccaaaggaggcatcgatctggtgctgctcgatctgatgctgcccgggcttgacggcactgcgctatgccgcagaattcgtgagcaaagccgtgtgccgatcatcatgctcactgcgaaaagcgcggaaatcgacaaggtggtcggtttggaaatcggcgcggacgactacatcaccaagccgtactcgttccgcgagctgctggcgcgggtgcgtgcggtgctgcgacgcaaccagatggtggccgacgcgacggaatcctccgatgacgatattccgctgatctgcggcgacatttccatgaagatcggccagcatgaggtgatggtgcgcggagagaacgtgttcttcccgctgaaggaattcgagcttctcgaatatctcatgcagaacaagggccgtgtgatgactcgccaccagctgatcgaccgtatctgggggtccgattacgttggcgacaccaaaacgttggatgtgcacgtcaagcgtgtccgctccaaaatcgaggaggatccggcgcatccgaaatatctgaccaccgtgcgcggtttgggatacaaaatcgacgttcctgcggaataaagcggaaatatcgcgatagctggaaatatataagataaaatattgcgattccagtaatcatcgtaatttaccgaataattgattatcgattgataactgaatataagaccgtggtatcacgatagtcgccgaagatcggtgaatggaaatgacgaaaacgtccgaagtgtcgtagagtgttcatcttccgttcaccgattttggttttgcaggaccaaaaccaccaataggcttgacattgtcatgaagaacgatggcgacaacagaatatgaaatgtcagaaacatacgccatcagaatgttgacagagggaaaagaataatgcgtaattccattctcgtacgctccattgcagctgtgtccggcattgtgatgctggcttccgtcgcggcttgcggcgacaacactgcttccaacactgattcttcggctagcaccgacaccaagaccaccgaaaccgtgtctggcaacttctccggcgctggcgcttcctcccagcaggctgctgtggaagcttggatcgccggcttccagggcaccaacccggatgccaaggtcgcttacaacccgtctggttccggcgctggcgtttccaccttcctgaccggcgccaccgcatgggccggctccgatgccgccctgtccaatgacgaggtcgagcagtccaagagcgtgtgcgcttccggcaacgccttcgacatcccggtctacgtctccccgatcgcagtggtcttcaacctcaacggtatctctggcaagggcaagaccctgaacatggacgccgacaccatcgccaagatcttcgacggcaagatcaccaagtggaacgatgacgccatcaagcagcagaacccgaaggttgacctgcctgatctcgacatcaccgtggtgcaccgctccgacaagtccggcaccaccaagaacttcctgagctacgtcaaggatgccgctggcgacgcttggggctatgagctcggcgagaactggccgaacgaggttggccaaggcgccaagggcacctccggcgtgatctccaccgtgcagcaggctgacggcaccatcggctacgccgatgcctcccaggctggcgagctcggcaccgttgcagtgaaggtcggcgacaattacgtgccgttctccgctgaggctgccgccaaggttgtggatgcctccccgctcgacgaatccgccactggcgacaaccgtgtggtcgtcaagctcgatcacaacaccaccgaggccggcgcctacccgatcgtgcttgtctcctacgacatcgcctgcccggcatacaaggatgccaacaccgccaagttcgtcaagtcctggctcacctacgtggtcagcgacgagggccagcagaccgctgcctccgctgcaggctccgctccgctgtccgacaccatgcgccagaaggtcctcaagtccatcgacgccatcgaaaccaagtgagctttggtacagtaaacgataagctctcggtgaacggcaactgaccgtctgtttcaggccgcagccgcaacatgaaagcgggtgcggcctgaaacggtacttgtaggtgaaacggaaaacgtaaccatcgaacgtcatcatgacgcaagtcatcgcaagtcatcgaacgtcatcgtagacctgttcaagtaatcgcaagttaaggagaacccgtgagttcgcaaagcaaaacggcacagcagccggtgagcggcaaaaacgcggacaaggtgttcaagggcgtggcctacgcctgcggcatcctgatcctcgtggtgctcgccgccgtcgcgctgttcctgctgttccgcgcatggccgttgatcggcggcgatcagcaggccaatagcgaaaccatcagcaacttcaccggcggcaaggcctccagcttctggggctacgtcggaccgctgctgttcggcaccgtgctgatctccgcgctggcactgttgatttccttcttcgtgtcggtcggcatcgcactgttcatctcgcactatgcgccgaagaagctcgccaccgccttgagctatgtggtcgatctgcttgccgcaatcccgtctgttatctacggtctgtggggcggcttggtgctggtgcccgccatctacccgttctggaattgggtggccaagtatcttggctggattccgctgttcgcaggtcctgccgccaatccttcccgtaccgtcgccactgtgggcgtggtgctcgcagtcatgattctgccgatcatcacctccatgtctcgcgatatcttcctgcagaccccgcgccttcaggaagaggcagcgctcgccttgggtgccactcgttgggaaatggtcaagcttgcggtgctgccattcggcaagtccggtgtggtgtctgcttcgatgttgggcttgggtcgtgcccttggcgaaaccatggccgtgctcatgatcctgtctccgggcctcaactactccatcaagctgctgcaggcctcgcagaatcaaacgattgcagccaacatcgccgcgcagtatccggaagccaacgatctcggcgtgtccgtgctgatcggcaccggcctggtgctgttcctcattactttcgtggtgaatttcatcgcccgtaagcttaccgagaaagcgagtgcgtgatgaccgcagtgaataacaacgcttctccgatggacggtgcccccgtcatcgattttgacaagttcaagccgacgcgttcctttaccgctgcacgtaagcgcaaggacctcgcgatgcgcgtgctgatcgcgcttgcattcattgtggcgctgattccgctgttctcggtgctgctcaccaccatcgtcaacggtgtcaaaaggctgaacctcaacttcctgagctataacatgaccggcgtggtcggtggcaatccgacgccgtccggtggttacggcggtattcagcacgccatcatcggtacgctggaaatcacgttcggcgctatggtcatttccattccgatcggtctgatgtgcgccgtgtacttggtggaatattccaaccgcggcaagctggctcgcgtcatcaccctgctggtcgacgtgatgagcggtatcccatccatcgttgccggtttgttcgcattctcgatgttcacgattctgattggacctggcaccatcaacggtttcgaaggttccgtggcactgtcgctgctgatgctgccgaccgtggtcaagtcttctgaagaaatgttgaagatcgtgcctcacgatttgcgtgaagcgtcgtatgctttgggtgttaccaagcagcgcacgattacgaagatcgtgttgcgtaccgctttgccgggcattgtttccggtgcgattctcgccgtcgcccgtgtgattggtgaaaccgctccgttgctgatgaccgcaggctacatcgcctccacgaacgtcaacctcttctccggccagatgaccacccttccggtgtacgtctaccaggagtactccaagctcaacgcgaactgcccggcttccgccgacgcttcctgcgtgaccaccatcccgatggaacgcgcatgggccgcagctctcgtgctgatcctcatcgtgctgatcctcaaccttatcggtcgactcgtggcgaagatcttcgccgtcaagtcggaacgatgagcggtagtcttacatacagaaacaacatataaggaaccaaaatgggacaacgtattgatgtcaatcatctgaacatctactacggcgacttcctggccgttgaagatgtgaacatcaacatcgaagccaacaaggtcaccgctttcatcggaccttccggctgtggcaagtccacggtgctgcgcacgctcgaccgcatgcacgagatcattccgggcgctcactgcgaaggcgaggtgctgctggaaggcaagaacctgtacgacaaagacatcgacccggttgccgtgcgtcgcgatgtcggcatggtgttccagcgtgcgaacccgttcccgaccatgtctatccgcgagaacgtgctcgctggtgtgaagcttaacaaccgcaagatttcgaagtccgatgcggacgatctggttgagtgggctttgcgtggtgccaacctgtggaacgaggtcaaggatcgtcttgacaatccgggcattggcctttccggcggtcagcagcagcgtctgtgcatcgcccgcgccgtggccgtacacccgcaggtactgctgatggacgagccgtgctccgctcttgacccgatttcgacgctggctgtcgaggatctgatcaacgagctgaagaacgactacaccatcgtgatcgtgacgcataacatgcagcaggccgcccgtatcgccgactacacggccttcttcaacctgaaggccgtcggtcagccgggtcacctcgagtacttcactgacacgaccaccatgttcaacaacccccagaacgaagaagccgagcgctacgtatcgggacgctttggctgatcggcaaaagccgatccgccaaagcgtagcgttgacccagtgggtcaacgcaagcgagctttagcgagccagcaaattatgtttcgctttgcgaagctccttaattgcacgcggctgatcggcaaagccgatctgccaaagcgtagcttcggtccagggcgacgccgttaagcaaacagtccagtggactgtttgtaggcggcgccgagatgcgacagtatcgaggcaggaaatattgccttgccttggcaaggctccttttcctgcgagcttgcacgcggctgatcggcaaatcatttcttactcccgcttgcggtggattgtcgcacgaatgtgtggtcgaaagtggttgtttcgctaaccatttcgatctcattcgtggcggccgttctcctgagcgggagttttttgtatgtgatgtctgatcgcgacacgctctattgataatgattctcaattaggttatgatggcgttatatcacgttagagaggatctatcatgcaccgtattacgagaattgcgattgccgcacttgcttctgtaggaatgcttgcgtcggttgctgcgtgtggaagcggccaatcaacatccgaaaaaaacggaaccatcgaagtggtcgcttccgtgaatcagtggggtaccgtggcgaaaaccctgggcggcgacaacgtcaacgtaaccagcatcatcaattccaccaatgtggatgcgcatgattacgagccgaccacgtcggatatcgccaaactgcagaaagcgcaagtcatcatcgtcaatggagccggctacgacgcatgggcggtcaaagcggcgcaaaccgccaacgcaaccatcgtcaacgccgctgaagtcggcggggtgaacgacggtgagaatccgcatgtctggttctccgccgaggtgcgcaaggcagtggcacaggcgatcaccaaagcgtacgaacaggtcgacgccgcgaaaaagaacgatttcgacaagatgaacgaccaatggacggctgaagaaaacaacgtcgaaagcaaaatcgccgaagtgagacagaaaacggatggattggcatacgctgcaacggaatccgtggcaagctatctggcggaagacatggggctgaccgacgcaacgccaagcgggtacgcgcgagccaccgcgaacgaaagcgagccgacgccaacggatatcaagcagttcaccgatgcgttgaaggcgggcgaaatcaaactgttggtggtcaacacgcaagaggaaagcgagttgacaggcaaaatcacggacgctgcgaaatccgtggaagtgcccatggtcgaactgaccgagcaaatgccggaacaatatgattccctgacggcgtggatggaaggtcttgttgacgccttttcgcaagccattgcgtaggtcagttacataacaagtaatacgaaagcaagcaaaacgggataacaagaggggcgactccgcagtgaaagcggaatcgcccctagtattttcacatcagtcgtttgcatggataccgatgtgaaccgacattcggaattacaggattgcggtgatgatgaagtccagaatgaacagcagcgacacaacccagatcaccggatgcacttccttggccttgcccttgcaggtcttgatcaggcagtaggtgatgaagccgccggcgatgccgtaggagatggagtagctgaacgccatgaatacggaggcgaagaacgccggtacggcctcggagatatcgccccagtcgatttccttcagcgaggacgccatcatgcagcccaccaccacgagcacgcctgcggttgcggcggacggaatggcggagatgaccggggagaggaaggcggacagggcgaagcagatagccacgaccacggaggtcaagccggtgcggccgccagcggcgatacctgcggaggattccacatacgtggtggtgttggaggtgccgcagatggcgccgatggaggttgcgatcgaatcggcgaacagggccttgtccatcttggaggagaagccggaaccgttttcgagggcttgctcgtcttccgcggagaagatgccggtgcggcggccggtgccgatgaacgtgccgatggtgtcgaaggtgtcggacatggagaacgcgaagatcgtcagcaggatgatcggcagcttcgacatgtcggagaacagcgatgggaagccttcggcgctgaagatagcgccaaaggtctgcggcagctgggcgaaagtgtcgccgatggagagggagttggccatggtggtctgacccattggaatgccggcgacggcggtgaccgcgatggcgatcagcatgccgccgcgcaccttgagcacggtgaggatgatggcgaggaacaggccgatgatgaacagccagatggtcggattgttcatgacggccagacctggggtggcctgcacggtatcgccgttcttggcgtcggccttggtggtgaaggtgaagaagccgacgttcagaaagccgacgtaggccacgaacaggccgatgccgccgccgatggcgttctgcagcacttccggaatggcttggatgatgatcttacgaatcttggtgacggtgatcagaatgttgatcaggccgcacaggaacaccatgcacagggtctgctgccaggtgaagccgaggccgaagcaaacggtgtaggtgaagaacgcgttgaggcccatgccggcggcctgagcgtacggaacgttggcgaacaggcccatgacaagcgtgcccgcgatggctgcgatgatggttgcgaggaacacgccgccccacggcatgcccgtttgcgacaggatctgtgggttgacgatgatgatgtacgacattgcgaagaacgtggtcagaccggccatgacctcagtggacacggtggtgccgttctccttaagatggaagaacttttccatatctctctatctctcttgggttggtaggaacgttccgactgttgcgcggcgcgttccggcgagaattgcgactcgccttatggaatcgtgggattccgaacaaagactaaccgtaacacttaagcaagtcatgaagatttcgtgaagtgcgacacgcccggatcttcgcaagtccaagcatggtcgtaggttattcacctgtaaaccacagaccgttggttggagtgcgcaagcgctcatgaagtttggttcgccaagccaacgcaggttgaagaacatacgcccaccaagggctttccgcttagcggtcgaatgttgctctgcctgtgtgcagggcttttttgttgcccggcgaaacgttcctgcttcacagtcaatggttgactaaggaaggaacgccatgaagaggcccgaaaaggaagcggtgatcgcccagcttacggataagttccgtgacgctgatgctatctacctgaccgagtaccgcgggcttaccgttccgcagatctctgaactgcgcgaaaagctaggccgcgatacttcctacactgtggctaagaacacgctgattcgcatcgcagccaaggaagctggcgtcgaaggtctcgatgagatcctcgctggtccgaccgctgtgaccttcgtgaagggtgacttcatcgaagctgcgaagaccctgcgtgacttcgccaagaccaacaaggcactgatcatcaagggcggcttcgctgatggcaccgtctacgatgctgaaggcgccaagaagctggcagacctcaagtctcgcccgcagctgctcgccgagttcgccggcgacatcaaggctacgatgtccaaggccgcgtacctgttcaacgctctgccgaccaaggccgtgcgtacgatcgatgcgctccgcgagaagcaggaaaaggccgcctgatttcattgcggttagccgcatgaatgatagtgaccacaaaagaaaataattgttttaggtgacggtcacctcttcaatcaagccgttgccaagaatgaaaggaagccattatggctaagtacaccaacgatgagctgctcgaagctttcggtgagatgaccctggttgagctctccgagttcgtcaaggctttcgaagagaagttcgacgtcgaggctgccgctccggctgctgtcgccgttgccgctccgggcgctgctgctccggctgaggaagagaaggacgagttcgacgtcatcctctccgccgttggcgacaagaagatccaggtcatcaaggccgtccgcgctatcacctccctgggtctggctgaggccaaggctctggtcgacggcgctccgaaggctgtcctggagaaggccaagaaggaagacgctgagaaggctaagtcccagctcgaagaagccggcgctaccgtcgagctcaagtgattcgcgcggcttgaagccgcatatcacgatcttgagtggaaaccccgttcgccacaaggcggcggggtttccgcatattctcaggtttttctttcgctgacaatccaataaaacccgatttgggcgtgaacgcttccatatcgtgccatacaatgggggaaataggcgaaagttgtcaattaatcgcgtcataatcctgaaatacgtggcaaggcatgacacaatggcaaagagtgttgtgtgtgaaaggaaggccgacaacggtgagcgaagatcaacgaacggcgcagcagtggaccgtcaaggttgatggaaccgaactcaagaagctggacagcggcgaaagcgtggaaatcggccgtaagccgttacgtcctctggtggatgatggattcgcgcgacttgacattatggacgcaaacaaatccatgtcgaaacggcatgccattttttcagttgatgcgcagggcaatgcttccgtgcgtgatctcaagtcgaccaatggttcgttcgtggtggccgacaatggccaattgatgcgtctgccggcggatgaggatttccaattgccgaccacaccgatgacgctgcaattcggtgacgtgcgcgtcaccttcgaacgagacatcgcacagacagtgcctgagactgagagccatgcgtcggcttcggtctccaacctgttctcctacgcagtgtccgacgaggtgccgcaggagcctgatgcggtggatatgtcggtcgatgatattctcaacctgcgtgccggcgagccgaccgcattgttcaacgcgcgcaacgtcgccaatcgtgttaatttcatgcaacttgccgagcgtcagtcttttgctcccgtccgttccaacgagccggattatggagatttgccgtctgtttcgctggtgcagcataacgtggtcgcagacaatactccgcgcgacctgttcgcggatgccgtggcggaacagcaggccgcggaggaagccgccaagaaaaacgctgcggaaaacgaacatgaagcgaatcagccggaatccgtgcaggaagtcgcattgccgacgcaaaccgcaacaggtaacgaaaccgagcatgacacgattcccgtgagcaagctgttcagcgcgcatccgagtaaaccgattatcgtggcgttgccggctgaagacaacaatatgtcggaacagcagacagaagcatcgcacgagcagtccaacgaaataggggagcagtctgccacgatcgtggagcagacaaacgacgaaactccaagccaagaggaaacagcgttgcagcaggccgatgatgagcgcttcaggccacatgctacacaatcgcaggttgcgagcgaaccgtcgccggacgaaaccagcgcgttcaagcctgttttcgaacccggatcagtgttcgaccgcgtttccaagggcgagctcgtcaagcaggagcagaccatcgaagtcgacgggctgacttcggatgatgccaagcgcaccgacgatttcaccgtgcagttcgagatggcgcgtcatccggaactgctgccattccttgccatgaacccgtcactatatgacgatctgtatgcatggctgggcgcattgggcaatacagacatcgacgcggccctgtcacataatccggggtatacggaataccgtaaagcggtagggaagtgagccaacacatgagcgaaagcaaagagaacgtcactgagctggatcgtattcgtgggtggcgtgagaagtatcgtcttggcctgtcgccgtcgccgcttgaggatgtgacgcagctgagtgcccaacttgatatgacgcacgcgcacccgtccggcatcgcgcagctattcgccagcgggcatgttcagctcaattccttgttccgtgacaatggcatgttacgtgccgcgggtcgtcgtgtggaacgtgtgcttgatgaccgtgaggcgaaaagccgtgtcagcggcgtgggcgaattgtctttggtggtcggcgtggccatttggaagggcaatcagatgccggtgctcatgtacccggtcgaagtgcgcaaagaaggccgcaatatcgaaaacggcacggtgatcgcattcacagggcgtgtacgtctgaacgcggctttcgcggccgtgctgcgcgagaacaacgtcatattggatgaggccaagctgtttgacggttcgaactatgagagcggcacgccagagacgtccgcggtgttcgcggccattacggatcgtgcggccaacgcgttccccgattttgagatcgaacggcacattattctcgggtgctttatggatccggcgtcgcagatgctggtggaaagccagaaaatcatcgatcagttggcccaaggtccgaccggcaacaccgctttggacgctttggctggagacaaggccgccgctgaagcattggagggggctgagattccggaatacagcccgttcgatgccgatccgcatggcgagtatgaggtcggcgatatcgacaataccgtccgatacgcttcgcaacttgcgtccgcgggccattcgttgtttgtggatagctcgattgctaacaataccgccgagcaggctgccgcgatcgcatcccgttgtgtgatgaacgggcgttccgtgctttatgtgccgtgcgtgaccgatcagaaacgtcgatttgtgcaggccgtcgccgcgaatgagatgagtggacagttgttggatatcgccgatgacggtgccaatgcggctattgatcgtcaattgattgccgctgttggattccaatccggtgttgcttcgtctcgatttgatcagatttccgacgaattggttggtgtgcgctcccgtttgacccgttatctgggcgatcttcatggcgtgagccaggagtggggcgtatccgcctaccagacgattcagaatctcgctcagatcgcggcgctacccacccatccgaccacgcacgtgcgtttgagtaagcagactgcgcattccattgcggacaagatcgaggattgggctgcgaaactgcagcgtgcgggtgagcttggcgaatacaccatcacggagaacgacaccgcatggtacaaggcttcgctgtattccgaagaggaagcggtgagtgcttaccagcgtgtggtcgaactgttgcgcaaggtgctgcccgccacccgtgagcaggtggccagcacggtgcagacctgcggattcccgattccaacgaccgcacaggagtgggggcgccaggtcatggtgctgaagaacctgcgccgagtgcttgacgtgttccagccggaaatcttcgaacgtgacatcgcatccatgattgaggcgaccaagccgaaggccgaacgcaaggccgaaggcagttccatgggattctgggagcgtcgccgccacatcaaggaagccaagggcatgctgcgcgtcggtgcccaagtggagaacctgcacgaggcgttgcttgtggtgtccaagcaggccgatcagtggcatatgttcgtgcctcatggcggctggccggtgctgcccaccaagctggatgacatcatcgaaacgcaggagaatctcaatcgggatatgaccgcgttgaatgcggtgcttgccacaaccccgcagggaggcaatctcgaaaccattgacttcaaccaggtcgaagagcgtttgaaggccctgtatgacgacaagcaggcgcttgacaatctgccggagcgcgcccgtttggagcgtgacttccactcggttggtcttgacgagctgattgaggatttgaacaatcgtggtattcccaacgatgccgttgcaggggaactgcagttggcatggtggaccacggcgttcgaggatattgtgaaatcctccgccattatctccaaccaggatggttcggcattgcagggcgctgcggaacgcttcgcccaagtcgacgtggagcacgtgcgttcgatcgggccgatggtggcacaggaatccatgcgtcgcctgtgcgacatgctgttctcgcgtacgcaggaagccaatctgctgcataccatgcttgccggctcccacaacgtttcgttgaatcgcctgcacaaggagcatccgcagattctcgcagcggcgaaaccgattcttgttgcgacgcccgccacacttgcagcgatcaccgatccggcgccgttagctgacgtcgtcatcatcgatgcagccgcgcatatccagtccatcgaattgctgagcatcatcagccgtgccaagcaggtggtggtgatcgcacatcgtgaaacagtcacatccgatggtctgaagcgtcttatcgcactgctaccgagcgtaaaaatcgccaatcgtcctgttcgacgcgctccgaagctcaatgcgttcctggaatcggaaggctatggctccgtacctttcgacgtggcaagagaaggcgcgcaaggcgagatcgcctaccatttcgtacctgacgccaacggtgtgccggtcatcacttcgggactggtggaaagcagccagcaggagatcgacgaggtggtcaggctgatcaccaagcgcgccgccggttttaccattgtgcccgcatcatacatgcttacggtggtgacgcttacgcatacgttccgcacccgactgggggcagagctcaaggccatcgccaacaagaacaaggccatgggcatgttccttcgccatgtgcgcatcgtggatatctccgacgtggccggagcgcatgccactgatgcgattcttgcgatgtgctatgcgaaaacctcccatgggcgcctactgcagcagttcggagcgttggaatccgaaggcgggcgaggcatgctgctggacgcattggccgtgccggaccgccatcttgacatcgtgtccgcgttctcgtcgtccgacatggatgacgaacgtctgcatcaggctggtccgaagatgctgaagaccgtgcttcgttggatggaacagcttgatgacagcgtggtgcgtcccgccgtcaagatgaccggctcgaacgtgcttctcaacgatcttgccgatcgcattcgagcccgtgggctgaatgtggccgtcgattatggtttcgacaatggatccaagctgccgctggtggttggtctgaacgacaagccgttcgcgttggcggtgctcaccgacgatgcgcaattcatgggattgcagtccaccagggaacgtcaccgtgtgcttttgcagaacatcgaatcgcttggctggtctgttatgaccgtgtggagcgttggcgcgttcgtgaatccagacaaggaagtggaccgtatcgtggcacgcctgagcgacctgtatcaggaggtcaagtgagcgtcgacgagcattctccgcaggagtcttcccaggaaactgaccagcctgccgttcgcgtggtgtccggctattgcgccactcgccgaacggcacgcaggcacaagcgtgtgatccgccagggcactgagctgttcgatgcggacggcgttaagctcgaaccgtccgatgtgctcaccgaacgtcagcgcaatgcggatgacgacaagcgtattctgggtgaactgccgccgcattggggcgtgttctccgagaggggacgctgacattcgcttgggatttgcttcgttgtcgtcacgaactgacgatggcgataatcgcgctgttctcttgagcctgcaaaacggtcgccgcttcatgaggaggcatggcaaacaccgcaagggtgttgccgtccgcatcgcgcgagggtttcgcggtcaggatcgcgcccgagcataattcgcgcagcgtcacggcatctgtatccggggatgtttccggtgttgcctcgccgaatatcgtggcgctggaaagtgtcacgacatcgccaagcgacagattgtcggcggaacttgccaatcgcacttcgattaccgtgtatccttcggaaacaacgggagaggcacgcgccatggtcgacgtgacgatgccgccttccgcaacgtccacttgggcgattagcccgacggcatcggcgcaatcatggaaaacgttacgtaaggccttgtcatacggaagatcgcgcaatgcgagcgaatccgcggtaatcacgctgcctttcgcaatgggctgcgctgcgatgacaaccggttgcgtggaaatcgtcaatcgcacgcactgcagggctgcgaacatggcaagtccggcacagaccgcggcgagcagccggtgcaatcgtgcattcttccgtcgccgatggggcgcagtcctcgtgccatcggtcgttcgcctgccatccatgccctgcagacgttgcaacaaatcatgaaaaaaggtcaccatgcatgcatgatgaccttacgaatagctgttacgcaagccgaatcaagggttgtggtcggaggatgtaagttatccacaggcttcggcatgtcgccttgttttccaagggttgagcttgtttgaattatgtgattgagctcacttggatttgtcggtgcggtagaaaccggatcccttgaattcgatcggcggtgcggaatacaccttgcggacctgttcctcgccgcattcggggcagatggtgatcgggtcgtcggtgaacgactgctgctcggtgaaatcgtagttgcagttcttgcaacggtaatgataagtaggcaaagtatcctcgcttcaaccaggttctcaaatttcttaacgggacatatcctagtacgctccctgagacggccgcatgaacgtcttgttcacgaatggtttattggcgaacctccgtgaatccatccggcgtaagcactccgtcaacgggaatgtcgtgcgcttcatgtggcaccggcttgtcggtcggctcccagggccagcagaccgctaccacgcgcgatccgaccgcacggtattcaagcgcccggtcgtaccatcctccgccacgacccaaacggaatccctcatgatcgacggcaaaagcgggaacgatgatcagtccagcgtttttcaacgcttcgggcccgcatacgctgttgctgggttcctgcggacgatgtgtgttggtggagccgtcgctgttggtctgatcgcgcagatcgtggacgctgtcaagttcgctccaaccaatatccatgccttctccaagacgtggaacgagtacgcggcagttcgaatcgaaaagcgcctgcagcattggtgtcatcgacatttcgctgcccatggatgcgaatgcggccaccgtggtgaatgaatggatgagattcgcctgccgtgcctgctctgccagtttttgaccggctttcatccgttcctcagggcttgtccgttttcttcttgcgattgcgttcttgcgccattgccgtttcagctcgcgttgcgttgcggtttcgtcacgcgtgctgtctcctgcgacatcggtttgcatattctgggtcatatcgcatgttgtaccacgggatggttgcgcgaaaacgaaagtgttatgcgcatggcagaatgaaagcgtgacgattttgcaatctttgcgcggcatgatgcgttcggaatccaatgccatcgatgttccgcggtttatccaatcgcacgggctccacgttcccataatcctgcggccgctgaccttcgacgactgtgacgaatggaacgacatccgttggcgtaatgacgactggctgaagccgtgggaatccggagacccgttgcatggtgcgtcgatgtcgttcaatgagtgggtgcgtgcgatgcggcgcaacgagcgaaacggcaccggagtggtgttcgccattgagcagcatgggcgtatcatcggccagatttcgctgggagcgatctgttatggcgccatgcgtactggtgtggtcggctactggatcgacgaacgctgcgcaggtcgtggatatgctcctatggccgtcgcgttattggctgattgggcgatgtttgatccttccggaccgcaattgcatcgtatggaaatcgacctgcttcccgaaaacgagcgttcccgcaaggtcgcgctcaaggtgggagcatgttatgagggtgtgcgcacatcgtacatgttcgtcaacgggcaatggcgtgatcatgaatcgtatgcgctgctaccggagtgcgcaccaaacggtttcaccgcgcggttgatggacgagtgagccgttgacgaggttcaacacgcgctttcgacgcacatgttcgacacgcgggggcgtgtgccccggagaatgtcggaatgtcacctattcttatgagttatgggttatgaatcgttaagcacggttgtggtgcttgcgattgtgattattctcatggctttctggctgcccaaacggacggtcaaaggcatgaagcgggtaatcgagcaccgagaggaccgcttttcgccgtcgctgcatctggtggatgccgacagcggaacgcgattctccgatgagaccgccgcaaaggcgaaaggggcaataatgcagtccaacgagacgcatgagggcaagctgaccgacgaaaggatcgcgcatgtccgtgcctttcgtcgtgccgcgatccgcagaaggcggattattgttgtctcgatgctggtgatcacaatcgtcgtgttgatgtgcgcgtttgtgttgcatttcagtccgttgtttgctttgattcccgcatcgctgcttgctggagtgcttgctttgggggtgagggccgccaagcaggccgcagcgtgggagcgtaaggtcgccaagtatcgttccaagatgaggaagcgggctgcggcggagcgcaagcgtgcccaagaggaacaggcggagcgctcgcgtttgcgggagcaggagcttgaggaaattcgtagaatcgccgaatctcaggtgccgaccgatgttatgccggaaggtgagattcgtcaggcgatcgatcgcggcaaggtcgaccgcgatgctgccgtaagcaagcgtaaggagacgcctgaggcgaaaaccgatacggaagtgaatgttgtggatgcgcaagtcgtgccgagcgagacgaacggtctgtccatccacgatgagcgggatgaaatcgccaaaaccgagaatgtggacgcccgtgacgatatgtcgtcgcccactgtggtgaacgcgtcgcaagatctgatttcgttttcgctgggtacgccgcgcaatggcgacgatattgtgcaggccgctccggaaagcatggagattaaatccacccgtcaggtggccaaggccgtgccttcgactgcgagtacggtttccgacaatgtcgagccgttgattgtgccgaccgatgcgatcagcagcatggattccgatgaggccgccgcccgcgtggaggctggtgtgcatctgcgggacgtggatgccgtgggattccatgacgccgaggtcagcgccgacgtcgaggctcccagcgttacctccgattctctgggtgtgggcttggcatccattatggcccgtcgtggtgcatgacggagggaaagcgaacgtacgaaacgcacgaaacgtgcaaacaagcgtaaagaacatcagcctgaaaccgaatggtttcaggctttttcgtatattttgctctcagcgttagcactcgagttggcagagtgctaataatcgcgctaggatatgtctcagcgcggaaggacgacgccgtaagtgatcgtcagcctcttgcaagcgggtcccggcgcggtaagtaacgatttctcttagaaagaggaggtccacagtgtcgatctcactcacaccgttggaagacaagatcatcgtcaagcaggcggaagccgagacccagaccgcatccggtctgttcattccggacaacgccaaggagaagccgcagcagggtgaagtcctggctgtcggcccgggccgtcgtaacgacgccggcgagcgcattccggtcgacgtcaaggtcggcgacaaggtgctgtactccaagtatggtggcaccgaggtgcactatcagggtgaggattacctgatcgtctccgcccgcgatattctggccattctcggctgagcgtagcgcgtagctgtttgaagaccccgtcagcgaacgattggtgaacaatcgttgccgttggcggggtcttgttgatttcaagcgcttgaagttcctgcaataggctgtgcgcggtcgatgcgcgccatgttcatcggcattggcgtgctgttgttggcgtcgctgttcaaatggtctgcagggaaagtccagaaaaaatactcatgatttttcttttctggattttctcatgaggatttgctctgattggcgctgacatgtagctgatagtggaaaaacgttggaatttcaacgatttggagctttttaggcaatcgcgacacgccgtatttgcattagtcacatggtctgtggcatactaaacgggttgccggttcgggttcaaccaaacaggcagcacggcggatttcccaagcggtcaaagggaactgactgtaaatcagtcgcctcgtgcttcagtggttcgaatccactatccgccacgcctcgatagctcagtggtagagcacttccttggtaaggaagaggtcgtgagtccaattctcactcgaggctctcatggcgggatagctcagctggctagagcgtacgactcataatcgtaaggtcaagagttcgagtctctttctcgctacaaaggtcgacggaacgtcggcatagcaacgaaccacaagaggtgaacttagatggcaagcaagagcgccgacattcgtccgggcatcacgctggcatgcaccgagtgcaaggagcgtaactacatcacgacgaagaaccgccgtaacacgccggatcgtcttgagctgaagaagttctgctcccgctgcggcaagcagaccgtgcatcgcgagacccgctgagcgagttcaaagctttcaacccgaccaattggtcgggtttttttgttttctccgaaacccctcttgacaccttttcagctgccttccccgcacgctaagctaatcaccatgactaatttcgcagatctcaccactattgccgtaggcgggccaatcgcatcctttattgaaccgacctcgcgtgtcggcgttattgaagccgttgaagatgctgacgccaaaggcttgccgttgtgcgtgatcggaggcggatccaacatgctcgtggccgacacgccgttcgatggcgtcgtggtccgtgatgcgcgacacgccgtaagtgtgcttgatgaggcagcgcctgccgaaaacgacgaaaaaatcgtgcacgtcaacgccgaagccggatgcaattgggatgatttcgtcgactactgcgtcgggcttggcctggaaggcgtggaaggactttccggcattccgggcaccgtcggcgcgtcggtggtgcagaatattggcgcatacggccaagaggtcgcatccagcgtcgaaagcgtggaagtctgggaccgcaaagacaagcaaaccaaagagctcaccaatcaggaactgcatttcggttaccgtatgagtgcgctcaaagccagcatgtacagcgctccggccacacccgcagccgacttcttcccgacgccgcgttacgtggtgctgtccgtcaccttcgcactgcatcacagcgcaaccggcgtggtcggctacgggcagctcgccaaggcattgggcgtggaagtgggcgaacgcatgtcgacaacggatattcgcaacgcggtattgaacgtacgtgcctccaagggcatgcttgaggattcccaccgttacttgaccgaagccatgcgcggcaccaaaaaaagcgaactggtcgccatcgcgcataatgcgcagcgtacacaggcaggcaatgacgaacccgactataatcgccatagctgtggcagcttcttcatgaatccgattctcaccaaagagcaggcggcaaagcttcccgaagatgcgccgcgattcagcgctaccctgccggatggcacgcctggagtcaaaacgtccgcagcatggcttatcgatcatgcaggcttccataaaggctacaaaaccagcgaaaacgctactgcgggactgtccaccatgcatacgttggcgttgaccaaccgaggaggagcctcagcagccgatatcgtgaaccttgccaaaaccgtgcaggatggtgtcgagcgggcgtacgacatccgtctcgttccagagccggtcgtcatcggcatgagcctcaagtaaacgtaagaacgaagggagaagggaaacgtaatgaacgtattacgcaagaaatccgtcgagcagacgctggcggaaacagaggagtcggggcattctctgaaacgagacctgacctggtgggatttggccattatgggcgtggccgtggcagtcggcgcgggcatcttctccatcggagcccaggcggcagccttccatgcgggtccggccgtaatcatcagcttcctcatcgccggcgtggtgtgcggtgcggccgtaatgtgctatgccgaattcgcgtccatgattccggttgcgggatccgcctacaccttcacctacaccaccgtcggtgagatcgtcgcgtgggtgatcggctgggatctgatccttgaaatgctgatggcaggctccgtcgtctccaaatattggggcgtctatctcaacgatttcttccggctggttggttggaatatcaacaccaacgtcaccatcggatcattcaatttcgatttcgcgccaatcatcgtcgtagctttcttcacggcacttttggtgtgcggtacgaaaatcggcgcacgagtcgacggcgcgctcaccatactgaaaatcgccatcgtgctattcgttgtaatcgtcggattcttctacgtcaaagccgagaacttcaccccattcattccaccgagcgaaccggcgaccgccaccggatccgggttggccgcaaccatggagcagccattatggcagtgggccaccggcatgacccccagcatttacggcattgccggcatcatctctggagccgcgctcgtgttcttcgcgttcctcggcttcgatgtggtcgccaccacctccgaagaaaccgtcaatccgaagaagaatgttccgctgggcatcggcgtgggcatgggactgatcatcgtgctctacaccctcgttgccattgtcaccaccggcatggtctcctacaaagacctcgccaagcagaaagacccgtcgctcgccacggcattcgaaatggtcggcgctgactgggccgccaaaatcatcagtttcggcattgtgatcggcctggcaaccgtggttatggtgctgctgctcggcctgacccgcgtggtgttcgccatgagccgagatggcctgctgccgcgctcgctcagtcacacgggcaagcacggcactccagtacgtctgcagattgccgtcggcgtggtcatggcactcatcgcagccagctgcaacgttagtatccttgccgacatggtgaacatcggcacgctgtcggcattcacccttgtttcaatctctattccaatcatgcgcaagaagcgccccgacctgaagcgagtcttcaaaatccccggcaatccatgggtgcctatcatcatcgcgctcgccaacatctggctcatgctcaacctgagcgtgctcacctggattcgattcgtggtctggcttgcggtcggcttctgcatctacttcggctacggctaccgccacgcccggctcggcacgggagagctggaagttggcaattaagagtagtcttgaacggtaagtgttaaggaggtaaccatgccatacgttgtcgctcagccgtgcgtcgatgtcaaagacaaggcctgcgtggacgaatgcccggtcgattgcatctacgagggctcccgttccctgtatatcaatccgaacgaatgcgtggattgcggtgcatgcgaaccggtgtgcccaaccgaagccatcttctatgaagacgatctgccagacgagtgggcttggtacaaggatgccgcggtcagcttctttgccgaagttggtgatatgggcggcgcttccgcagccggcccgatcggcaaggatccggagcaagtagctgctctgccgccgcaaaatcagtgattggcatttgaaagcggccttttcccgttggaagaggccgcatattttgtttatagaggattattaaggagttttcacgatgggctttcatgagttttcttcgccatacgattggtcgcgtatcgcagcatacaagcgcacggcaaaagctgcgttcggaggcatgatcgacctgtccgtgggatctcccgtcgatcctgtgcccgactcggtgcgcaaggcgctcgcagcggcggcgaatgatccgaatgcgtatggatatccggctactgcaggtactgccgatttacgtactgcgattgctgaatggttttcggcgactcgcaatgttgatttgcaggcgattcatgctgatgtggtgcctaccgtcggctccaaagagggtgttgcgttgatggcgtcgctactgcatttcggtgaggatgatgttgtggtgcagccgaaggtttcgtacccgacgtatgagatcggcacgcagttggctggggcgaaggtgcttaaggtcgacgatgtggctgatgttgcgtcgtggcgcaatgtgcctggtgtcaaagcggtgtgggtgaattccccttgcaatccgacgggcgaggtgtattcggccgagcggatggctggcattgtcgcagctgcgcgtgagatcggcgcggtggtgctttccgacgaatgctatgcgctgatgcagtggaggggtgctgtgaatggcgctgaaggtgaagctgattcacttgcgtcgacgccgtgcgcgctttgtgacgatgtgtgtttgggctccgccgagggcgtgctggtgctttattcgttgagcaagcaaagcaatatggctgggtatcgtaccgcgttcattgccggagatgagtctttgattgcatcgatgagtgcatatcgcaagcaaattggtcagattattcctggtccggtgcaggctgcgatggctgccggattgcgtgatctggaatccgtcaaggttcagcatgcgcgctatcgggaacgtctcagcgtgttggtgagcgcgttgcgtgcttacggatactgcaccgacatgccggatggtgcattgtatgtgtgggtgagagccaagtcgggcgattgttggaccgatatggagcagcttgccaagattggcatcatcgccagccccggcgagttctatggtgcgccggaatgtctgcgtttctccgccaccgccagcgacgaggcgatcgcttccgctgctgaacgtttggcgcgctaagccgatatgcaaaaggggcttccggcaatcgctggaagcccctttatctgcggagtcagggggagtccaacgcccatgcgtcttatggctatgcgcagctgttgatgtcgctgatggcaaagtgaacggcgtaggctaggccgcagggcgtcgtccctggtttacttaaatctattcaaaagtttcgtaaatatttgcatatagagctttcgtaacaaaaaattttaagtatttagttaagtgacttgactttcttgaaaatcaagtcatataatcaagcagtgctttaactgaaatgctaaagcatttatgaaacatgacgatgtgtgttcatgcatgtcaccaaaggagaaagacatgatgaggtcaagaacttggaaacgagtgcttgctgctgtttgcgctggtgtagcggccgtttcaatggctgcttgcggcggaggtactaataacaccgcgaaggacggagtcattatcaacagtgttatgaattcaacttcgcaggcgtcgttgaattataatccgttctcttctacagctttgaccggtgtggtcggtgctctgtacgagccattgttctatatgaacaaccttaaggacgaccctactaagctggaaccgctaatgggtaaatcctacactatcagtgacgatgcgaaaactattgatgtaacgattcgtgacggtgaaaagtggtctgatggcgaaccttacactaccgaagatgttgcatacacattcaacctccttaattccaacaaggctttgaataccagtggctttgctggctctgccaaggtccttagcgatacggaagttcgtatcactttggacaagcctgaatcggtgaatgctctgtcgtatctgtccggcacgatgattgttccgaagcatgtgtgggaaaagatcgatgatccggtgacctataccaataaagacgctgttggctctgggcctttcacagttaagggcgggaacttttccccaaccgcttacacgtttaagaagaatccgtactactgggatgaaggtaagcctgaaattgatggcgtccgttatgttctgatcaccggtggcacccaagcttctcaaaatgccttgaccgctggcgatgtggactggatgtctgcgatcttcccgaatatggatgatgtgctgtcgggatatcctgatattaagacggttaacgttccttctagtcagttggcattcatgacctgttcgaacaaagaactcggctgcagtggtcctaccactgatccggcagtgcgcaaggctatctattacgctcttgatcgtaatcagattaataaactcgctctgaatggccagtacagtgagctggctggttctctctatccgtatggacagttcaccaagtacgcttcggatgatgtcccggattcacctattccgggtaaaggacgtacggatgaagccgtcaaggtactggaagacgccggctatacgaagggtgatgacggcatctatcagaaggacggagttaagctgagcatcaaagtcgctgttatgagtgatgtctctgactggatcaacgcgattaacgtcgcctcgcagcagctgaaaaagatcggtattgatctgcatgcggaccaaatgtcttctaatgaatggactcaggcgatgcagcagggccagtttgaaatgtccatttatggtctgtgggtcgcaggtgccgaaccatggatgttctacaaccagttctattccactgccagtacggctgcagtgggtaagagcgcttggcctaattacgctcgctacagcaataagaccgtggatgatgctcttaatgccatcaataccaccactgatgtggcgaccaagaagtctgaatatgagaagattcagactcaggtgtttgaggacatgccgtatatcccgattctgcgtcaatccggtctgagcgaaatgtggagcgacaaggttaccggttggccgacagacgataacgtctatgctaatccgcagacttgggcaaatcctgatttgggcattgtcctgaagaacctgaaggttaagaagtaacctgacggattttatgaatcaacggtgcacaaggcgttttagctgtgcgttttgtgcaccatttttccatgtagaaatgaggtaacatgaggttctacctgaaaaagataggattttaccttgttgcattgtttgcggctttgacattgaactttgccatcccgcgactgatgccaggtgatccggtttcagctgttcttaccaggctcgcatcgcgaggtggtactgttgcgcccgaaacaagggaagcgattactgcaatgctgggacaagatggaggcaacatcttccagcagtatattggttatctgaagaatatcttcaccggcaactggggcgtatctgtaacgtatttccccaaccaagttacaacgtccattgcttctgcactgccttggaccatttgtcttgtcggcacaaccacgattatatcgttctttgttcaacaggctcttggtatctgggctggttggcgtcgtggtggcgcttttgataacatcatttcccctgtgtccaccattttccaagctgttccttacttctggcttgcactcatcttcatttgggtgtttgcccgtacgctgcattggttccctcagtcaggcggatacaattatcgtgaagttgtgcccggcttcacttgggaattcttctcgagcgcagtgcagtatgcaatcttgccggccttgacgattcttgtcagctctctgggcatgggtgttgtcggtatgcgtaatatgatggtctccacgttgtctgaggactacattgttactgctgaggccaagggtttaagtcctaaacgcgttatgatgtgctacgcagctcgtaatgcagtgttgccatccatttctggctttggcacgtctatcggtgcagtggtgggtggatcgctgcttactgaacaggtgttctcctatccaggtgttggtcagatgcttttgcaagcggtgaccagtaacgattacgcgctgatgcaaggtatcttcctgattattaccgttactgttctagtcgtgaactttatcattgatttgctttacggcattatcgatccacgtacgcggcaacaggattgaggttaaatatgtctgcaacaaattcttctgctgctgtggctcgtagccaagctaaacgtcgtcgctccgctttggattctctcaagcgagttcttcctgagcgttctgcaaaattgacggctggattaaccattgtgatcgcaatggttttgttcgccattattgttcctatcttcacgaaggatcctaataagatcaatgacattggcttgtctgcgccatctgcccagcattggttgggcactacgcagtctggccaggatgttttcactcagcttggctattctgtccgtggctctctgattattggctttgctgttggcttgattgcaactgcgttgtcgttcattttcggtgttttgggcacatatattggcggaatttgggatgatttgttctctctgattaccaatatcatgctggtgattccggggttgcctctgaccatcgtgatttctgcattgatgccttccaagggcacgatgatgttggtcattgttatttcaatcactgcatgggctggcggtgcccgtgtactgcgggcgcaaacattgtcgatgcgtgggcgtgattatgttcttgccgcaaaaattgcaggtgaacgtccgtggcgcgtgattaccgttgaaattctgcctaatctgttgcctgtgatgggatcgcagtttgtgttctccgttattatggcaatcctgagtgagtcttcgttgtccttcattggcctggggtcgacccaatccttctcgctgggaaccatgctgtattacgcgcagaacggttctgctctgaacacgggcgcatggtggtggttcctgccaccgggactgatgatcgctatcatcggcgccggattgtccttcattaatttctccatcgatgaagtcatcaatccgcgactacgtaagcctaccaagaaaagcaagggaaggaaagggtgaacacgatggcgactcagaattctgatatcctgctttcggtcgataacctcgacgttatctacgatacggataatccggtgcacgccgtgcagaacgctacattcgaattgcgtcgcggtgagatgcttggtttggctggtgaatccggttgcggcaagagtacattggcgtatagcatcaatcaaatgctgaaagctccgggtaagattaactctggctctgtgattttccatgataagtcagggaaagatattgatatccgtgctttgtcggggcgttcattgcgtgaataccgttgggagaaaacctccatggtgtttcagggcgccatgaattcattaagtcctgtaactaagattggtaagcaacttgccgatatttataaaactcatcgtcctcagatggcgaagagcgaacgacaagaccgttgcgcacatttgcttgagatggtgcatgttgatccgaatcgtctagctgcttacccgtttgaactttccggcggcatgcgtcagcgtgtgatgattgccatggctttggctcttgagccgcagctgattattatggatgaaccgaccacggcgttggacgttgttgtacagcgtgaaatcatcgaggaaatttcggaattgcgccgtgacaagggcttctctgttatttttattacgcatgatttgccgatgctcttggagatcacggacaaaattgctgtgatgaaagatggtgtcatcgtagaacaaggcgtttctgaagacgtgtatttcaatccgaagcatccgtatacacaacggttgctgagctcgttcccatctttgacaggagatcgtggctcattcgttcgtgttccacgccatgcgtgaaaggaataatcatgtcagtattgaagcttgaacatgtgaaaaaagattttaccctgcgtaatggtttgaaaaccacgacgattcatgcggtgaaggatgcatcattcgagttagcttcggataagaccattgctcttgttggtgagtctggttccggtaaatcgacaatcgcccgaatgattacatgtttggagacgccgacttctggaagcatcacgttggacggcaagcctgtccctacgcatggtaaggatttgtacgaataccgtcataatgtgcaaatggtatttcaggatccgttcgcttccttgaatccatatcatacgattttccaccatattcttcgtcctcttatgattaatcacatggcaaatagccaagaggaatatgagcagaaggttatcgaactgctggaacgcgttgaattaacgcctgccgtcaatttcatgtatcgacgccctcatgagctgtctggcggacagcgtcagcgcgtcgcaattgcacgtgcattggctcctaagccaaaggttctaattgcggatgagcctgtttcgatgttggatgtttctttgcggttaggcgtgcttaacctgctgtctagaattcagcaggaagaacacatcggcatgctgtacattacccatgatctggcgactgctcgccatttttcggatgagattatggtgatgtgtcatggagacattattgaacatggtccttctgatgatgtgattttgaatccgcagcaagactacacgaaagtgttgcttaatgccgcgcctgatccggagaagcatttcgcgaagattcgtgacgagcgtagccgtcagtaatgccgcatggaatacgtctgatcatcatctgattgcttgcaactccctcggcctatggccgagggttccatataaaggagtactttatgcaaatcgcaaaccccgttctcccgggattcaatgccgatccctcgatgattcgggtcggggatacctactacatcgccaattccacgttcgaatggttcccaggtgtccgtctgcacgagtccaaggacatggtccattggaacctgttgccgagtccactgagccgcacgagccagcttgacatgcgcggcaatccgtcatccggtggcatctgggctccggatctttcctatgcggatggcaaattctggctgatctacacggacgtgaaggtcgtgaatggtgcgttcaaggattgcacgaactatttggtcactgccgaaagtatccatggtccgtggagcgagccgattcgcgtgaacggtgtcggcttcgacgcaagcctgttccatgacgacgatggtcgcaagtatctggtgcagcagacttgggattttcgtgagtaccatcatggcttcgacggcatcacactgaccgaattcgatgtgaagacgatgaagctcaagccggaaactgaacgtacgatttggcgcggtacggacgtcaaactcaccgagggaccacatctgtacaagatcaatggctattactacctgttcgccgctgaaggcggtaccgtgtatacgcatcaggaagtcgtggcccgatccaagtctttggacgcgttgtccttcgaaggcatgccgtcgaatccgttcatcacgaatttcgacacgccgcgttcctatctgcaaaagcaggggcatggcgcgctggtcgataccccgtccggcgaatggtattacgcctcgctgtgcggtcgtccgtggcatcacgacaatgaatccttcactgatccgcgcggctggtgcacgctggggcgtgaaacctccatccagaaggtcgaatggaccgaggatggctggccgtatattgtcggaggccatggcggacagcgttatgtggatgctccgaaggatgccatcgagaccgaggcacctgcggatcacagccagcatgacgatttcatgtccgatacgttggatttgaattggaatacgctgcgtgtgccgttcgatggcgagatgggcaaggtcggtggcggcgtgttggaactgcgtggccagggctcgctgtgcaaccttttcgatctgtcgttggtggcacgtcgttggcaggcgttcaacttcgatgcgaccgtaaaggttgagttcgatccgaagaactaccgccagatggccggcctgacgaactactacgatgatttatgctggtcgtgggtgttcgtgacttgggacgagcggcggcaatgccgcgtgattgaggtcgctcagaacgatttcaacaactacacgtcgttcctgcgggataccgctccagcagtgccggatgacgtgaagtccgtgtggctgcgcacgaaggtgcgcaagcagtggtattcgtatgaatattcgtttgatgggacttcatgggtcgatttgggcgtgaaactggacgcgaagatcctgtcggacgactatatcctgcgtcgatacggcggattcttcaccggagcattcgtcggtttggctgcagtcgatctttctggatacgacagggttgcgaaattcagcgaattcgattatcgggaattgcccgataacgagtaggtgttttggtggcgacgggagctgtgttttcgtcgccactgacgtatgcaagccgtcatgaatcgtatacggaggctttatgtggacttgtcaaagatggaagaaggaagagcaacgatgcttgcgatgccgaagattttcgatgacggatgtgtgctgcaatccgggcaggacgtaccggcatggggctggtgcgaaccatggcggagcgttactgtcacggcttaggaacatgtgtgaataaggagattcagcaatgaagtttgaataccacgtcaaaccaaccggcagcgatgctgcgtgcggcgacgcggagcatccgttcgccacgatttccaaggccgcgcagatggcctctccgggtgatacggtaatcgtgcatgaaggcgtataccgcgaacaagtcgatccgagacgcggcggtctgagtgaacatgagcgcatcacctactgcggagccgaaggcgaagcacggccggttatcaaaggctcggaatgcgtgcagggctggacggaattggccgatcatccgcatgtgtggacggtgatgcttgataatacgatgttcggggatttcaatccattcgcgaccccgattttcggcgactggctggaaatgcccaagttcggcaaggatccggacaaacatcttggcgatgtgtatctcaacggtgtttccttcttcgaatcgacgacgttggaaggcgtatacgatccgcagccgcgtgatacggatgaggatttcgcgttgaagattccctgccccgtgccggatgtggaccgtacacgttatgtatggcatgccgaagtggacgagaatgccggcaccacaacgatctgggcgaatttccaaggtgccgatccgaatgaggaactggtggaggtcagtgttcgtcgcacatgcttcttcccttcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgttgcatgacgccaaattctccgcggtgtcattgggcaaggaaatctcatccggcgacaacgagtgggcgaaaaccgagcgcaagaccggttaccagtaccagttggaggccgtgttcaaggcccgtcgcatcggctgggaaaaggggctgatcggcggtcatatcgtacgcaacaacgacatctacgagtgcggacagaatgccatcgtcggacatatgggcagcgcattctgccgtatcgagcataaccatgtccatcacattgcgttgaagcgtgaattcttcggatgggaggtcgctggcatcaaattccatgccgcattggatacggtcattgccaacaacaacatccacgactgctcgctgggcatgtggatggattggcagacgcagggcacgcgcatcacgcgcaatgtgttccacgataacgtccgtgacctcatgattgaagtgagtcatgggccgtatctggtggacaataacgttttcgcctcgccggtgatgttccagaactggtcgcaaggtggtgctttcgtcaacaatctgatttgcggcggcattgaaccgcataccgtccccgaccgttccacgccgtatcactatccgcacaccaccgaggtggccgggtgcgctgtggtatccggcggcgatgagcgttggctgaacaacatgttcgcgccgcaaccggtgaaaccgaccgtcggtgaatatggtttgtccgcctacagcgattgtccgatgtcgatgcatgaatacttggaacgccagcggggcatgtgggcagattcttcgcagggtggtgacgagcgcaatcctctgcagtctctatacgcgggcggcaacatctatctgtccggcgcacaggggctgaacaagcaggaaggtacagccgatgattcggagcgcatgcaggaggacgccccgttcttcggcggcaccgcctccacgagcgttgcgtgtgatgagcccatgccggtgacattggtcgaagaacccgatggactgtacctgcagtgcactgtgccacaggccgtcgccgataccaggatgcaggtcgtcaccagcgatatgctcggcgtgcctcgcatcgtggaggaacgctatgaacagcccgatggcagtgactatgtgctggacaccgacttgctgggacaagccttgacgacaacggaacgcaaggccgggtcgttgaatggtcttgtctccggagagaatcacatccgaatctgggaatggaacaactgatatgacaaatgcaaccgataccaacaagacattgggcgagtccatgttcgcacagtgcggatatgcccaggacgccatcgataagcgcgtgtcacaggtctggcatgaaattttcgaaggtccgaacaaattctattgggagaacgacgaaggtcttgcctatgtgatggacaccggcaacaacgatgtacgtaccgagggtatgagctatgcgatgatgatcgccctgcaatacgaccgtaaggacgtattcgacaagctgtggggctgggtaatgcgtcacatgtacatgaaggacggtcatcatgcgcattatttcgcatggtcggtcgcgccggacggtacgccgaactcgaatggtcctgcacctgacggcgaggaatatttcgcgatggacctgttcctcgcctcccgtcgctggggtgatggcgaggatatctatgaatattccgcatggggacgcgagatcttgagatattgcgttcataagggtgaacgctacgacggcgagcccatgtggaatcccgacaacaagctcatcaagttcattccggaaaccgagtggagcgatccgtcctaccatctgccgcacttctatgaagtattcgccgaagaagctgacgaagaagaccgtccattttggcatgaggcagccgccgcaagccgtcgctatctgcaggcggcctgcgacgagcggaccggcatgaacgctgaatacgcggattatgacggaaagccgcatgtcgacgagtccaatcattggcatttctattccgacgcctaccgtaccgcggcgaatatcggactggatgcagcctggaacggtcctcaggaagtgctgtgcgaccgcgtcgccgcactgcagcgattcttcctgacccacgaccgtactagcgtctacgccatcgacggcaccgccgtggacgaggtcgtgcttcatccggtcggattcctggccgcgaccgcgcaaggcgcacttgcggcggtgcattcggcccagcccgacgcggaacataatgcccgtgaatgggtgcgcatgctgtggaatacgccgatgcgaaccggcacgcgtcgttactatgacaatttcctctatgctttcgccatgctggcgttgagcggaaagtatcggtatgaatgatgattacctcaactaatcctatggtctacacggattttcctgatccagacatcatccgggtcggggacgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgtttgccgccaacgatacgcataccagctatctgctgacggcggacgatccatgcggcccatggcgaaagcgtgagcttgacggcttctattacgacagcggactgttctttgacgacgatgatcgagcctatgtcgtacatgggcagtcgacattgcgcatcacggagttgaatcctgaattaagcgggccgatgccgggtgggctcgaccgggtcatcgtgcaggacgatccgcaggctgaccttggttatgagggcagtcacctgtacaagcatgatggacgctattacgtcttcacctgtcacttcccgcaaggcaagggcaaaacagaagcctgcttgatggccgaatccttggatggcgctttcgaagtgcgtgaaattatcgaagacgacctgtccttccacggttacggagtcgcgcaaggcggtatggtggacactccggacggcgactggtatgcattcatgatgcaggaccgcggcggtgtgggacgcgtgccgatactgatgccgatgcggttcggcgaggacggattccccgttgtcggcgagaacggcaaagtgccgcagtcggtcagcgtgccggctgcgagctgtgccgaacctgtcacacccatcaacggcagcgaattcatagcccggtataacgccgaaggcggagtcgatgccaactgtctgcagccatactggcagttcaatcacatttcacataacgaatactggtcactgacggaacgtccgggagcattccgcctgcattccggacgcatcagctcgaatctcaatcatgcatggaacacgctgacgcagcgcacgatggggcctgtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggtgaatgacgattccatcttctccgacgatgattgggacagtccagccgtaacggatgcggaaatcatggcggatgcggattgcatgcgcctgcgcgcggtatatgatttcaccgattgcaaggatgaagtgacgttcttctaccgcgatgcggatacgccggaatccgaatggtgtccattggggacagcgcaccggatggtcttcaaaatggatcatttcacaggttgccgtatcggattgttcctgtattcgacaaaagagaccggtggaatcgccgatttttacgactttgcgtattcgacgccggatacgaaggaaagagagcaatgaagcgacaggtcatagtgtcgcaaggaactgtcgaaggcttggcggctgaagatcagggcatcaccgtgttccgaggggtcccgttcgcccagcctcccgtcggcggtctgcgctggcgtgcgccgcagccagccctgccatgggatggtgtgctgcaagccttcgatttcgggcctaccgcgatgcagccgacgccgggcgcctccgatgatttctatgatcgtgaatggggcactgatccggccgtgccgatgagcgaggattgcctctacctgaatatttggactccggcattacgcggatatggcgcggatagcatggtagcctccgaaaagctgccagtcatggtctggatttacggcggagcctatcaatgcggcggcacatttgaaaaggaattcgacggcacacatctcgccgcgaacggcgtcgttgtggtcagtgtggcctatcgtctgaatgcatttgggtttatgacgcaccctttgctgcatgaggaggccgtagaacgcggcgacggcgagccatatgcgaatttcggattcctggatcagcgtgccggaatccaatgggtgaaggaaaacatcgcgaagtttggcggagatccggaaaacatcacggttttcggccaatcggccggtgccgccagcgtcttggcccagatctgctcgccgatgaatcatggcctgtttcagaaagccatcatgcaatccggcgcaggcttagggtatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgattgtcaattgggtgccatgcgtggacggcctgttccttcccgatcaggaggagcgtatcgtcgggggctgcaaggccaacaacgttgacatgctggtcggcaacacgaccaatgagttcatcgcttcgactgaagatgggaagcctgtgcatgtcggccagctcggcaatctcacgctgatccgtaaatggaccgcaagcggtgggaccgcgccatactactatcatttcgatgtcgctatgccgggggatgatgccggagccttccactcgtccgatctgtggttctcctttggaagccttgcgaaatgctggcgtccgttcgttggatggcattacgatctggcaaggcgaatggggctgtattggaccaatttcgccgccaatggcgatcccaacggaacggaccgtgacggaacgccgcttcctgtatgggatccttgcatcggtgaggaatgtcccgccatgcatttgtgccaagaaccgggcatgcggacggattggcttaccgaaacggatcgaaaagcatttggcctgtgacggcatgccgttgatgtataaatgctgatatgtaaacagggacggtctttgtggatcgtccctgtcgcataatggtttgccgttgcgcgtgcaggaggatttcgagactgattatccgacttttcaccgtttccgtcgtctggttcgtcggtggcatctcgcggaggctcgggccgttaaagaccctgttcggcgtcgtgcggatatcacgtagtcggtaggagccttgccgtttatctgctgtttgagcatgtcggtcatggcgtcgcccatgtgtatcgtcgcgttggatgccttgaaatcgttggtattccatcgttttggcatgaaaaaagggcttccggatttctccgaaaaccctcaaggcggagtcagagggattcgaaccctcgagccgctaaaaacgactaacaccttagcagggtgcccctatcggccactcaggcatgactccactgttttaccgttttcacggcgcaacagcatgtaactataccatccatttgcgggcaaaacaccatatctcgaaaaaaagatgaaagaacgttgaaatatcgggaaaaatccgtgctgtatgcatgtgcgtgccttatgaaatcgcaactgtcgacacgccgttttcataagataaactgcgatattcgaacatttgtttcaaaggaacgtgaaaaacagctatcatggaatcatgagtaccgcaccgagaatcgcagcagccaaacgtgactggggccatgacgaggctgggtgcacggtgctgcatatcgacatggatgctttctatgcgtctttggaagtggcccggcacccggaataccgcggcaggccggtgatcatcggcgtgggcaatcgttcggtggtgtccgcggccagctacgaggcacggcaatacggcatcaactcggccatggcaagttccagggcgcaaaagctatgcccgaacggcattttccttccggtcgacatgagttactatcgcgcgatgtcgcatcgcattttcaaggaagtgctcagtcggattaccggccgcatcgaacaggtatcggttgacgaatgctatatggacgtttccggagcgttgctgcggtggggcagtcccagtgccattggagcgtggatacgagaacaggtggccttgcgctacaacatcacctgttccgtcggcatcgcggcgaacaagctggtcgccaaaatggcatccaccaatgccaagcccaacggcatgttgatgattcccgtggcgcggcatgcgcaattcgtgcagatgatgccattgcgtggcattcccggcatcggaccttctctggaaaagcgtctgaacgcgtggggcatcgactcggtcgccgaccttgcacgcatgagtctcgaatctctggagcgggccaccggatctgctatctccgcacacggcctgtatcaggcggcccgaggcctggacgataggcccgtcgtaccgtacacgcaggaaaaatcgattggtgcggaacgcaccttcgaagcagacacacaagacatgcgacaggtgtgttctatgcttcgctggtgttgcgatgacgtggctacgtcgttgcgtaagcgtggtttcctcgcacgcaaggtcatggtcaaactccgatttccggacttgagttatgcgacgaaagggcgcacgctggactgtcctacggacgcggcgagcgtgctttacccgcaatgcgtagacctgctgctcgccatgatgggcatggttccggagtccgtgcatgccatttcccttgctcgacccgtgcgtttggcgggaatgagcaccagtggacttgtgcttgccgaagagactgcgatccagccctcactggatgatctgctggaagaaaacgaagccgaacggcatgcggcggttcaggcaaaacctgcgcaaatgcagacccacgcaaaacgtttgcgtggtgcggaagcggcactggatgcggtgcgtcaaaaatacggcaacgacatcgccagtttcggagtgtagaaaccgtggtgcgtccgttattcttgaattgaagagttgagaaggtttcagaggaaggcggggtgccatgaaatacagaaaagaggcagtgcacgcaaccaacacggaagtgcttgcagccggccgacgcaggctcgcgttcgcggcgttggccgtgcttgccgtcgtgcttgttgcgggaatatggctgctggtgcatagccttcaatcaaagcagcgtgatgccgatacgaagccggcaacaacggtgaacgagccaaaaacggttgaaaagaaacaagtgaccgaacctgcggagcatcatggcaattccccggattgccccgataccgattgcatcgccatgcttgtcaacggtgatctgctgttccatgagggattgtggaaccagtatgccagcgccaacaccgcggccaccgacggcaccgcattcgatttcaccggtctgttcgagccgatgcgcaaatatatcgaagcttccgacatcgccgtatgtgaattcgaaacacctatcgcacaacgtggcggtccatattccgcctatccgattttcaatattcctccagaagtggccgatgccgcgaaaaatgtgggatatcatgcctgcactcatgcttcgaatcattcttgggatcaaggtgccgacggcatcgcacgtttgtgggacacgcttgaacaggacggcatagcgcaaaccggttcctataaaaccgaaaaggattcgtatgagccgttggtcatcgattcgccgacgggcggcggcaaaatcggactcgttgcgggaaccgtatcgttgaatgcgcaaacgcctgactacgactggcgtgtggatcgccttcgcgaatccggagatccgaaccatcaggccgatatagacaaggccgtggccaaggcgaaggccgctcgagaacaaggtgccgacgtggtggccatggccatgcattccgtgcaggaatacttggactacgccgattcctggcagcaggatgaagcgcacgagctagctgatacgggcgcatttgatgtgatctatggtgcaggttgccattgcgcgcagccgatcgagaactataacggcacttggatcatctacggtttgggtaatgccgtaaccgaatcggccaatactgcagacaccatcgtaaacaaccaaggtgtgaccgcgcgcattcaattcgcaggcaaaaaaggcgtggcagactcgtggcgcgtcaaccgtatcgactgggtgcccagcgccaatgtgacgcaaggcaaataccaatggtgttcgctggcaagcgaccatccggacggcccctgctgggatgaaacgcaagacgcgaatgtgcgccaacgcatctgggacgtgctctattccatgggcgccgatcagaacgtggtcaaggaatggaatattaccgcggagcaaacgagttcatctggccagtagttttccgtggcacaatatgcctcatgccgtgagtcgcatatgcgtaagaactctcgaacatacaatgtgaggtgaaaacatggaaatctacgaaacccaaccggaacgcaccgatctgccactggtggtcatgcccgtcatcatcgaatcgatgatcgaaccgttcgaaaagaacttcgaactgctcaaagacattgcccgcgtgcgcatgtacaaggatttcacgcttgacgaagacaccatcgtcgaacgttgcgccgaagctgacgtcatcatggtgatcggattccactgcgccgattccatcctcgatcggttgaacgccaaatgctatgcattcggcggcaccggcgtggccagttacatcgatctcgacaaagccaaggaacgtggaatccgcgtatgcaatgtggtgcactatggcgaccatgccgtggccgaacacaccatcgcactgcttatggaactcgccagacaggtcggcaaactcgacaggcaagtcaaaacaggcgattgggacggtgccgacggctacgagctgtacggcaagaagcttggcatcatcggccttggcggcatcggtcagaccgtggcacgcatcgccggagctttgggcatgaacgtgtccgcatggaactcccatgtgccggagcaggtgttcgccgatctgaatatcactccagtcaacgatatgaacgagctgattgccggttccgacgtggtatccatccatatgccgctgctggactccacaaaaggcatcgtcactgcggaaaacctcgaagctctgaaaccgggaaccatgttcatcaacacggcccgtgcggaaatcatcgaaccgggcgcattgctcgccagactccagcgaggcgacattcctgcggcgctcgatgtgttcgaacacgagccgctcactgccgacgatccgctctgttcgattccaggcatcatcctcaccccgcacaccgcgtggcgcaccgatggcgcctatgtgggcatcaccagacaggtggtccaatccgttgcggcattctgcaagggcgaggatttcaacgtcgtcgtgtgaataaccgcaaaaccggtatgggcaaaacatgtggacggtcggcgtgattgggtaggttgaaagacatgcagaccatactcgattccgccgatcagcccgcgcatgatgcgttcgccgagaaaaaatcggaattcatcggcgacgcctgtcatatcgactccttggatgaggcgctcgcgtttgtgcagacgattcgcgaccagcatccgaaagcgcgtcatgtcgcctatgctgcggtgtgcggcggttccgacggtcgtttggccgaacgcatgagcgatgacggcgagccatcgggcacggcgggcaaaccgattcttgacgtgttgcgcgccaacgagatgacggattgcgtggttgccgtcacccgatatttcggaggtattctactgggttccggaggcctgatccgcgcatattccacgggtgcgtccattacggtcaaagcggcgaacaaagcgaagatcgtgccatgttgcgaatatcaggtgacgcttgactatccgcaattgggaagctttcagaatctgcttgcgtcagtggacggcgagcaggcggatgcgcaatataccgatcgcatcgtgctgtcaattatcgttccgcaggaacaatcgcagaaattcaaatcacgaattatcgaaacgttcaatgcgaccgtcacgccgcggcaaacgggcacgtccaatcgcccggtgcgatactgaaatccaacgatgacgaatggaatattgagcagaacataacgtaaggtggaacgcatgaccgaagatatgagctcgcaagacactactgccgtggaaaccgccgaaaataccgtcgaaaccgttgtggggaacgccgacgaacaagcatcaaaccaagaggttccttcggatttcgagcctttgaccgcaacctacgagcggttgcgtcactccacggatgccgccgaattgagcgaattcgcgcgccgtccgctgcctgaccgttccgaacaggccgctttctcgcgtgccacggcattgctggaagccgtcgccggcaatgcgcatacaccgttggaagatcgcgtttttcttgcggaaaccatgccgtttccgaatattctcgtcaaactgtccaccgacgaatccgttgaggtgcgtaaagctgttgcgggcaatgccaatgataagaattggctggtggggcgtctcaccaaggatgagtccctcgaagtgcgcgatgtcgcgttgcgcaacaagcagacgtcttggaagatgcggctcgaaggcgcgcaggatccgggtatggattccacggcccttgattttctgggatctttgggggtcgacgtcgagccgaatgctcctgccgtgcttgcttccatggtacgtagggccgttgctttgaacccgaacacgtctgatcagatgttggaaaaacttgcgcaggatgcgtcaggagaggtgaaaagggccgctgaacggcatctttcggaaaaataattgcatacgttgtcatttttatgagatttttgcgcgtggtgcatgtgattggggcatagactgttgtttatgacagaacagaccgaaaatgcaacgcgtctagcccgtccgatcattcgcctggcaaagttggtgggtatcgccaccagttacgtcggcatgagccgcgactaccacgaaatcgaagacgatgttctcgtggcggtgctcaaggcgctcggaatcgacgcttccaacgatggggcgatcgagcagtccatcaccaccattcagcgcgaacgcgacacacgtatcgttcctccgaccgtgctgcacgttgtcggcaaggaaagcaaggttgaggttcacggcggagcgcttgacgttcctgaagcttccatcatgctggaagacggtggggcgtatgccggcaaaatcgagctcgagggtggcagcgataccgtggtcgaggtcgacggcggcttcgtgtgcacctcatatctggtgcttccggcagatcttcccgaggggtatcacacccttgaagtcaccgttggtggcaagacggagattgcaaccgttatcagcgctccggaaaagatcgagctgcttgacgacatgaaggaaggctccctgtggggctggatgagccagctctactccattcgttccagcggttcctggggcatcggcgactatgaggatctgaagaccctgctcgtcgagtccaagaagaagaccggcgccgacttcatgctgatcaatccgctgcatgccgccgaaccggtgccgccgatcgagccatcgccgtatctgccgatttcgcgccgtttcattaatttcagctatattcgaccggaatccatgccggaatatgccgtgctttcgccggaagacaaggcgaaagtggatgaactgcatgagcaggtcaagccgctcaacggcaatgcgcggatcttggatcgcgaaaccatgtggcgtaccaagatgcaggcgttgtggatcatctacaagtccggcctttccgcacagcgtcaagccgagttcgaccagtatctcgccgaagtgggcgatgagatcgaatcctatgccacatggtgcctgtgctacgacaagtggggcgcctcgaatggcagcgacgacgattgggtgcgcaagtacaatcgtgattccgaggaagtcgcgcagcttcgcgcacagtacccggacacgcttgaattctatcgttggctcgaatgggtcgccaccgagcagctgcatgcggcccagcaggcggcgcgcgaggccggcatgaagatcggcatcgtcgccgacatggctgtgggcgtgcatccggccggttccgacgtgtggtggaacccggagcgttttgccaagggcgccacggtcggcgctccgccggacatgttcaaccagcagggtcaggattggagtcagccgccgctgaatccaatcgctctcgaacagaccggctacaaggtgtaccgagatatggtgcacggcatgttctccaatgcgggcgcggtacgtattgaccatattctcggcttgttccgcttgtggtggattccggaaggcaagaaagccatggacggcacctacgtgcattacgattctgacatcatgctcggcattctcgcattggaagcatcccgcgccggtggtgtggtcgtgggcgaggatctcggcgtggttccggcatacgtgtccaagtcgctgtccgagcacggcattctcggttgcgctgtggaatggttcgagcagttcgacggcgaattccgtgcgccgaaggattggcgtccgtatgcgttggcatccgtcaacacgcacgatttgcctccggcagccggctacttggagtacgggcatgtcaaattgcgtgaacagcttggactgctgtccggtccggtcgaagaattccagaagtccacggaagccgaacataacgccatgctgagcatgcttgttgacgaaggctatctcgacgcttccgcgctggaagacgagcttgccaacgaaaacgagatcatcgacgcgctgtaccgcggtttgaagggatcgccatgcaagctcatggcggcgtccatcgtcgacgcggtcggcgaaaagcgcacgcagaaccagccgggcaccagcaacgaatatccgaactggcgtattccgctggctgacggcgatggcaatgtcgtgccgctggagcagttgttcgacaatactcgactgcaggagatcgcagcgattatgcgcggctgagcttgcagcggattgaggctgattgcagctgatttcgattggcggaaggccggcgatgcaaggtagggagacctgccaagcgtcgccggcttttgcgtgtcgattgctgtgtttccgtattcgcaagtactaggggttgatgtgtcgcgaatgtcaaggctggcgatatactagtagattgttgtgtttccctacggggtccttcaaagcgcttttcccactcgccatcgaggactttcagggagcccacggataatgagacctgaaaaaggcatcattccgcgcctaaccaacgcagagatgttgatggaaggtccggaacacaatatatagaaaaggtacatcgtgaaaactttcactccgaagccagctgatctgactcacgactggtacgtcatcgacgccaccgacgtggtgctcggccgtctcgcttcccaggcagccatcctgctgcgtggcaagaacaagccgacctacgctccgcacgccgattccggcaaccacgtgatcattctcaacgccgataagatcgctctgaccggcaataagttgggcaaggaactgtacatgcactccggtcgtccgggtggcctgcgtcgcgatagctacggcaagctgctcaagaccaaccctgagcgcatcatcaagtccgctatcaagggcatgctgccgaagaatcgtctggccaaggtccagctggatcgcctccacatcatctgtggcaccgagcatccgtacgctggccagaagccgcaggttttcgagatcgctcaggtctcgcagcaggctaagtgaaccgaagggagataagaaacatggctgaaaacaccaacaactccgcggttctcgagaccgaagaggagctcacctcgtacaccaccgagaccaacgctggcgctggcaccggtacttccgctatcgctccgggctatggcaccggtcgtcgtaaggaagccgtcgctcgtgtccgcctggttccgggcaccggcaagtggaccatcaatggtcgcaccctggaagagtacttcccggccaagctgctgcagcgtgaggtcaactccccgatcgtgcttctcaagctcgaaggcaagttcgacgctatcgtcctcgttgacggtggcggcaccaccggccaggctggcgcaatccgcctgggcgttgcccgcgctctgaacgctatcgatcgtgatgcgaaccgcgcagccctgaagaaggctggcttcctgacccgcgacgctcgcgtcgtggaacgcaagaaggccggtctgcacaaggctcgtcgcgctccgcagttctcgaagcgctaaagctttacggcttatacgaaacccctcggaaattcgacttccgaggggtttcttggtattccagacggtattttgactggcgtttagatggttggcatctgcttcatcgcgctgatgctcaatgccggaagcgtccacaatgtcggatcatcttccgacagcccatcatcggcggattgcagattgtccgcatcgtctttcatttgccagtacatcatgttgatgcggtgcagatggttgcggagcctgcccgcgggcttgctttccgattcttcgtcgaattccgacacccgttcgatggacgttcccaatcccggatattcgccgacaatctccgatgaggaccagaccatctcccattcgatgtctttcggcagatgaaaacgcgtgacctcatcggaaccgttgatcagaatcagcagacttggctcgtcgggggatagcagctgcatggcgaacgaacggacggaaggattcgtccaatccgcatcatttggcatctgtccattcggcaaataccaatgcacgcgatcggatttcttcagcaaaccgatttcgctcaggcgagtgaagaaatcctcatgattgtacaaatcgcgggatttacgcaatgtgattaaacgggaagtgagattgaactgcttcaattccggcgtttgttcggtactgtacagccaatcccaatcaagccaggtggtgtcgttatcctgcgtgtaggcgttgttgttgccgttctgcgaattgccgaattcgtcgccggcaagcagcattggcgtgcctagcgaaagcagcagcgtacccagcaggttcatggtggcgcgttgccgttgctgcacgatgatttgatcgccgctggggccctcgtgaccgaagttgacggaatgattgtcgtttgttccgtcgcggttgttttcgccgttggtctcgttatgcttggttttgtacatggtcagatcggctgtggtgaagccgtcatggcatgccacgtaattcacggacgcggtcgaaccgcggcctggatcggtggcgaacaggtcggatgatccgcacaaacgtgtggccatctcctgcatggtcatttcgccgtattctccaccgcgcatgcgatccacgtcggtcagccagaatttgcgtgtgcaatcgcggaacctgtcgttccattcggcgaaggggatgccgaattcgccggtgcgccagccatttggaccgcaatcccaaggttccatgatcattttgagattgccgagcagcatgtcggaacgcaatgcatacaggaacggatggtagcgggtgaattcaccgtcgagacgtgccagcgtcgccgcgagatcgaatcggaatccgtcgatgccaatgcgtttggcccaatagcgcaacgaatccacggcgaatgtggtgacgtgcgtgttggtgaaatcaagcgtgttgccgcagccggtggtgtcgtacaggcggctgatcttatctttggtgcgtcgataatatgccagattgtcgagtccgcgccagcatacggtcggtccttccggaccggattcgcaggtgtggttgtagaccacgtccataatcacttcgaatccggcctcatgcaaggctcgtaccatgtcgatgacttcctggcgtactgcggccgcaccggcctcctgggagcgcttggtggcgtatgaggcttccggcgcgaaatagccgagcgtcgaatatccccaatagttgacgcgtccgcgttcctgcagaaacagttcggattgcttggcttgaatcggcagcagctcaatggaagtgacgcccaaatcctgcaggtaggagagcgtcgccggatgtgccaaacctgcataggtgccgcgaagctctttgggaagccaaggcgcgttggctgtgaagcctttgacatgcagctcgtagatcacggttttgctccatgctacatgcgggtgtgatggctcaccgtcatgcttgttggtggcacgatcgtctatcgccacggaaacgggaacatgccccacggagtcgatggtgctcatcgggccgaatggcgaacctttgactttgccgttcacgatctcgcattcataggagaacgctccgggatcaagctccattgatccttcgatgcctttggcataggggtcgagcaacagtttgtacgggttgaagctcacgccgtggtcggggtcccatgggccgttgacgcggtatccgtattgcatgccgtcccatgcttgcggcacgtgcacgtaccacagtccgtaattgggcccgtccatgcggaatagtgtttcgcgaagattgagcgaggggattcgccgagtgcagatgcgctgtttcatcgcctgatcgatgaaggtcagccccggctcgttgaacaatcgtactgcgtcggcatagaaggcactgggttggtcgagcggctcaagtacgcaaaaccacacttggtccgctgtttccgagcggacgatggcatccgccccaccatcatcggtgaagtagagacctggacgagttgcataacggtgcaaagacgggttcttcataacctcattctaaacactttgaaattatctgttgacttactatgtcgaggctgtcgacgctcgtgccggtctgatccggccgtgagcttgaactcgagcaggtgcaggacttcctcgacggcaaaatcgccgccgcttccaaggctgtcgtcaaaatcggtgctgacgctgtttattcgtcctgaacagcctggaattagcaaaaaagtgtcacgatatgacggcaaatgcgccgctgacatcgccgcatagcgcatatcctaatcacaaaagggaaaaacgtatcgtaccaaccatcacaaggagggtattatgaccaaaccaatgtctgaattcaccaccgatctgcagcattccggcatgccggcgaaagatctggacgaaaccatcgaattctataccaagaaactcggtttcgagttggcgggactgttccataacggtgaaaaccgttgcgcattcctgcgttacggccatctgaccatcgaaacctgggaaggcgacccagcgccgctgaccaccggtgccatcaaccactgggcgttcgatactcccgacattgaagccgcgttcgaaaacgcgaaggaactcggactgaatttcaaagacactgaaattcagcatatcgacagcttctgggagcacggcattcgctacttcaatgtatacggaccgaacggcgaaaccatcgaattctgccagattgtcaaataactatcattagatgattaccgtcaaataatcgctgaaaaaatacaacaagtgaagcagacggaagcgaacaaagaagcgtgcgttgaaccttatatacgggttcggcaacacgcttcttttgttatgcaagcgatgcgattaatgcgattaatatatgtgtaaaagcggtcacatatcgcatagttcgcgtacgtacggttccacaaaacgcagggccgcgccgataatgtcttgatggtcgagcgccattcccttgcgcagggtgaaatccgtggtgccgaatggcgtatgttccaccacgcgttcgcgtagtccggccatatcgtcatcatcgagatattgtgctgcctcaccgctgatgatcacgtcaccggccagcaccgagcgaatgttcgttaccgccagcgccacataatccagccattgcgagaatcgtttgcggtgctcctgctcgccttgttccaataccgagaagaagccgggcaggctttcgccgtcctccatcagcgtttccggcgagcaatacgtgtccatgcatcccaattgcccgcaatagcaagggtttccgcccggaatcagcgtcatatgttcgattgagccattgcattggttcggcccttggtagagcgatccgtccacgatgaccgcgcctcctgggcgtcgttcgaggtagatgcagacggcatccttcagattgtggtcgaaccagagttccgccatggcagaagcgtcggaatcgtgaatcatcagcgacggatagttgagaccatggctgagttcgctgagtttcaggccggtgttgcccatgattttgccgaaagtgatcgactggccgtccgccgacacgatgccttgcatgcagaaggccacgccgagtaccgtgctgccttgtttcgccagttcttgcgcgaaatcgttgatgatgccattcatgcgctggtagtaggcgtcgttgttgcgataggggagtgtgcgctgtctggtggctacggatttgccgttcagatcaatggcgatggccgtgatttgtgtggtttggatgcgcacgccgatcgccacgctggagtgtgccgcgaattcgtagatttgcgctttgcgtccaccggtggattgctgcatctcgcctttgacgatgagcccgtcggcctccatggcgcgcagattctgcgtgatggttggcaggctgagccctaattcgtgttcgaacatctgcttggtggctgaaccttgggtatagatgaacgcggtcatggccttgagattggcttctttgactgatagggcggattgggctttcactggttgatccttcctgcacaacttctttttcaagactacttcataaaagtcctttccttatgtctcgtgttggtctgagatatcaggtattgcaaaaaagtatcaaaaatagctgtgcataaaggattttctgccacttttctgcgtcgaaaatatgtttatcaacaaaaaagttgagacggtgacaacgacgttctaccaagaaaagagacatgttatgaagataggtctgccgcgcacgctattggccggcttggtcgccatagcggtgttcatgactggcgatggctttgaattgacttttttgtccaaatacatcgtggaccagggattcagttcttcacaatcgtcgctgatgttcaccatgtacgggctgatggctgcgcttgctggctgggcgtccggtgtgctagctgaaatgttcggtgccaaacgcatcatgctgatcggcgcgagcgcctgggtcgttttgcacctgctgttcgttggtgtggcgctgccgagcggcgtctatccgctgatgttaggcgtgtatgcgttgcggggtgttggctacccgctgttcatctactcgttcgtggtgttgatggcgcaaaccatcgatactgccaagctcgcgtcggccatggggtggttttgggccgcctactcgttcggcattggcgtgttcggcgcatatttgccgagtttcaccattccgctggtgggcgagtactactcgctgtggctttcgttgcctttttctatagctggactgctgatttgcctgctgatggtgccgaaaagcaagggtgctgacacctcttccatgagcaatgccgacaagctgcgcgagcttagtcgaggagtcaccattctggtgcataatcgccaaatcgctttggctgcggtggtgcgtgtgatctgcaatctgacgttgtacggctttcccgtcatcatgccactctacttggccactaccaacaatggtggcggcgcttggtttaaggtttcgcaatggagtcagatttggggattccagtttgtggtcaccattttcggcaatgtgttctggggtcgtatgggcgattcgcatggttggatgcggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgtcggaacataagggtgctgcgatttccgcgcataatctcgcttccggcctgactacgtttttcggtccgctgattgcgacggtgctgatttccactatcggattcggcggcgtgtgctggacgtatgcgatctgctatgcgatcggatcgttggtcacgctcggcattcatcctcatcaacccggatttgacgatcgtggccatcgcattaccgcggtcgaacgtaactaatcgcaattgaatatcaattgctcaatcatcatttttctcaaaaaaatatcattatccacaaaggagaataatcatgaaggcagtcgttctcgaagagcagggcgtcatcaatgtgcgtgaggtgccggacgcccccgcacctggtctaggcgagctgaagatcgcgccacataccgttggtgtgtgcggttccgacctgcattattacactcatggtcgcgtgggtaaatatgtggtggagcagccgatgattctcggtcatgaggcttccggcacggtggttgaggtcggtcctggcgtcgaaggcttcaaggtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcaggcacggtcggcatgctgaccgcgtcgtgcgcgttggcgggtggcgcttccaaggtgctgatctccgatgtgtcggcaatcaaactggcgattgcggctcagattccaggtattattccggtggatctcaccaaagaggatctggtggagcgcgtccgtgaggaaacggggggctggggtgctgatgtggctttcgagtgctcgggctcgccgaagtcatacgagacattctggaagctgattgctcccggtggcgctgccgttatcgttggcattccggtcaatccggtggccatcgacattacggaactgcaggctaccgaggtgcgcatcgaaaatatcttccgttatgccaatgtgtatcagaaggccattgacctcgtggctaacggtaaactgaatctgaagccattcatcaccgacacctatgcgatggaggatgcccaggcggcgttcgatcgcatggctgaggggcgtcctggagacattaagctgcagattaccgtgaaaaacgactgacgttacgcacgttacggaacgacgaaaggggtctgtgtcatgggtgctgttgcacaagtcaacgataatcggcatgggaaggcggctttggctcagacctcttttggtggattcgtgccgaaaggtggaagtccgaacgattccggcgtattggagatcattgtgccggacgcgcaggcttcggtgcgttgggcgaagcatggctacccaagctcgttggcgaaatggcatcatcatcctcatattgaaattcatctgattcgggaaggtaccggattgatgatggcgggcaatgccgttgttccgtatgaggccgggcaggttgcgctgattggttcaaatcttccgcataattgggtgtccgacatcgctccgggggagcggcttcgtcagcgtgatgtggtgtgccatgtgcgtccggaaaccatgcgtctgctgatgtctggatttccggaaacgtctggttttgcaatggtgttgaaacgtgcggggcaggcattggtgctgagcggtgaatccgctcgtcaggccggttcgattctggaaaacatggaggaacatagtcttgcttgccgtgtcagtgatctgattcgtgtgttggatgtgttcgcgcatgcccccgcagatgaatcctatacggtggttgcgtccggatacgatccggctgtatgcagtggtgcggaacgtgtggtcaatgatgccatcgagtacatttcatcgcatctgagcggtgaaattagcatggatttggccgcccgccaggccggaatgagcgtttcggctttctctcgtctgttcaaaagggctgcaggaatagggttttcggattttgttcgacgattgcgtatcgggcatgcatgcagattgctgacgaccacgaatcaaagcgtcgcttcgattcgtcgcgcttgcggatatggtaacgcttcgaatttcaatcgtcgcttctttgaagaaacaggcgaaactcctactggctggcggaaaaaatacattgaacgaacaagataaataaatcgactttgtaaaagctcgatatgattgatatcatatagaagatacttttataaaagatatggaggtgagacttgagaaagtgtgtgtgatttatgataaaaagcaacaaaaacgctcaaaatgatgtttttgaggctttttgattccataaaagaacgcaatctaaacattaaatgaacagaagataacatttctcttgcgacacgacacagtggaacatcatattgcatactcactaaagtgtgtcctaggtcacaaaagaccagcaacgcgtccatccgcttcgaggcggatggaataacgggaaactactttgcaaacccccaaagaatcgaggaggacttcaagtggcagacgcaaagaaggaagagccgaccaagccgactccggaagagaagctcgccgcagctgaggctgaggtcgacgctctggtcaagaagggcctgaaggctcttgacgatttcgaaaagctcgatcagaagcaggttgaccgtatcgtcgccaaggcttccgtcgcagcactgaacaagcatctggtgctcgccaagatggccgttgaggaaaccggccgtggtttggtggaagacaaggccaccaagaacatcttcgcctgcgagcacgtcaccaactatctggccggtcagaagaccgtcggcatcattcgtgaagacgatgtcatgggcatcgacgagatcgccgaaccggtcggtgtcgtcgccggcgtgaccccggtcaccaacccaacctccaccgccatcttcaagtcgctgatcgcgctgaagacccgctgcccgatcatcttcggcttccacccgggcgcacagaagtgctccgtcgaagccgccaagatcgtgcgcgacgcagccatcgcggcaggcgctcctgagaactgtatccagtggatcgagcacccgtccatcgaagccaccggcgccctgatgaagcatgatggtatcgccaccatcctcgccaccggtggcccgggcatggtcaaggcggcatattcctccggcaagccggccctcggcgtcggcgctggcaacgctccggcatatgtcgacaagaacgtcgacatcgtgcgcgccgccaacgatctggtgctctccaagcacttcgattacggcatgatctgcgccaccgagcaggccatcatcgccgacaaggaagtctacgctccgctgatcaaggaactcaagcgccgcaaggcctacttcgtgaacgacgaagagaaggccaagctcgagcagtacatgttcggctgcaccgcatattccggccagaccccgaagctcaactctgtggtgccgggcaagtccccgcagtacatcgccaaggccgcaggttttgagattccggaagacgccaccattcttgccgccgagtgcaaggaagtcggcgagaacgagccgttgaccatggagaagctcgctccggtccaggccgtactgaagtccgacaacaaggaacaggccttcgaaatgtgcgaagccatgctcaagcatggtgcaggccacaccgcagccatccacaccaacgatcaggctctggtccgcgaatacggccagcgcatgcacgcatgccgcatcatctggaactctccgagctccctcggcggcgtgggcgacatctacaacgccatcgcaccgtcgctgaccctcggctgcggctcctacggcggcaactccgtgtctggcaacgttcaggcagttaaccttctcaacatcaagcgcatcgctcggaggaacaacaacatgcagtggttcaagattccggccaagacttacttcgagccgaacgccatcaagtacctgcgcgacatgtacggcatcgagagggccgtcatcgtgtgcgataaggtcatggagcagctcggtgtggtcgacaagatcatcgaccagctccgcgcacgttccaaccgtgtgaccttccgcatcatcgactacgtcgagccggaaccgagcgtcgaaaccgtcgagcgcggtgccaccatgatgcgtgaggagttcgagccggacaccatcatcgccgtcggcggtggttccccgatggacgcctccaagatcatgtggctgctgtacgagcacccggaaatctccttctccgacgtgcgtgagaagttcttcgatatccgtaagcgcgccttcaagatcccgccgctgggcaagaaggccaagctcgtgtgcatcccgacctcttccggcaccggttccgaagtcacgccgttcgctgtgatcaccgatcacaagaccggctacaagtacccgatcaccgattacgcgctgaccccgtccgtcgccatcgtcgatccggtgctggcgcgtacccagccgcgcaagctcgcatccgatgctggcttcgacgccctgacccactccttcgaggcttacgtctccgtctatgccaacgatttcaccgatggcatggcgttgcacgcggccaagttgatttgggacaacctcgccgagtccgtcaacggcgagccgggtgaagacaagatcaaggcccaggagaagatgcacaacgccgccaccatggccggcatggcattcggctccgcattcctcggcatgtgccacggcatggcccacaccatcggtgccctgtgccacgttgcccatggtcgtaccaactccatcctgctgccgtacgtcatccgctacaacggctccattccggaggaaccgaccagctggccgaagtacaacaagtacatcgctccggaacgttaccaggagatcgccaagaaccttggcgtgaacccgggcaagactccggaagagggcgttgagaacctggccaaggccgtcgaggactaccgcgacaacaagctcggcatgaacaagagcttccaggagtgcggtgtggacgaggactacttctggtccatcctcgatcagatcggcatgcgtgcctatgaggatcagtgcgctccggcaaatccgcgtatcccgcagatcgaggatatgaaggacatcgccatcgccgcatactacggcgtcagccaggccgaggggcacaagctgcgcgtccagcgtcagggcgaggccgccacggaagaagcttccgagcgtgcatgagtcgcttcatgtataggccatcagcagtgacctacatataaggtgcttgcgttatatcggcaagcatcatagataacgaggaatttggttggattcgttcaaccggattcctcgttttttatatgtggaaaagcattttcggatgatgctgcagtatgatcgcaacagacgatcggcaatgtgcatctcattcgttttcagggacttgaaaacaggacttgagaccgcgacacgcgaggatttcttaagactacccctgatgcttaaataaagaagttgcctgattttagggctcgcaaattggaattaaaaaagcgagcgtggcacagtgatcacgagagtgaaaactgcatggctgcgcactgatgtggtatgaccacggaacttccacggtttcgggggtcttctgcgccggtgccctttgagaagcaggctggtaaacagtaactaacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgtactcataagcgtctcatcgacattgtggacccgaccccgaaggccgtggattcccttatgcacattgatctgcccgcagatgtgaacatcgagatcaagctgtaagggaggagggaaccattatgtctaatcgcaccgcactgctgggcaagaagctcggcatgtctcaggtctgggacgagaacggtttcttcgttcctgtgaccctcgttgacgtctccaccaacgtggtgactgctgtcaagtccgaagagtccgacggctacaaggctgttcagcttggctacggccaggttgacccgaccaaggtgactaagccgcttgccggccacttcgccaaggctggcgtcaccccgcgtcgtcacctcgctgaggtccgcaccgataacgccgaagagttcgagccgggtcaggagctgaccgctgagctgttcccggagggcaccctggtcgatgtgaccggtaccaccaagggcaagggcttcgcaggcaccatcaagcgctggggcttcaagtcctatcgtcgtacccacggctctcacaagaacgagcgtcgtcctggctctgttggcgcatgcgctaccccgagccgtatcctcaagggcaagcgtatggctggccgcatgggtcatgtaaccaacaccacgctgaacctcaccatcgtttcgtcggatgttgagaacggcgtgctcgccatcaagggcgccatcccgggcccgaagggcagcatcgttctcgtccgttcggcagtgaagggagcctgataaatcatggcaaacgttactctgaacgttaccgataaccagggcaatgcagccggaaccgttgaggctccggctgagatcttcggcttctccgccgaagaagtccagtcccgtatcccgctgatccaccaggttgtggtggcccagcgcgccgctgctcgtcagggcactcatgccaccaagactcgcggtatggtttccggcggtggccgcaagccgtggaagcagaagggcaccggtcgtgctcgtcagggctccattcgtgcaccgcagtggtaccacggtggcaccgtgttcggtccgcagccgcgtgactactcccagcgcaccccgaagaagatgaaggccgctgctctcaagtacgtgctttccgatcgcgccaacgcaggtcgcgtggcagtcgtggacttcggcgtttccgaagccccgtccaccaaggccgctgttgccgctcttaccccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggcttcgacgctttccttgctgcgaaggctgagccggctgcaaaggaggcctgattttcatggtcgctattcacaagcccgcacacgacatcatcctcaagcctgtcgtttctgagaagagctacgctctgtccgatcgcggtcagtacaccttcgtggtggccccgaacgcgaacaaggtccagatcaagcaggcaatcgaagagatcttcaatgtcaaggtgacgaacgtcaacaccctcaaccgcgccggcaagcgtcagcgcacccgcaacggtttcggccagcgcgtcaatcagaagcgcgctatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgttccacgcctgagaagtcgctggttcgcaaactcagcaagactggcggtcgtaactcctacggccgtatgacctcccgtcatcgtggcggcggtcacaagcgccagtaccgtctcatcgacttcaagcgttgggacaaggacggcgtgccggcaacggtcgctcacattgagtacgacccgaaccgttccgctcgcatcgcactgctgcactacgcagatggtgagaagcgttacatcatcgctccggaaggcatcaagcagggtgacgtcatcgagaccggcgcccaggctgatatcaagccgggcaacaacctgccgctgcgcaacatcccgactggtaccgtggtgcacgcgattgagctccgcccgctgggtggcgccaagatcgctcgttccgcaggtgcttccgtgcagctcgtcgccaaggatggcgcttacgcccagctgcgtatgccgtccggcgaaatccgcaacgtggatgctcgctgccgcgcaaccgttggtgaggtcggcaactctgatcacgccaacatccagctcggtaaggcaggtcgtgcacgttggatgggcaagcgcccgatcacccgtggtgaatccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgatcacccctgatttcatcggacacaccttcgccgttcacgatggccgcaagcacgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatcccttccggtgcgtaaggtcctagagagcgccatcgcgaacgctcgcgtgaaggccgacaaggccggcgaaccgttccgtgagaacgacctggtcgtgaaggagacctatgtggacgaaggcgtgacgctcaagcgtttccgcgctcgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagagccatcgttccaagtggttctccgattccaacaaggtcggcgaacgctaccgcgacttcgttctcgaagatgacgtcatccgcaaggccatgagcaaggatctcgagcgtgcgggcgtgtcccgtatcgtcatcgagcgtacccgcgaccgcgtgcgtgtggacatccacaccgctcgcccgggcatcgtcatcggccgccgtggtgctgaagctgagcgcgttcgcgccaagcttgagaagctcaccggcaagcaggtccagctcaacatcttcgaagtgaagaacgcagcactggacgcccagctcgtcgcacagggcatcgctgagcagctcaccaaccgcgtgaccttccgtcgcgcgatgcgtaaggcccagcaggatgccatgcgtgcaggcgccaagggtattcgtatcaagctctccggccgccttggtggcgccgaaatgagccgttccgagttctatcgcgagggtcgcgttccgctgcagaccctgcgcgccctcatcgattacggcttcttcgaagccaagaccacttacggccgtatcggcgtgaaggtctggatctacaagggtgacatgaccgagcgtgagttcgaagagcagcaggcacagcagagcaacaaccgccagggtcgccgcggcgatcgccgtccgcgtcgtggccagcgcaatgctgccccgcagcagaacgcagcagcagaggctccggccgcagctgaggcacctgccgcaacggaaacgaaggagtgagctgagaaatgcttatcccaaagagaaccaagtatcgtaagcagcaccgtccggtccgccgtggcatgtccaagggcggaaacgagatcgcattcggcgatttcggtatccaggctctggctccagcttatgtgaccaaccgccagatcgaggccgctcgtattgccatgacccgctacatcaagcgtggtggccgcgtgtggatcacgatcttcccggatcgtccgctgaccaagaagccgcttggcacccgaatgggttccggtaagggtactccggaattctggatcgctaacgtccacccgggtcgcgttatgttcgagatcggtggcgtgtccgaggatgtcgctcgcgaggctctgcgccgcgcaatcgacaagctccctatgaagtgccgtgttattgctcgtgaaggcggtgacatctgatggcagtcggaactgcagactacaccatgaagaatctgaacgagaagaccaacgaggagatcgagggcttcctcaagaagtccaaggaagagctgttcaacctgcgcttccagtccgcgaccggtcagctcgaaaacaccgcccgcctcaaggcggtcaagcacgacatcgccaggatgtacaccgtcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctgtacggcaaggtcgtgcgttccactcgtacggtcaaggtccatgatgaacacaacgaggctcacattggcgacctcgtgagtattatggagactcggcccctgagcaagaccaagcgttggcgtctcgatagcatcatcgagcgcgctaagtaaataagttcggcaaggctccgtgagtcaccccgcctgcttcaagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggcgacgtgatcgtcgcctccgtcaaggacgccatccctggcgggtcggtcaagaagggcgacgtcgtcaaggctgtcgtcgtccgcactgtcaaggagcaccgtcgtgtggacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcatccgcggcaaggatcgcggcaaggaaggcaccgtcaagcaggtgctcaaggacgatcgtttgatcgttgaaggcgtgcagatcgtcaagaagcacgttcgcgctacgcagcagggccagcaggccggcatcgtggctgtcgaggctccgattcatcgctccaacgtgatggtcatcgatccggagaccaagcagccgacccgcgtgcgcatcgtcgaaaaggaagaggctcgcgacggcaaggtgaagaccgtgcgtgtgcgtgttgccaagaagtccggaaaggagctggcatgaccgataccactgtcgaagcgccggcaactccgcgcttgaagcaaaagtataacgagcagatcgtgccggagctggagaaggaattccactactccaacccgatgcaggttgctcgcgtccagaaggtcgtcgtctccatgggcgttggcgccgctgctcgcgactccaagctcatcgaaggcgccgtcaaggacctcaccctgatcaccggccagaagccgaagatcaccaaggccaagaagtccgtcgcacagttccacctgcgtgaaggccaggccatcggcgcttacgtcaccctgcgtggcgagcgcatgtgggagttcctggatcgccttctgaccatggctctgccgcgtatccgcgatttccgtggcatcaacggcaaccagttcgacggtcagggcaactacaactttggtctcaccgagcagtccatgttccacgagatcgatccggattcgatcgatcaccagcgcggtatggatatcaccgtggtgaccagcaccaaggacgacaaggaagctcgcgtgctcctgaagcatctcggcttccccttcaaggagaactgatatggcaaaaaccgctcttaagaacaaggcggccgctaagccgaagttcaaggtgcgcgcttacacgcgttgccaggtctgcggtcgtcctcactccgtctaccgcaagttcggcctttgccgcatctgccttcgtgagaaggcccaccgcggcgagctgcccggcgttacgaagtccagttggtaaataacgacgctgaaggtccgcggcccaatcgctgaaaagcgtgcgggcggcggaaaccacggcgagaaagggcaataagcccaaatgacaatgacagatccgatcgcagacatgcttacgcgtctgcgtaatgcgagcgcggcaaagcacgaaaccgtggatatgccgtactccaagttcaaggcgaacatcgccgagattctgaagcgcgaaggctacatcaaggacttcaccgctaaggaagccaaggtcggccagactctcgaggtcaccctcaagtatggtccgaacggcgagcgttccatccagggcatcaagcgcatctccaagccgggcctgcgtcgttacgcaaagtccgatgctctgccgatgccgctcggtggccttggcatcgcaatcatctcgactagctcgggactgctgacccagaaggaatgcctcgaccgaggcatcggcggcgaaatcgtcgctttcgtttggtgagaaaggagagctgaaacatggcatcgcatattggtaagctccccgtcaccattcctgctggcgtggaagttaagatcgacggtcagtccttcaccgccaagggcgctaagggcactgactcctacgagattccggaaggcatcaccgctcaggtcgaaggcaacgagatcatcctcgtcccggctgacgatctgcgcccgacccgtgcaaagcacggcctggctcgttccattgtggcgagcatggtcaagggcgtgcacgagggctatgccaagaccctggatatcgtcggcaccggttaccgtgctcaggcgaagggtaagggtatcgagttctccctcggttattcccacaccatcaccgttgagccgccggaaggcatcgagttcgaactgccgaacccgaatcaggtgatcgtcaagggtatcgacaagcaggctgtcggccagtgcgccgctaacatccgcaagcttcgcgctccggaaccctacaagggcaagggcgtcaagtactcggatgaacgcatcctgcgcaaggctggaaaggctggtaagtaatgagcgtccagattttcggtaagggcaagaaggtcgcgctccagcgccgtcacgctcgtctgcgcaagcgtatcagcggtaccccggagctcccgcgtctggtggttacccgttccaaccgtcacatggttgcccagatcatcgacgacaccaagggcattaccttggtgagcgaatccactctgatgagcgatttcgctggttttgagggcaccaagaccgaagccgccaagaaggtcggcgaactgattgccaagaaggctcaggacgcaggcatcaccgcggttgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgctgctgaggctaccaacgaggatcgcaagtcccgtcgtggccagcgtggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgccgccctcgtggtggttggcgacggcaacggcaccgtgggcgtcggctacggcaagtcccgtgaggtcccggctgcaatcgccaaaggccagctggatgccaagaagcacatgttcactgttccgcgcgtcaagggcaccgtcacccacccggtgatcggtcatgatgccgcaggtaccgtgctcctgcgcccggctgctccgggtaccggcgttatcgccggcggtgcagtccgcgctgtcatggaatgcgctggcatcaccgacgtcttgaccaagtcgatgggctccgccaccgccgtcaacgtggtgcgtgcgactgtcgacgctctcaagaagctcgaagagccggaagagatcgcagctcgtcgtggcatgtccctcgaagaggtggctcctgactccctgctgcgtgctcgcgccgaaggcatcgccgaggctcgcaaggcccgtgaagaagcacaggccaaggccgctcagaaggacggtgagtgatgactaacctgaacatcaagctgcaccacggtctggtgaactccactccgaagcagcgtgctgcggctcagactctgggcctgaacaagattggcaagaccgtgactcgtgaggacaccccggcccttcgtggccagctgctggttctccgtcacctggtcaccgttgaggaggctgactgattatggcagatattctgcagatgcatgacctgaagccggctccgggcgccaagaaggatcgcattcgcgtcggtcgtggtgaaggctccaagggtaagacctcgggccgtggcgacaagggtaccaagaagcgctatcaggttcgcccgggcttcgaaggtggccagctgccgctgtacatgcgccttccgaagctgcgtggcttcaagagcccgttcaagaaggaatatcaggtcgtcaacgtcgcagctcttgcggaactgttcccgcagggtggcgagattaccgttgccgatttggttgccaagggtgccgtgcgtgacggctacccggtcaaggtcctgggcgacggcgaggtttcggctgcctacaccatcaagggtgtcaaggcttccgcttctgccaagtccaagattgaggctgccggcggctccatctccgaggactgattccacggaatgtagctgacttaagctcgtaagtgaggcttctcccgctggggcgggggaggcctcacttcgttttttcggtccagtacggggatcgaaaaacagtgcccagagatctaatgaaaaccgacaatggaacactccatgtgtaggtagacgccgtacgctagactcaaccggtagagtctgtttttgcacgggtgcgccggcgcgcacgtcgatggaaggaatcccaggtgaggacgttaatccaggccttgaaaaccaaggagttgaggaacaagatcctcttcactcttggtatcatcatcatttatcgtattggttcgttcattccgaccccaggtgtcgactacaaggtggtccagcagtgcgtcggctcgatgaacagcacctccgagaacttcattggtctggtgaacctcttctctggcggcgcaatgttgcagctgtcgatcttcgcgctaggcgtcatgccgtacatcacggcatctatcgtcatccagctgctccgcgtggtcattccccgctttgaggcgctgcataaggaaggccagtctggtgaagccaagctgacccagtacacccgttacctgaccattggcctcgctgtgctgcagtccaccaccattctggtgaccgcccgctccggtgccctgttcaactatcagtgctcccaggtcgtgcctgacggttccgtctggaacctcgtggtcatggtgctgatcatgaccggtggtacgggcctgatcatgtggatggccgaattgatcaccgataagggtcttggccagggtatgtccatccttatcttcatgtccatctgttccggcttcctgccgcagttgtgggagatcggttggggcaccaaaggcaccgatggcaattgggcgaagttcgccgcggtcgtcggcgtactgttggttatcatgatcctcgtcatctacgtcgagctttcccagcgtcgtattccggtgcagtacacccgtcgtatgattggccgcaagatgtacggcggatcctctacctatctgccgctgaagatcaatatgagcggcgttattccgccgatcttcgcgtcctccattctggccatcccgaccctgatcgcacagttcggcaaatccgaccagtcctgggtcaagtggattaactccaacctggccaataccacttccgtgtggtacatcgcactgtacgcgttgatgatcgtgttcttctgcttcttctacacggaaatcaccttcaacccggacgagaccgcagacaacatgaagcagtacggcggcttcattccgggaatccgtgcaggcagcgccaccagccgttatctgagctacgtgatgaacaggctcaacaccgtcggtgccgtgtatctgctattcgtggcgcttattccgaccgtgctcatcatggcgcttgacctcaacaccaagttgccgttcggcggcaccaccatcctgatcatcgcaggcgtcggcctcgacaccctgcgtcaggccaaggcccagaccgaacagttccagtacgctggattcctgttcgagggcactgaccacaaggaaggcaagtaaagcctcaaaatcgtgataccgtttcgacgtgaggcggtatcacgattttcatgtaaccaatcgaaaatcagaaagcctcgaaagaggccaaatgaaacggagaataacatgcgactgctgatcatgggacctcagggcgtcggcaagggcacccaggctgctctgctgagcgagcactacggtattccggcaatctccaccggcgatatcttccgctacaacattaagaacaagaccgaacttggcgttgaggcactgaaatacatcgataaaggcgaactggttcctgacgagctgaccaacaagatcgtcaaggatcgcttggccatggacgatgccaagaacggttggattcttgacggttacccgcgcaacgcctcccaggtcgaagcgctggacgccatcctcgccgatctgaacactccgctggacgcagtggtggctctcgacgccgaccatgacgtgcttatggagcgcatgaagaagcgcgccgagatcgaaggtcgctccgacgacactccggaagcaattgccaagcgcctcgatgtatacgccaaggaaaccgctccgttgctgacaacctacgaagagcgtggcctgctgaagaccttcaacggcgtcggttccgtcgaagagatccagtccaccatcgtggctgaactcggctgaaatagctgaggattgggctgattcgaagcatattcatagataagaaagcccaataaaataccacaaatcaatcgaaaacgggaattgcgacacgccgaatgtgccgtaattcccgttttcgtgtattcttgcaagttggtgtgtcttcgggcacgcatagtaatcgccaaagaacggaacgaggctcatggctaaagacggtgtgattgaagtcgaaggacaggtagtggaagcactgccgaacgcgatgttccgcgttgaactcgagaacaagcatatcgtgctcgcaaccatctcgggcaagatgaggaagaactacatccgcattctgccgcaggatcgtgttgtgcttgaaatgagcccttatgatctgaaccgcggccgtattacgtaccgttacaagtaaggtacataagcaaaggaaaaccatgaaggtcagccctagtgtgaagaggatctgcgagaattgccgcgtgatccgtcgtcacggccgcgtcatggtgatctgcgtcaacccgcgccacaagcagcgtcagggctgagagtagatccagcggcacaataagtacaggcgctgagtcacagatcgcgcaagcgatatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgtgggtcgtactcgtgccaaggaaacgcttgccgcgaccggtatcaacccggatattcgcgtcaaggatctgacggatgagcagctgattacgctgcgtgactacctcgagggtaactataagatcgagggtgatctgcgtcgtgaaatcgatgcggatatccgtcgtaagattcagatcaactgctaccaaggccagcgtcaccgtaagggacttcctgtgcgcggtcagcgcaccaagaccaatgcacgtacccgcaagggtccgaagcgtacggtcgccggaaagaagaaggccaccaagtaatcggtggctgtcagttcagaccacgagacgtaagtttcatcgcctgaacaacaaagcaaattcgttattaggaaacgagggtcaatggcagctcaaaagcaagccgcgcgcaagccgcgtcgccgcgaccgtaagtcggtcccggttgggcaggcgcacatcaagtccactttcaacaacaccatcatttcgatcaccgacccgtccggcgcagttgtgtcctgggcgtccggtggcgatgtcggcttcaagggctcccgcaagtccacgccgtacgccgctggcatggccgctgagtccgcagcccgcaaggctatggaacacggtctgaagaaggtcgacgtgttcgtgaaggggccgggttccggtcgtgaaaccgctatccgttccctgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctctcgagcctggtttcggttacacgcttggcaactcgctgcgccgcaccctcctgagctccatccctggagcggctgtgacttcggtgcgtatctccggcgtcccgcacgagttcaccactctgccgggtgttgaagaggacgttaccgagatcctgctgaacatcaagggcatcgtgctcaccagcgaatacgatgagccggttgtcatgtatctgcgcaagagcggcaagggcgaggccaccgcgggtgacatcacccctccggccggcgtcaccatcgccaacccggatatgcatatcgcaaccctcgcggaagatggcgaacttgaaatcgagttcaccgtcgagcgtggtcgcggctatgtgcctgcccagatgaacaagcaggataacgccgagatcggtcgtattccggtcgactcgatttactccccggtgctcaaggtgagctatcgtgtggaagccactcgcgttgaacagcgcactgacttcgacaagctcatcctggacgtggagaccaagccggcaatctccccgcgcgatgcagtcgcatccgcaggctccaccctggtggaactcttcggtctgtgccgtgagcttaacacccaggctgagggcgtcgaggttggacctgccccggtggcagaggaaaccaacccggagatggctgttccgatcgaggatctcaacctcacccagcgcagctacaactgcctgaagcgtgaaggcatccacacgattggcgagctggtcgcccacactgagcaggatctgctcgacatccgcaatttcggtatgaagtccatcgacgaagtcaaggaaaagctccagtccttgggtctggctctcaaggcttccccgctgggcaacttcgataccaacaacctcgaaggcggcaccttcttctcgccggaagacgagtgattcgccgcttttgacctaaccgcttcgttggattcggatgttcgggcgattgcccacctgaatccaacggggctttcaaggagaaacaatgcctacaccaaagaagggtccgcgtctggcctccagcccggctcatgagcgtcttatgctcgcgaacatggctaccagcctgttccagcgcggccgcatcaccaccaccctgccgaaggctaagcgccttcgtccgttggctgagcgcctgatcacgctcgccaagcgtggtgatctgcacagccgtcgtcgcgtgatgcgtgtcatccgcaacaagtccgttgtgcacaagctgttcaccgagatcgccgagcagatggagcagcgtgagggtggctacacccgcatcgtcaagatcgctccgcgtcgtggcgacgccgctccggcagccatcatcgagctcgtcaccgagccggtgagcccgaagcaggccgtggtcaaggaagctgaagctgcaaccaaggttgccgctgaagaagctccggttgtcgaagaggcaccggttgaggctccggaagccaccgcagagaacgccgagtgattggcatcaagcaggcttgactagctgatgaaaaggctgggaatcgaaaggttcccagcctttttgttatgcgttgtcatgtgttgttatgcgccttttgttatgctcattgccgtgagattacgtatcgacttggcatatgacggcaccgatttttacggatgggcgaaacagcctgacatacgcaccgtgcagggggaaatcgaacgtgtgctgcataccattctgcgcgtgccggaaggcgacgacaatgagccgctgcgcctgaccgtcgcaggtcgtactgataccggcgtgcacgcgtcgcaccaagtttgccatctcgacatcaatgaggagacgcttgcacgttgcgtcgggcatatgcaggtcgaaccggtgatggcgttgacgcgacgactgcaacgcatgctgccgaacgatatcgccattcgttccatcaaagaggctcctgaaggattcgacgcacgcttctccgcgttggaacgcacttacgtatatcgcattgccgaccgatcaagcgaaatcgatccacgtaccagaaatagcgtgctgcatatcgacgataatcttgacatcggcgccatgaacaaggctgctgaaatgacaatcggtctgcatgatttcggctcgttcgcaactcccaatccaggaggaaccaccatacgcgaggtcaaaaccgcgtattggaggcgcataccgcagcatccgcttatcgacgacggaaccaccatgggggagcggtaccgaacgcccgccttggagtcgggactgctctgcttcaccatcgtcgccgacgcattcgcacgcaatatggtgcgttcgttggttaacggttgcgtacaggttggtatcggcaaacgttccttggattggttcgccggaaaaatggcgacgccgttgcgtgaaggcagcactggcccgatcgctccgcaaggattgacgctcgaacatatcgaatatccggaagacgaccagttggcgattcgtgccgaagcgattcgtgcgaaacgtactttgtaagagcacatactgtacagttgcacgcaaactggcgacggaactggtgaaccgccgggagtcgatcaaccgcgagttgagccgtaatggtgtgcgtttcggtatttgattatgcgggcaaaagacatcgtgtgggcgtggtctaccgtcgcttgtcggacgaatatctcgatccgttcgcattcaatccggattccgtgatcggtgtgccgccatgttggtctcaccgcgtgttataccgccggattgttgggtggagagggtgccacgcacgcttgggtggaggtgtaccataacgagcgttggattgggtttgatctgacacataaccgtatggtcgacgacaactacatcaccatcgcgcacggccgtaattaccgtgactgcatgctcgacatcggtattttctccggttgcaatgtgcaacagcatcagtgggtgaacgcttccgtgcacgaacaggagctgtaggcaataaaaaaaccgaagcgccgttgctccggtttttctacttgcggataaggcgagattcgaactcgcggaggggtttgccctcacacgctttcgaggcgtgctccttagaccgctcggacacttatccattgcgccgcttgaaaacaagcaacttgattattttgccacagctttgtcgattgtcaaatccagctatgagatttttgcgatgtccgcgattgttcggcgtgtcttatctgcatggatgatgcgtcacgttgtcaggctcgcggctgcgcaggtatcgcgtaggttgttgtatgaactggcgtgtgttggtgtgcgctattcgaacaatgcttcgtcgaatgatggatagccccaagtgagagctaggtccacacggtcggcgatcatgctggtaagtatgcccagagactgttgccttgaatcatctgaagagttttctgcggtcgtgcgggattgcgccgaatcgctcgtcgaattcgaacttgattcgacggctgcgatttcgctgcgtgcgcaattcatttcaatgacggcgtcggtcggtgcgaacaatccagttgcggaatccacaatagtatcgggatgggcgagcaattgcgcgacatcataggttttcgcacgggtatcttcagctccagagaaggaaatcagccgctgcgaagttgttttatgacgatcgctgatatcgagcgtcgcatgtccgatggaacgtgccgcgaaaacctccattgcgaatccggcctgatcttccgcaacggacatggcggaaagcgaatccgcgtcaatatcaaatgaatcgatgccgtcgcaacgtgacagcgtgggctgtgcgatgttgatcgtaagtcgcgccgccatcaaacgggcggtgtgacgggcctgcgcgctacgcaacgtgccgtcggcgaaccgtgcagggcagtaggccgcggtgtttgcccaatctgaaaccgcttcctgcgcggcaagatagcgcataatgatatggcgtgacctgtctgccatgatgtcggcgttggcggtcgcgtcagcatacgccttctcgcaaggacttggctgcagttcagcctcggcgcggcccgcgattcggggtgcggagcaagcagtcagagacgctacaagcacgcctatgcatgccaagacgcagacgcgtcttgaggtcgacgagaccgaggggaaaagaggggaacgtgtctgcatgaaacattagactaatagttgactgtgaccattgggccgagcgctcggaataacttcatataggaggtcttggaagtatggaactggacctggcaggaatgcaccagctcgcagctgggcagggaatcgatcccgagacgctggatgccgcactctcggaagcattacgactggcatatctgaaaacgccgcacgcggcgaagcatgctcgtgtggagcttgatccgcgtgccggaagctttaccgtttgggctcaggatgagattccggtcgaaccgaccgaggataatccgcaccctgcgccgactttgggcgaggaatacgatgacactccgcgtgactttggccgcttggccgcagccaccgcacgtcaggtcatcagccagctgttccgcaaggccgaggacgacaaggtgttcggcgcgttctcagggcagaaaggcaagctgatcaccggtatcgtgcagcaggacgtgaaggacacttccaatgtgcacgtagccgttggcgatgtcgaggcgttgcttccccgtcgtgagcaggtgccgggagaacgctaccgccacggtgagcgcatccgcgtatatgtggtgaatgttgcacgcggtctcaagggcccggaaatcgtagtgtcccgctcccatccggagcttgttcgccgcctgttcgagcgtgaggttccggaactggtttccggcgccgtgtcgattatggccattgcgcgtgaggccggtgcccgcaccaagatcgcggtgcgagccaacactgaaggcgttaatccgaagggtgccctgatcggccccggcggcgctcgcgtgcgtgcggtgatggagaatctcggaccggaaaagatcgatatcgtcgactggtctgccgatccggcgaagttcgtcgccgcggcgctgtctccggcggtcgccaccggtgtgcaggtgatcagcgagaagaaccagaccgcaatcgccttcatccatgatgatcagctgtctcttgccatcggcaaggaaggtcagaacgcacgcttggccgccaagctgaccggatggaagattggtatcgaatccgccgaggcacacgccaagaagatggcagaagcgcaggcttcgaccagtgaggaaactgccgaataaccaacgctttcagcaacggcaagcccgtgggcgttcaatccacgggcttgagtatgctggactcgataatccaaagcgtgggggtttatgccgtcatgcccagggaaaagacgaggtatcacgaacatggttgcacgatgagaaggaacaagctcgccgtgaatcagtagcggtcgcgctcgtatgcgcgcggcccaagataggagaaattgagtgccgaaagcacgcgtatatgaacttgccaaggaacttggcgttgacagcaagactgttttgaacaaacttgaggcgatgggcgaattcgtgaagtctgcatcgtctaccgttgaacctccggttgcccgtaagctgaggaatgctttcgtttccaacgcgcagagcaacgcatctgaatccaagaagcctgcggccccggccaagaagccggctgcccccgcggcttcgcccactcctgcgcctcgcgccactcctgctgctcccgcggcatccgcggcaaagcctgccgctccaaagccggcacgtcctgcagcatccaagtccgaagccccgaagcccggccagcgcatgcctcgtccgggtgattcccgccagcatggcaatcgcgccaacggtaacactccgcgtccgcagggcgaacgccgtcagggcggcaagtcggctccggttccgggacctcgcgcacagcgcaacaataccaatgctccgcagggtggcaatggcaacaatgccgccaatggtgcgaagccgcacactccgggtccgcgtccgggcaacaatccgttcagccgcaagcagggcatgcgtaccccgacaccgggtgacattccgcgtccgcatccgatgaaccgtccgagcgccaacaacaatggcgaaggccgtcgtggcggccgcccgggtcagggtggcggtcagcgtggtggtttccgcggtcgtccgggtcagggcaccggcgcgaagccgggccagtggggccagcatcgttcgggtcagggtggcggtcagcgccctgcaggcggtggcaaccgttttggtggcggctccaataccaacggcggcggtttccagggtggcaatagcgctccgggcaacggtccggcacgcggcggcggtcgcggtcgcggcggtgctgcaggcgcattcggacgtcagggcggcaagtcctcgaaggcccgtaagaatcgtctggcaaagcgtcaggaattccaggagatgaaggccccggtcatcggcggtgtgcgcattcctaccggcaacggccagaccgttcgcctgcgtcagggtgcatccctcgccgatttggccgaaaagatcaatgtcaatccggctgctttggtcactgtgctcttccatcttggtgagatggccacggcaacccagtccttggacgagtccaccttccagattctcggcgaggaaatcggctgggatatcaagatcgtgtctgccgaagaggaagacaaggagctgttgcagcagttcgacatcgacttggatgaggaagagctgcaggaggatgaggacctgaagccgcgtccgccggtcgttaccgtgatgggccatgtcgatcacggtaagacccgactgctcgacaccattcgccgtaccaacgtcatcgcacgtgaagccggtggcatcacccagcgtatcggtgcatatcaggtgaccgtcgatcttgagggcgaaccgcgtaagatcacgttccttgataccccaggccacgaagccttcaccgccatgcgtgcccgtggcgccgagctcaccgacgtcgcgattctcgtggtcgcggcagatgacggcgtgatgccacagaccgtggaagccatcaaccacgcgcaggcagccaacgtgccgatcgtggtggccgtcaataagatcgataagcagggagcgaaccccgacaaggtccgcggccagctcaccgaatacggtctcgtgccggaagaatacggtggcagcaccatgttcgttgacatttccgccaagcagggcaccaatgtcgacaagctgctcgaagccgtgcttcttaccgccgatgctgagcttgatctgcgtgccaacccggatatggacgctcgcggtgccaccgtggaagctcgacttgacaagggccgtggtgccgtggcaaccgtgcttgttcagtccggtacgctgcacatcggcgactccatcgtcgctggcacctcctacggacgcgtccgcgccatgcttgacgagaacggcaaccacatgaaggaagccgcaccgtccactccggtgcaggtgcttggcttgacctccgtgccgaccgcaggcgacctgttcctggtggcctccgacgaccgtaccgcacgccagatcgccgagaagcgtcaagccactgagcgtgccgcccagctggcaaaacgtcgtaaggtcgtgtctctggaaagcctcaaggagcagttcgccaagtccgaagtcgacatgctcaacatcgtcatcaagggcgattcctccggttctgtcgaagcgctggaagattccttgatgaagatcgaagtgtccgacgaggtcggcatccaggtgatccaccgcggcgtcggcgccatcacccagaacgacgtcaacctggctaccgtcgacaaggccgtcatcatcggcttcaacgttcgcccgaaccgtcaggtggcggatctggccgaacgcgaaggcgtggaaatcaagtactactcgatcatctacaaggccatcgaagacatcgaggcatccctcaagggcatgctcaagccggaattcgaagaggtcgtcacctcccactccgagattcgcgaaatcttccgttcctccaagttcggcaacatcgcgggtgtcatggtgcaagacggcgaagtcaagcgcggtacgaagtgccgtattctgcgcaacggcatcgcaaccgtcaacgatctcgagatttcctcgctgcgtcgttttaaggacgacgttacttctgtcaaggaaggttacgaagcgggtatcaacctcggttcgttcaacgatatcgagcttggcgatattatcgagaccttcgaaatgcaggaaatcgaacgtaagtagtcgattgattcggaccagcgatcgataacaggaaaggaacgcccacagctgacatacggctgcgggcgttccgcgatacaacaagaacttatttcaaaaactaagctgatacattcatctgattgaaggacgataatggcaggaaccaatcctcgcgctgcacgtatcgcggcgttgatccaacgtgtgatcgcatcctccatggaggcgcagctgcacgacaagcgtctcgcaaacgtgaccatcaccgaagtgcgtgtgaccaacgatctgcagattgccaaggtctactggacccagcttggccgtgaaggccacgaacagggcgagcgtcgccgcgcacagcaggcgttgaaccaagccaagggccgtctgcgttccctcgtgggcactaaagccggcctgcgcctgactccgcagctcgaattcgtgtttgacgaggtgccgggcgaagcacatgaaatcgaagatattctcgccatcgcgcgcaagcgtgacgaagagctcgccaaaacccgcaaaaccgcacagtatgcgggcgaagccgatccgtacaagcatccggaagaggatgacgacgatgatttcgacgatgacgacgtcgaagtcgaagattgggacgatgacgaagaagcctgaacattccggtctgctggtcatcgacaagccgcagggcgtcaccagccatgacgtggtcgcggccgtacgcggcgccctgcatatgaaacgagtcgggcatgcgggcacgctcgatccgatggccaccggcgtgctggtggtcggattcggcaatgccacgcgactactcaactacattgtcgaccataacaaaacgtacgaggccaccattcgccttgggcagcgcactaccacggacgatgccgaaggcgagttgctgccgggggagtgggcagcgagctttccctcgcgtcaagctgtggaacagctgatcgcagaacgtttcaccgggcgcatcgaacaggtaccgaacgtctactccgccattaaggtcaacggtcagcgcgcctatgatctggcgcgtgaaggtaaggatgtggaacttaaggcacgtcctgtgaccatcgaagagttcaacgtacggcaggtgcgttacggctacacgcatagcgatcgtgccggcgcggaacttgttggcgcagtcgtggccgagaaggcaagcaatggatggattgccaacattgcaccgcatgaagacatgcagcccgttatggaactcgacgtgaccgtgacctgttccgcaggcacttacattcgcgcgctcgcacgcgatctgggcgaggaactcgggttgggaggccacctgacgatgttgcggcgcacgcgcgtcggcagattctcagtgaatatgcccaacgtcatgagcgcccacgctgaatccaaaacattcaccgatcgtgaaggcatggaagtgacgcgcaatcgtgcggtgcttgacgatgccgagcatgcgctcgatcatgcgctcgatcccgtggccagcgccgcggcttccatgagtatgctggccgtcagcgagcaagaggcggccgacttgcgtttcggacgcagaatcgcgcatgacatatgtacgaccacggcggcgtacgttgaggaaaccaacgatttggtcgctatcctcgaacgtgcgaaacgcggtgaggccaaaccggtcgcggtattcaactgaaccatccaatcagactacagatacgaattcatacacaagaaggacatgatgaagacaatcacgctcacgcctgatgccagtggcatggtggattggcctacgctgagcaatgataagaaatccgtggtgaccatcggttcgttcgatggcatgcatcagggccatcaggcggtgattcgccgcgtggtggaactcgccaagaaggagcagtccttctccgtggtggtgctattcgatccgcgccctgcattggtacacggttacgcggcgaagaacggcggtcaggagccgccggccgacatggttgatacgcaagcgctcaccagcatgcaggaacgtcttcgcgccatcgacaagctgggagtggattacacgctcatcgtgcactacacactggcattcgcggcgaaatcataccgattcttcctcggccagatggtcggcaagctgggtatgcgcactttggcgctcggctccgacgcggccatgggggcaaatcgcgccggagacgtgaaagccatcgagaatctagcgctcgctactggcgtgttccagcttgaagtggttgatgatcgaggtcccggagagacccgagtgccagccaatgcccaaccggttatgccgaccggccacggcgagccaacagacccgctggaaggcgcttccaaggcggaacgccgcgcatggagcaagaagaaccaagccaagcccgtgcgtgtgtggagttccacgaacgtgcgctacctgctaggccagggacgcatcaaagacgccgacgcgattctggggcatccgcacgccgtggaaggtattgtggtgcacggcgaggaacgtggacgcaccattggattcccgacggcgaatttgagtgacaatgtggccggttatctgccggttgacggcgtgtatgcgggttggctcgttgacttgggatcgaaaactgcagagagcgatcatgcggaagcagcgtccgatggtatttcgcaacagtttgactcgtcttccgttgatgcccgccttgccgatcattcgccgtatcgttggcccgctgcgatttccatcggcaccaagccgaccttcaacgaggcgaccggaatgaacgatcgcgtggtcgaagcttacgccatcaccgacgattggcttgatttgtacgatcatcaggtgcgcgtggaatttacaggattcctgcgtccgcaaatcaagttcgattccgcacaggatctgatcgacgagctgaagcgcaatgtcgaggaaaccaagcgaattactgcctgattctaatcgcaataataattacgataatgacagtgattaatgaatgctgatattttcgataaaaacgtatcagcattcaaaaaaatagtggggctcttacgtaagaatctacgtaagagccccactagtataggttaaaaaataacataatgtatatgcttcgcgtgcatacatgcgaaaacggtatgtagggtgtgtgctatcgcaacatggcgccaagcgcatcctgcaatgtgtcgacctgaacgatcgacaatccgggaattgcgatttctctacgtaatgtcggcactacagcggtggtgaagccaagacgggcagcctcgcgcaaccggtattccagtcgcggcaccgggcgcacctgcccggtcaacgaaatctcgccgatcgcacacgtggtgcggccgatcgccttcgacttcgcggcgctcgccaacgcgcccacaatcgccagatcgcagcccggctcacgtgcctgacctccagcaatcgtggaaatatagagatcgtttgccagaagattgacgttgccatgcctgtatagcaccgccaccagcatggcgatgcggttcgcgtccacgccattcgccgcacggcgaggcgtcggcaataccgatttggtgaccaacgactgcacttcgataggcaggctgcggtggccgtccaaggtgaacgtcacgcacgtgccctccaccggagcggaactggcggaattggatgatgaaagaaaaagcccagacgggtccgtcacctcttcgatgccttcgccgctcatatcgaaacagccgacctcatcggtgggaccgaaacgattcttcaccgcgcgcagcatgcgaagcgcggtttcagcatccccttcgaattggcagaccacatcaacgagatgctccaacgtgcgcggaccggcaatcgagccgtctttggtgacatgaccgaccagtaatactggaatatcaagcgtttttgcagtgtcgatcagggcgctcgccacttcgcgcacctgcgtcgaccctccggaaattccgtcgacttcctgcgagacgatggtctgtgcggaatcgacgatggccagcgcaggcttgctttgctcgatcagtccgagcacggtcgacaggtcggtggtggcggacagtagcagattcggctcgaccgcgcctatgcgtgatgcccgcatacgcacctgcgcctgcgattcctcgccggaaatatacagtaccgtgttgcgttccggttgcgccgcgcaaagacgggccacgttgccggcggtttccagcagcagtgtcgatttgccgatgcccggctcgcctgcgatgagcgtcacggagccgggtacgatgccgccgccgagtatgcggttgaattccgtgaaacccgtgctgattctggaaatgttttccgtgccgatttccgtgatgggctttgcggcggaagcgggcaccatatgcgattgcgtgcgcgatgtgcgcccgggggccgcggtgcgtttcgaagcggcgggacgggcctcgtgaaattcctcgatggtgccccactggccgcattcggggcagcggcccagccatttcgggccgttccagccgcattcggaacatacaaattgcgaggacgtctttgccatatcgctgacaatacggatattttgggacaatcgttttcggagatattaagggggtgctggtgcgggatgatggcgagatcacggtttctggattcgagcgtctcacggatatgaaagaataacagccatgtctactacgcaaacttcctcttctcatggcaaactgatcgtggctgtcattgccgccgctttggtggtcgtgctcgccttggtgtccgctttcatctggcccggctgggctctgaacaagggcgatgaagcgtccactcagggcaccaccacctcgcagggcgcgtcgcaggatgcctctgagccgaccacgccgtccattgacgctgtggcgttgccggatgacgccagcgaactgttgaaggccatgcctgattccgtgttgaatttcgcgcgcaccaaggccgatgccagcacttcgtggagcggcgcttccccggtcgaggagtacacgttgacgtattccacgggcaaggacggtcaggatatcaccttgaaagtggcgcaatggtctcagtctgatgatgcgcaaagtcagtatgacaatctgaccggtgccatgaccggcaaggagctgggcggcggcaatgtgaaggtttccggtgaagcgaccggcgcctatagcgccaaaaccgatccggacgacgaaaccaaggccatcgcggtctggcgcaacgataccgtggtgttccaagccacgggagccaaggattcggtgcagcgcttctaccagcagttcccgctgtgatactgcctacggctggttgtgcgatcctatgattcatgcatgattcacgtaagattcagccgtggaccatgcggactgcgtttgcctgatcttccgataaaaaggtgcgtgcttccaccatatgaatgcggttgtgtgcgttagtccccgaagcagtgtagtattgggcaagttgcaaacttttaccctttgagtttaagaacggaggctgagatgggctcggtcatcaagaagcgccgcaagcgcatgagcaagaagaagcaccgcaaactgcttcgtaagactcgccaccagcgcaagtagtcttcaggcgcggttgaagcgtcgcttaaacaaaatcccgtatgtcttcttgaggtatgcgggatttttgcatattgcaaagaaataaacgaaaagtacgagaatcggaaatcaatagatgcaaaaagaaggctgtgcgttcgaagttgaacgcacagcctcatatggtttcgtgtaggttcgcgaaaatccgcggaaaatgcggaacttacgctacttcaaactcacttgttggagttggtgagcacgcgcggaccgttgggatcgcccacgatgacctggtccaccatgtgcaggaacaggccatgctccaccacgccaacggtgttgatgagatcgtcggccagagcctccgggtgttcgatgcattcgaggtgcagatcgaccacgtagttgttctcgtcggtgcgcaccggctggccttcggcgtcgaggcgaagcaccggcttgtagccgcgggattcgaacttcttgacgacctggcctgcgccgaacggaatcacctcaaccggcagcgggaacttgccgatggtgtccacaaccttggactcgtccacgatccacacgatcttgttggagttggtggccacgatcttctcccacagcagagcggcgccgccgcccttgatgccgttgaagttcttgtcgacctcgtcggcgccgtcgatggtcacgtcgatgtgatcaacgtcatcgatgtcgacgatcttgatgccgtagccttctgcctgctcctgagtgcggcgggaggtggtcacgccggtgaactccaagccttcctcctgcacgcggcggccgagctcgtcgaccaggaagcgcacggtcgagccggtgcccagacctgcgatcatgccgttctgaatcagcttggcagcttcgatgccggctgccttcttcaatgcgtcctgctgtgccttgtccatgatcctccttcgatatggggttaagaccgtctccatattatcggatgtgttgatttttgtgcgtttgcggacatgtcatgaacgaaggtgtgccattggtggtcagcaaatgttttcacaggatgtttcacgcactttcgaggcgttaaggtcgaaagtgctggctcgttagttgtgcttgactgcaaatggcgcttcgtcgaggacgagcgtgccgtcgccttgcacgtagccttccaccgcgatgtaaccgcggatcaggcgtggcttgccgtcgaacgtcggactggaatttggcgggggagtgaagcgaatggcgcccgacaccgccaatcccgaaggactggcgcgatgcggcagtttcggcaagtcggcgacggcgttcgttggcgccgacgcgtttgcggattcggctgattcgctcgttggcgccggcgtgttttccgaggaattcgcggattgttcgttctgtgcatcgtcggctggctgccgctcgtcatgctcgtggggaaaacagtccggcttgagcagcatttcggcatacgatttgcgcggtgcctcggcgtcaggcgtcgtgccatcaggcatggtcgtatcaagcgcggtggtcggttccggcatgtcgtcggattccaccgacatttcgttggacgtcaacggcaatgtcgcctcgtcgggcgctggatagccttccggctccaccagcatatcggcgatggaacgtggacgcggctccggatcggccgcgcccatcagatcatcggccgatccttgagcggacttgccttgcccgcgccccatatggtattcgtccgtagtgattttgccgtcaagcagcatttgggcatcatcgggaacatcggtaccttgcgaatattcggaagccagcagcgactgccaaccctccaaaggaagatatccttcacggatcttcgaacggcaatcgcccgcataggtgcgcgccagctcgtccaccttctcattgccggcattgccggcatgacccttgacccatacgaatttcaccggtccggggcgcttggagatttcggcatcgatcgcgcgaatcagatccgcgttctttaccggcttcttctgcgagttcttccagccgttcttcttccagccgtgaacccacgtggtggaacagttgatcgcatactgcgaatcggtttcgatcaccaacggttcggagccggggtgcgcgcgcaacgcctccagcactgcgcacagctcgccaatctgattggtgccgttcgtagctccgccggcatcgcagtcgctgtcatggtgatgccccggcttgccgcctgtggcaagctcatgatcggcccaaccccaacccatcggaccattcggattgcctaaagcggaaccgtctgtagaaaccgtaatcgtcatatctctaccctacgaaagccgtgagacgctgccatacgtggtgaactgcgaactgtgatcgggcgacgtcgaacgggaatctcaatcatccaaacacagcatgacggaagcgcggaacagcgtgccgtcataatcgaacgaggttgcgccatgatgccgttccgcggtttcgcgcacggtggcggtgcccaaaccttcacccccatgcttggttgaggcgaaagcgtcgccaacctgcataatggaggaatcgtgcgtgttgtcgaccacaatgaacagtgatgcgggcggcccagtgcgatatttgatgcgcaccctgagttttttctccccatcctgttgtttcataatggcctcagacgcattttccagtagattgccgaccatggaacataattcggcattattgatgttgagatattgcggcaccgacgctttgacgtcgacttcagcccctatatggcggatccagtcacagtagtagaccagcaccgcgttcaacgaagcatgttcgcaatactgcatggggatgggctgcaacagcctatgattggccatctcctccaaatacgaggtgatgccgggcatatcgtcggccgcggcgagagcctgcaacgtctgaatatgatgccggatattgtgcttgatctgcctcgcttcgttgatgcgttcgttcatatgctgcagctgcaaggtctgcatggcttcgtaatgttcgcgtttgctggcttcgcgcagtcggtccgcctgctggaccatataccagatgaggaagtaggccatggtcatgaaaccggaatatgcgatggatacggtgaaggcgatgctaagcacgcgggtgtcgagcagcgatgcgttgtcggcgggcatgcaccacaccacaattgctgtggaaatgaacgggaaaagccagatgaccctccaaaaattcctgctgatggaaggtgaatcgaatgttgcggaaaatgaatgatggaacggatggaaaagtgtagtcgccgcaatcaaatcaaaaatcagcagactgatcattcccggccatccgacacgtaaattcatggactgctcattcagaacagctaaatccacggccaaagacaggtaataaatgatcgcgacgatatatgcggctgttgaaacgacgaaaagaagctgcccccaaggaagattcgtcatcttacgtaaagccaataccacaaccggagccgaaggaatcacggaccagagcgaggggacgtgggcgaggcaacatgcgatgccgcacaggaagaagacaatcacgccggaaatcatgagaataaggccgtcgcgcttgggattctccatatgatgccaggtcatgtacaggcagagaagcaggcccgttagcgcgtttagctgctcgccgatggcgaagaacatgcatgatggcgcgatcgatgcgagtgcgtcaagcatggctagtcctccattctcatgcgggtgaacgtgtattccgcgtattttctgcaggtggtggtcaccgcggttttcgtgatgggaatgtgcttgccgcctttcatcacgaattcattgttgctgatgcctgacacgtagtcgaagttgacgagcactcctcgcgcggtgcggtagaagttgctgaatacggtgagacgatgttccacatcggagaagttggtgcggattttcgcgcaggtgccgtcggcgaaggtgaattccacataatgcgcgctggaaagcgcgtaggcgataaggcgacggtccatggtgatggcgggattgccgaaagccacctgccatgcggcgtccgtgctgctttgtgcattgcccgtcgattgatgttttttcagatgagtgaccggtgttttcgtgtcgagctgcgctgcgacgcggtccatggtcgcatggaacgcgtcgtgattcaggggcttcaacagatatccgcttgcctgcacctcgtagccgagcacggcgaaatcagtgcttgacgtgatgaacacgatcgggcaatcgtcgttttgtctgcgcagcgtccgtgcgatatcaagtccggtcgccgcatgcgtggcggtttcgtcgtccgacagatagcagtcgagcagcagcaggtcgtatcgggcgtctttccagctttcgatgaaggattccgcatcggcgaaggtcacgcattccacgccgatatcgcgggtgcgtttgaaatattccgcgcacatgacggccatcagttggcgttcggcggcgtggtcttcgacgatggcgatgcgcatcgttcacctcccatgaagattggcggggaccgctggactgagtgttgtgtcgctatcattcaagcgtaatgcgaagcggggccggcagggggtgatagcgtgcgtgtcatgccagaattcggcgtttcgtgccatatcgcacgattcgtgttcgttgcgattcgtattcgggcggatatgcgagaagcccgcctttttcaggaaagcgggcttctcagtgagtttgcgaatgattggcgaatggctggattacgccgattcgtcaatgatcactcggccaaggccttgtccacgacttcggtggcttcggcgagcaccttgtcgagggcttcgggggattcgaaggactcggcgtacaccttgtagatgttctcggtgccggaaggacgggccgcgaaccagttgttctcggtggtgaccttcaggccgccgatcttggcgtggttgcccggggcttcggtgagcttggcggtgatgtcctcgccggccagctgggtggccgcgacgtcgtcgccggaaagcttggcgaacttctgcttctgctccaaggtggtcggcgtgtcgactcgcttgtaccagctttcgccaaagcgatcgacctgctcctgatgcagctgggccgggttcttgccggtcttggcggtgatttccgcagccagcaggtcagggatcagaccatccttatcggtggtccacacacggccgtccttgcgcaggaagctcatgccggagctctcttcgccgccgaaggcgacttcgcccttgaacagcgggtcaacgaaccacttgaagccgaccggaacctcaacgagcttggcgtcgatggaagcggccacgcggtcgatcagggaggaggacaccagcgtcttgccgatgccggcgccttccggccagcccgggcggttgccgccgaacaggtactctacgcacacggcgatgtagtggttcgggttcatcacgccccagttcgggcatacgatgccgtgacggtcggcgtccggatcggtgccgccgaccaggtcgtacttgtcccaagcgccgttgttgagggagtccacaagacccttcatggcgtacggggagctcggatccatgcggatcttgccatcatggtcgatggtcatgaagctccaggtcggatcgacctgcgggcgcaccacgtcgatggtcaggttgaacttctcgttcatcagcggccagtagttgacggaagcgccgccgagcgggtcgatgcccaggcgcacgccggaggaacggatcacatcgaagtcgatgacgttctccagatcggcgacatagtgctcgcggaagtcgaagcgctcgaccaggtcggacttgacggcctgctcgaacggaacgcgcttgatgttcttgaaatcgccgagcagctcgttggcacgatccgcgatggcgttggtgacgtcggacggagccgggccgccggtgaccgggtcatacttgaagccgccatcggtcggcgggttgtgcgacggggtcaccacgatgccgtcggccaggccttcgccggtgaagcgctgggtgccatccgctgcgcggttgtgggtcaggatggcctgggacacaaccggggtcggggtgaagtcgtcgcgggaatcgatgcgcacggtcacgccgttggcgacgagcacttcgatggcggtcttccaagccggctcggacagagcatgagtgtcgcggccgatgtacagcgggccggtcacgccggccttcttgcggtattcggcgatggcctgggtgatggcgacgatatgggcctcgttgaacgaggtcttcagagacgatccgcggtggccggaggtgccgaaggagacacgctgttccggaacgttggggtcggggacgacgtcatagtacttgccgatgacctcgtcgacattgatcagatctgctggggtagcgggcattcccgcattgtttgcaaccatagtcactattctgccacgcttttgcgtcagatgtgcgtaattgtcccattatgcgcgatgaatacgttgtctgtttagtgcatgttcggatgtgtgtacatgaattttcgaaaatggcggattctgcgcttagccgagttgcgcaatgtcaaacgatggtgtatagctctatgctattcgactgatgcagggttgctagtcaacataaagacgcaagacctgagatgtggctgaactatagccatatctcaggtctttttttgttgcccgaagcggtgttgctcggatcgaatcggttgtaagggaaagaaaggaaatcaggatggctgactcactcgcatcgcagatcatcactgcaatcggtggtcctgaaaacgttcgcagtctgacgcattgcgccactcgactgcgctttgaactggttgacgcatccaaggtcgatcagaatagtctcgagcacatgcagggcgtgctcggcgcggtgccgcagagcggcgaccgcttccaggtggtcatcggcggtggcgttgccaccgtgtacgaaaacatcatgcatctgcccgaaatggccggtgtcggcggtgcctccgcatccgacgatggtcagaagagcaatgccgacgtcaaggccgaagcccgttccaaggcccgcggcaaggtggcttggctggactccttcttcgagtatctctccgattccttccgcccgattctgggcgtgctgctcggcgcttccatcatcatcgcgctggtcaacctgcttatttcgctgaacgtcattccgaatgacgaggtttccgcaggctgggtattcgtgaaagccatctggaagggcgtattctacttcctgccgatcatggtcgcctacaacgcgtccaagaagctcaaagtcgacccatggctgggtggtgccatcatggccatgctcatgaccccgcagttcaccggcttgatggacgccaagaccaccacgtgcgtggagaacgccgctctgggcaccaagtcttgcatggccaacatattcggtctgccgatggcattgagcgactattccggcaacgtgttcgtgccgctgctcatggccgccgtgcttgctctcgtctaccacggattgaagaggatcatcccggaaagcgtccagctggtcttcgtgccgttcttctgcatgatcatcgttggcgcgctgaccgcctttatcatcggcccgatcggcgtgtgggtcggcaacggcctcggcgtcggcttggcctggatgaacacccatgccccgttcatcttcgccatcatcattccgatgctgtacccgttcctcgtgccgctcggtttgcactggccgctcaacgccctgatgctcatgaacatccagactctcggctacgacttcatccaaggcccgatgggcgtgtggaacttcgcctgcttcggcgctaccgctggcgtgctcttccttgctgtgcgtgacaaggataaggacatgcgccagaccgctttgggcgcacttgcggccggcctgctcggtggcgtttccgaaccgtctctgtacggcattcacctgcgttacaagctcatctacaagcgcatgctggtgggctgcggtctcggtggcgtcgtcatcgccatcctcggttggctcttcccgtccgtcaccgccgccggccagaccgtgcatggcgtgaccaccaccgctttcgcattcacctcgttgctgaccattccggtcttcaatcagatgtgggtgtatgcagtgtccatcgccgtgtccttcctcacctccttccttctgatcatcaccttcgactaccgcactccggaacagaaggccgaagtgctggcccgtgcggctgccaatcagaagaccgctgtctcgtcggtcgaagccaagggagtcgctccggctgctgccaccgcgactgccactgttgccgccaccaagactgaagccccggctgctgctgccaccaccaccgtggtgaacgctccagtcgcaggccatgtgatttccctggatgaaaccggcgatccggtgttcgcatcccgcgcactaggcgaaggcgtcggcatccagccggcagacagcaccgtcgtcgcgccggtatccggcgtgctgcagaccgtcgccgaaaccggtcacgcattcggcatcaaaaccgatgatggcgtggaagtgctcgtgcacgtcggcatcgacacggtgaagatgaacggcgaaggcttcgatgtgaaggtcaaggccaacgaacacgtgaacgcgggggacaacctcgttgtcgtcgactttgataaggttaaggaagctggatacagcaccaccacattgatgacggtgctgaacacagtggccttcgcgtccgtcacgccaaagaccggcgtcgacgtcaaggccggtgagtcggtgatcgacattcagcgctgaccaatcgcatagtcggaaggggccgacgtggacgttcttcgcgtattcaacaataatgtcgtactggcaaaagacggcaacagtgaggtgattctcaccggtcgaggtataggtttccaagccaagcccggccagcatgttgacgacgcgaagatcgtccgtcggttcgttcccgcagatggcaaggatcccgaccatatggcccaacaggtggccgggattccgcccgaaatcattcgtctcgttacggacgccatgaaccgcaccggtctgaaggaacaggccgacagacagcctgcattggtgctggcattatccgaccatatttgcggtgcgatccgccgatcgcaaaacaagcagaccatcgaatatccgctggaagccgaagtgcgttcgctctacgcgagcgaatatgccaaaggcaaagctctggtcgatgccatgaacacgtatctgggcggtgcgctgccggattgcgaagccgtggctttggccctgcacttggtcaatgcgggcttctctaccggcgatctttccgccacatacaccatgaccggcgtcatccagcaaatgctgacggtcatcgaaggctattacggcatcactctcgaccagaacagcgtcaatgtggcgcgtttcatcacgcatctgcgctatcttttcgtgcgcatccaccaacatgaacagcttgatgacgagcctgaaccaatcgtggaatccatcaaaacctcatatccgaaagcatcggattgtgcgaacaaacttgcgatcatcgtcaaaatgcgattgaacgtgagtctttcggaagcggaaatcgcctatctcaccttgcatgtcgcacgagtgacttctcatgcgacggaatcgcatgagaatgacgataccaatgcataatctgcataaaatacataatcatcgtaataaataatttaataattacgataatagttactgatttacattggaagtattggcttcgggcgcttccggcacacgcacgcacaacgacttacgctccacactgaaacgaatatgctgcgtttcgggaagcatatcgccatccacctgagccaacacgggtttctccaacttgatttccgcgctgacgccctgaatctggtcaaccgtggaattcgtggacagcggactctgctgggccttgccggtgatcgtctgatgcagcacatcgccgaacagattcgcccaaccgatcaaaccgccggatgtgtcaatgatctcgtaatcgagaatgccgtcatcgtacacggcgtcgggcatgagcgaaaataccggaatctggccgcaattgccggccatgaacgtgcggaaggtcaatccgtgcgtggtgtgcgtgctgccgtcggcgctggtaatggtcacatcacccttgtacttcggggcgaacaggttcttcacgcccgacacgaaataggcgagccagctgatgttcttcttcaactcaggatcggtgtcgtcgatcatcaccgcatcaaagccgatgcccgcgataataaggaacgcatggccgtgatcggcggcttcatcatcgagcagcgtcagtcggccgacatccaccaaacgcgaaccatgagatgtggcgacggtcagcgccgcatcgatatcatccacaggaatgcccatattgcgggcaaacagattgccggtgccaatagggatgatgcccagcgcgtggccggttcccgaaagtgcgctcgccaccgtgcgcaccgtgccgtcgccgccgaccgcgaccaccacgtcggcgccatgctccaaggcttccagcgcgcaggcgcgaccatccttatcaagctgcgttccgatatattcaacctgcgtgagatgcttcgcctcacagaactcctgaatatgctgcttgcgttgttccgcctgtggtttcgaaggattgatcacaaacgcgtaatgcacctgatcatcgtcgcgcttgtcgagctgttccgcaagtttgcgatgcttatacgcgcgtactgcgaaaaaggcggccgcgcacaccgctgcgaccgcaagaacgacaatcagaatgataacaggcataggcatgtcatctattgttcacggaagatgcgaaaaaagcgaatcaagactgatttattcgacgattcctgcacgttgtatacaaaaatgagaggactgcggcgggtgtcggctttcagcactaggctaggaggcatgcttgatatccaattcattcgtgaacatgctgacgttgttaaggaatcccagcgcaagcgtggcgaatcggtcgaactggtcgacgaggtgctgcgctccgacgaggttcgtcgttcctctctgaaggaattcgaggctgcccgtgcgcagcagaaggaaatcggcaagaaggtcgccgcggctccggccgacgaaaaggccaagctgattgccgaaaccaaggaactctcccagaaggtttccgaatacaaggccgcagcggacgccgcagccgaagaatacaccaccgccatgtggaagctctccaacgtggttgagccggaagctccggaaggtggcgaagacgattacgtggtggtcaagaaggttggacagatccgcgatttcgcagccgaaggtttcgagccgaaggatcacctgaccctcggtcgtggcgttgccggcatcgatatggaacgtggcgtgaaggtcggcggttcccgcttctacttcctgcgcggccaggtggcacgtatgcagatcgccatgctcaccatggctgtggaccaggccgaagagcacggcttcacgctggccatcaccccgacgctggtgcgtccggaagtgatgcgcggcactggcttcctcaactcccacgccgacgaaatctaccgtctgcgcgaacctgacgagcagtacttggtcggtacttccgaagtggcgctcgccggtatgcacgagaacgagattctcgacctgtctgacggtccgctgcgttactgcggttggagctcctgctaccgccgtgaggctggcgcagctggcaaggatacttccggcatcatccgcgtgcaccagttcgacaaggtggaaatgttcgtttacaccaagcaggaggactcctacaaggagcatgagcacctgctggccatggagcaggaaatgctcggcaaagtcgaggtgccgtaccgcatcatcgataccgctgccggcgatctgggctcttccgcagcccgcaagttcgactgcgaggcttgggtgccgacccagggtcgctaccgtgagctgacctccacttccaactgcaccgaatatcaggctcgccgtctgaacattcgcgaacgtatggaagatggtggcacccgcgccgtttccacgctgaacggtacgctggccaccacccgttggctggttgccattcttgagaaccatcagcagaaggacggctccatcgtcattccgcaggccatgcgtgcctacatgggtggcaaggaagtcatcgagccgaccaagtgggaagcctgatagagtttgggtttgcctggcagagtctgatagcttgggttgctcgtggagtttggtaactcgggtttgtttatcggttccactgagttgctgagctactaaactgctgaaacggacttctgcaatacgaaatatggaagtctgaggatgcctggcatttggcatttgccgatttctggcttttctggcttatgggaagggactcgcggtgagcgggtcccctcttttttgttttcgccgcgttctttcctttgtccttgctcgctttcttcccctcgttctttgggttgtgctatattagcgtttcgtgcgtgatgcacatgggtaggtgtctgagcggtctaaagagacggtcttgaaaaccgttgaggtgcaagcctccgcgagttcgaatctcgccttacccgcctatcaggcttactgagagcgctctaagcgcccggtaagccttttttgttgctgcaatccgggtaaactccacccaagttcggctcagcaccgtccaagtctcaattcttccatccactggaacaatcttcccgctgttggccctgtgagcgtccagattcttccagtgggtggaggatttgggtcgctgggatggtctgtggcggggtgattcttccagtgactgggggatttttcccgctggggggcttgtgggcgtctgtttttctccagtgggtggaggatttgggtcgttgagaggcttgtaaatgtccactttcttccagtgactggaaggattggggagggattgtgatgttgttcggtgtacgatcaggctgagttgtgagaaaggctgctgtgactatgcgtgagaatgggatgcaaatgaaggaacgagcgatgggagctatggctgggcttgcgttgggcgatgcgtggggaatgcctacgcaaagcatgtcggacaagcagattcgccggtattacgacggtccgatcacgaaacttatgagtgccgtgccgcagcagccgatcgcaccgaatatgaaagctggtgccgtcaccgacgatacagaacaggctttcgtactcgcacggcgacttatcgacgataacggctgcattgataacacccgatacgcccacgatctgctgcaatgggaagctgcgatgaaggccaagggatcgcttgacctgctgggaccttccaccaaagcagcgctgcaaaaacttaccgaaggcgtaagtctggaagagaccggccgattcggcaccaccaacggcggtgcaatgcgtgccacgccggtgggcatcgcattccgtccaggccaagcgctcgccgacgccgcctggcgatcctgtgtggtgacgcataacacggtgcagggcattgaagcgaccactttggtggctgcggcggtgagctttgccattgaaggagaacgtgactttttgcacctcgcggtggaattcgtacggaagcttccacagcgtggcaattggtcggcaaaggcttcggtgcttgcgcgtgtgcaatatttcatgaattgggccgaaactgatggatgcaggctcaatgacaacgaattcgctgctgtgctgcaacggaattgcggtaccagcgtggaatcgaacgagtccgtggccgccgctttcgccattgcggcgcgcttttttgacgatcccacgcatgctttgtgtttcgcggcttctatcggtggcgacactgacaccattgcggctattgcgggcgcgatgctgggggcgtggcatggtatgcaaggtttcgacaaaaccatgcttgatcaggtgctttcacaacttgctgaagataatcaccttgatttggtcggcactgttacgtcgctacgcgcgttacgcgatgatagtgcgcttaatgatgtaaatatcgtttgatctgcaggaaccgtagttagcgaaactatgacggaagtgcgaaaggcatcgcaatgactggaaaagttatttctcttgggcaggttattgtcgatctgaccatgaatgtggacgcggtgccgcgtgcgggtgaagatgtgttcgccggcaatgtgcaaacgcaggttggtgccagcttcaacacgctgtatgccgtgcgccgcatgggcgttaaggcgtctcatgctggtgtgattggtacggggccgtgggcttcgcagattctgcaaacgttggaaaatcaggaaattcagcatatcggcaagcgggatgccgtgcacgattcgggattttgcgtggcgttgaccgacgcgaatgctgaacggacgttcatttcgacgaggggcgcagaagcgtacggcagtgccgatgcgttcgattctgtgaatccagaaaagcgggatgtcgtgcatgtgagcggatacacgttggtgcatcacactgcggacgcgctgcttgcttttgtgaaaagaacgactgaacatcgtgagttcactgcggtattcgatccttctccgatgatctcggcagttgatgatgacgttttccgtgtgatgctcgcatatcgtccgatatggtcgtgcaatgaacgcgaggcaacgttgattgcgcaacgtttggcggcgctcgatagtggcgattcttgcgattgcaaggtttcgcgggatatgctgcaagagattgagagcgcgaatgtcaatgaggagacggttgcgtggctgtgcgatcgattgcaatctcctgtaatcgttcgcgtgggcgcggatggtgcgtggtcggcgattcccggtgacgaagtgctgcgaattccaggttttccaatgaaagcggtggataccaatggcgctggtgattgtcacgcgggtgtgttgtgcgccctgctgtgcgaaggcgtgccgttggaggaggctgtacgttgcgccaatgctgcttcggcgttgtctgtaacgcgatcagggccggctacctgccctgatcgaaaggaggttgagcggctcctaggaagggcgttctaagacttatggtacaaatgactataagtggttatatcatgtgcacgattgcgctgacgcggcgtgcatgtcgcttgcccgcggcgttgctcggcagattcaaggagattagtttcacatgagcaatgagaaagggaccctctccatcgaggagcagggtatcgacaccatatccgaagaggagcgtaagggcacgccggccagtctgttttggccctggttcgctgccaatgtttccatgttcgccatgtcgtacggcgcgtgggcgctcggtttcggcatttcgttctggcaggccaccgccatgaccattattggcgtggtcatctcgttcctgctggtcggcatcatttccatcgcgggcaaacgcggcaacgcgcccaccatggtgctcacccgcgccacgttcggcgtggaaggtgccaaagtgccagcggctctgagctggatcgccacattaggctgggagatttcactgaccaccaccgctgtgttggcattatcaagcaccatcgaaaaactcggttggggctctggtgtcgcgcccaagatcatctccaccattgtggtggtcggccttgtggtggtcgcaggtattttcggatacgacctgattatgcgttgtcagcaggtcatcaccatcgtgaccggtgtgatcaccgtcggtttctttatcctcggctggggacatattgacttttccgccattgactcggttccggcgggatcattgccggccatgctcggctgctgcttcttcgtgatgaccggctttggcttgggctgggtgaatatcgctgccgattactcgcgctatctgccgcgcaactcctccaatggcggcattgtgttctggaccacattcggtgcgtccattgccaatgtgttcctgattttctacggtctgctgctcgcggtttccaatgccgacatggcggaaaacgttggaaatgatccgattggagccatggcttccattctgccgacctggtacttgattccgtacaccattgtggccgtgctcggtttgatgtccggctccattatggacaattattccaacgggcttgcgctgctgtcgttcggtgtgaagttgccgcgtaccgtggctgccgcgctcaccgccgctttgactgtgcttggtgtggtctacgtgactttcttctccgacacgttcattggcccgttccaaggctttctgaccacgctcggcgtgccgatggccgtatgggccggcatgttcgtggccgatgtgatcattcgcaagaaggattacagcaccgctgatttgtatgatccgaaggggcgttacggtgcgtggaacggtaagtctttcgccattcttgtcgtcggtaccgtgcttggttggggattggtggtcaacactgccgccagctggctgaactggcaggggtatctgctgttccttatcggtggcaaagaaggtagttgggctgccgccaatcttggtgtgattgttgcgctgattattggtcttgcgggatcgttgatgttccagcgtggcgatattgccaagcaggaagctgatctgccggtttcggaagcatgagttgcttattgcgataatacaaggaaaggaaaagtcatgattgcggaagatgaatggctggtagttatcgacaggcagcgtgtttttgcggaaagtgaatggtccgcatgggcttgcccggacggctcctatcacactactgatgaagcgttcgcacgattggctaaggcgttcggcgatcgtgtggtctatacgcgatatgttgcgcctgagccaccgcaaaacgcttgggttgattatttcaaagattggccgcagtttttggttgctcccgacgatccgatgtacgatctcaccgcggataccgcggaattggcgcaaggccatgccgtggtcagttgcgacactttcggcaagtggggaagcgtgctgagcgaagccattaaaggcgctaaaaagatcacggtatgtggtgtcgccaccgattgctgtgtgcttaccactgtgctcgccgcggctgacaatggtgtagcggtacgcgttgctgctgacgcttgtgcaggcagttcgccagaaaaccatcagatggcattgagcaccatggcattgttcacgccgctggtcaccgtcactgatactgattccatcgtaggataggtaaggactttgattctgcggggtttgttgagttctgctcagcaaaccccgcttttttgtatgtcgtgcatattgcgccaaaacttggatgatgctcggctggcatcggtaatgagccattaatcttgcggtgcgcttttgtaactgcggcgtaacagtgcggtggtgattgtaacggacgattccggcacaatcgtgggtatcgacagtttcgtgaagaggttttactgacggacatgtctctcacaggaaaaatcccatgtatgaatcgaggccaccatggcacagcagatcactcgcttgcttgacgatcctacgcaagcggtcagtctagacactttcagtgggctcaccaaaggatgtcccgcaccattctggcttttccaaggcgtttgcgcggcttggggcatcgaccaccagcgggcgcaactcaacctcatcaccgtatccgagaacgcgacgttcctgctgttgctggacggcgagccccaaggcgtggtacgtgtctcgcagccgggctatgtgggaggtcccgaggcggtggcgtcggaaatcagctggttgaatgcgttgcatgatatcgaaggtatcagcctgatcaatccggttcccaccatccgtggcacgttcgtaacgaaaatcactgatctgaacggtgtcggctggacggtgatctccacgaaatatgtggaaggaaccgtgctggaagatcttgagaatcctgcaccgtattacgagacgatcggtgaatgggctgcgaaattccatgagcagtcgcgcacgtggagcaaaccgtacggtttcacccgcttcaattgggatctttcgaacatggttggtccggcaccgcgttggggacgttgggaaaacgccaatctcaccgacgaagagaagcagctgtgcgacaccgcgctgtggaaggccatggacgtggtgatgaaagtgccgagaaccaacgaaacttgggggcttatccatgccgacttgcgcccgtcgaacgtgattcgcggcaatgacgggagactgaccgtcatcgatttcgacgatgccggatacagctggtatctctacgattacgcttcatcgctgagtttcatcgaacatgaaccgtatgctcccgatcttgccaaggcgtgggtcaagggataccagcgcgtcgcaggttcgttcacggatgaggaactgcgtatcatgtccgcgctttccatgatccgacgcatgcagatgctcggctggaccaccagccaccgtgaggatgccctgcccgacggtctcgctgcacagcaggctcccggcagcgtgatgtgcgcaaaaaactatcttgaggatccgctctggctgctgcattaggcaagttgcatgaaacaagcgtaattacgcagaaaccagaaaatccaagaaatccaatcgtaagcacgtaaaaatacgcaattacgaaaatctcaatttttataacttaacaacatctgaccgcaaccaaccaaacgaggaatcaatggcataactcgccgaacaataagagaggaaggcgattacaatgactgcgtcaactgtttcgggacgatcgataggcggcgtgacctacgttgaaaccgacaaggactatttcgcaaaacgacagcttaagcgaaccgcgggagcgttcggtctatgggccatcggcatttccgcggtgatctccggcgacttctccggctggaacggaggcatcgcccaagccggatggggtggcatgctggtggccgccatcgtggtgtacctcatgtacgtgcttatgctcaactccatcagcgaaatggcgtcggccatgccgcacacgggtggcgcgtattccttcgcgcgtgccgccatgggtccgtggggcggcttcttcaccggccttgcggaaaccatcgagtatgtgatgaccgcagccaccatcgtctacttctcgtcggcatacgctgatgcgatcctgtcgaacctgaccggatattcgcttgacgatcatggcttggcttgggtttggtggcttgccttgtatgcgattttcgtagtggtcaattggctgggcgccgaaacgtcgttccgtttcgccgaagtcgtgtcgatcgccgcgctcgccatcgtcgcactgttcggtatcggcgctttcgccactggtaaggccgatttctccacgctgctcaatatcacgcctaccgaaggcaactccgcgttcctgccgttcggcccaggtgccatcttctacgccatgccgttcgccatgtggttgttccttggtattgagcagctgcctctggctgcagaggaagtgcgtgagccggaaaagaacattccgaagtcgtcccgcctgtgcattttcacgctgggattgtccgcgctgatcatcgtgttcctgaacccggctgtggtcggttccgaagcgctcgctggttccgatgagccgttgctggatggctatcgtgcgattctgccgggcaatctcgccgcggtgctgtccgcattcgcgttgatcggtctgctcgcttccatccaaggcattatgttcgcgtatggccgcaacctgtattcactgtcccgtgcaggctattatccggcgttcctgtcgctgaccggtaagaagaagacgccgtactggggtctggtcgtcggcgcgatcatcggtttcgcagccctgttcatcatcgcgtacggcggtgatggcgccggttcggtggtgttgaacatcgctgtgtggggtgcggtgctggcatatctgctgcagatggtttcctatgtgatcctcaggaagaagatgcctgatatcaagcgtccgttcaccagcccgttcggcgtgccgggcgcggtaatcgcaggtttgcttgcattctgcattttcgttgccgtgctgctgaacccggattatcgactggccgtctacgccatggtggtcatctacgttctcgcgaccatcttcttcgcggtttacggacgtaagcacctggtgctttctccggaagaagagttcgccgcttccggcggaaaggtcgcatataagactgaagactgactgattttctgcgattatcgtttcgttttcttgaaataaaacgatattgccaaggccgtgttcatctgggatgcggcctttttcaatcatcggaaatatgtaaaaaggtcaaccaaataggtggaaaacagcggaaatggtttgtttctgcgctgtatcagccactcaacattactgcgttaccgtgtgggtaacgccacaggaagccaacgaaagaaggaatcatggcaactcgatcaaccatcatggacaccaatagcttccgtccggaaatggcggccgcgctcgacccagaaacacgcaaactaaccgaagagcgtgacgtgcttggtccggcctaccgtttgttctaccgcaatccagtgcatctggtgaagggccgtggctcgcatctttgggatgccggcggcgaggaatacttggacgtgtacaacaatgtcgcatccgtcggccactgtcacccgcgcgtggtggatgcacttacccagcaggcttcgatgctcaacacccacacgcgctacctgcatgagaacatcctgcattatgcggaagatatcctctccaccatgcctgacgaacttgaccgcatcatgttccagtgcactggttccgaagccaacgatctggccattcgcgtagcacagacctacactggcggcgaaggcgtgatcgtgaccagcgaggcctaccatggcaattcggcactcacctccaagctttccccagcgctcggcaccgcgcaaacgcttggcttgaccatgcgcatgattcccacgccggacacttaccgcttggtcattgacggcaagcctgccgcggaatgcgccgccgaggaattcggcaactggatggctggcgaagtgcgcaaggccgttgctgatatggaacgtcatggcatcaagtttgcggcattgcttgccgactccatcttctcctccgacggcgtgtaccccgatccggtcggctatctgaagccggtgatcgacaccgttcatgaactgggtggcgtatggatcgccgacgaagtgcagccgggcttcactcgcaccggcgacgcattctggggattcggacgccaaggcattgttcccgatctggtcacatccggcaagcccatggccaacggtctgcccacgtcgatgatggccgcccgtcacgaagtacttgaaccgttcgcaggctccattccttacttcaacactttcggcggcaacccggtatgcatggccgcggcccaggcggtgcttgacgtgatgcgtgacgaagacaccatgagcaacgccaagaaggtcggcgcaatattcaaggatgccgtcgcgtcgcttatgccggcacacccctgcatcggcgacgtgcgtggcgcgggcctgtacatcggctgcgaaatcgtcaagccgggcaccaaggatcccgaccagcaggcagcgctcgatatcctcgaaaccctgcgtgacaaccacatcctcacctccgtatgcggccgttacggcaatatcctcaagctgcgcccgccgctggtgttcagcgaatccgatgtggattggttcatggatggattcatgaagactctggaaacattgaagctgtaaaacgacagataaccataaagaaagggcgcggatatggaagatcataccggcatcgggcgcacgcgaagcgctacgagcgaactggtctaccgtatccgcgctcgcattcgtgaacaggagcttcttcccggagagaaactcggatcggaacgggcgctcgccgacagtcttggcgtcagccgttccgatttgcgcaatgcgttgaccgtgttggaatccgatcatgaaatcatccgcaaaatcggtcgtgccgggggcatcgtcatatcggacggacgtttggaacgcaatatcaacacggtggaatcattgccgacgatcgcgcgaagacaaggcatgcgcgtttcgtcgaaagtattgcaggcggtgattgccccggcttccgtttccgacgtgcgtttgctgcgattgccgggcgagcatccgatgatctacgacattacgcgattgcggtatatcgaaaatcggccgctttcgttggaacggtcgcatttgccggcatatctgtttcctctgttccttacacgcgatttgacgaccccgttctacaccatgttcgaacgtgattatggcgtgtatccgtgcaatgtcgacgaaacattggaatcggtggtcggcgacgagcaggagaacgagctgctgcagatcaaggcgggaactccgctgatgcgcattcaccggatcgcctatgcgtcggatggatgcccgttcgagcgtgccactgacgtgtatatcgctgatcgcatgcgattcaccatgcatcattccggctatgtacgcctgtccgcaacgtctacgcagaatatgacgaaataagccggaagattcttcggttatacgatgcggcggtcggcggcccagcgggtgagttcggtgcggtttgacagctgcagtttgcgtagtacggagctgacgtgcgtttccacggttttgatggaaataaacagttccgcagccacttccttgtacgtgtagccgcgcgcgatcaagcgcatgacttcctgctcacggttcgacaagcggtccagctcgtcatcgtggatcggtccgcttgcagagccgcccatgccagccggtgagccattttggaaagcggacagcacgaatcccgccaatttcggcgaaaacacggcatagccctcatgcacttgcttgatggaagaaatcaaatcatcgccggaaatcgtctttgtcacatagccttgcgctccggcacgaatcaccgaaccgacatcctgcggcgaatcagacaccgacagcgccagaaacacggtattaggggagtatgcgcgcgatttcacgagaatctcggcaccgccgccaccctcgccgccgggaacatgcacatcaagcagcaccacatccggcttcgtctgcgcgatcatcgccaccgacccctcgacatcggccgcttgcccgacgatgtcgaaatgcggctgcagcgttgcgataacgcccgcacggaacatttcatgatcgtcaacgatggcgatgcggatctgctgttcctgctcgttcattgctgctcctcgaaatggttggtaggttgattgctgaattgattggtacgttgattgttggattgacggttatggtgattgggaaaatcggtttgttgtgagttgctttgcggctcgtgcgattgctgcgcattcgtgtcggcggctgcggatgcgggcatgtctgcgattggcatatgcatgcgtacctccgtgccccattgcggtctcgatacaatctccactgtaccgccacgacgcttgattcgtccgataatcgattcacgaatgccaaggcgattcgcggggatggcattcacgtcaaatccgttgccatggtcgcgcacgaacacttccaccagtttgctgcttgcctcgcagtagacggaaatcggctctcctccatgcgctaccgcattgataagcgcctgttgcgtggcgtcaagcaacgcatcggtttgcgcgcttggacgtgcgtcgcccaccgtcaccacttcgatcggcttgccatgcgtgtcttccacatgtgcggcgatttctttcaagccggcgttcacggaacggtcagacgtggtgcgttcctgatacagccattcacgcaattcgcgttcctgcgaacgcgccagcgaaaacaccgtctgctgatcgtcggcatgcaactgaatcagcgccaacgtttgcagtacgccatcatgcagatgcgcggtcatgtcggcacgttcctcttcgcgttccttcgatgcgcgttccgtacccaaatcgcgaatcagcgccatgatccatggcacaatcgcaagcaatgcgccaatcagcagtgccaaaccggcgcacagtatgcgaatcatggaaaacgcgtcaaaatgcatgcaggaactgacgtacaaagcgtatgcggcgaaaataatcgcaatgccgccaagcatcgtccataattgaccttcttcggcgttgaaacgcaaccaagagacgccgataccgaccagaccaagcagcaggggcacaatcagagtgcgttcaacaccgcctgcgaacatgacgaaacagatggaaagcagcatcagaccagctaatgcaagcaaagcgggttttggtgctttcttcagtgtctgttcaaggttttcgctggaagattgcgtattaccatgcgtttcgtcgttgcgttcagtcgtatcttcaaaagatggtggttgcgtgtgctgaccatcttgcgtagctgtaaaagattgatattccagggaaacgggatatgtcccgtacggcatgttgccccgggaaagcggtgcctgccatggcgaacgcttgccggcaataatgtacgtctgctgtatggggtctcctacgggaagtgccatccacaggaaaatgtaagcgatgagccctgaaccgaacagacatgtggtggcgaggaaaaacaggcgcacccatagcacggcaatgcccaaatgcatgctgatcgccttgcatacgccggctcccatgcgtccgtatggaggacgcatcaacggcagtttggccggctgtgtcggcatcggacgtccctcatgcagggcttggtcgcagcagtagcgcatatatacggcgctcgcctggtcgtactggctttgcgtgtaccacggttttcctaaggatttcatacttccattgtgccctgtgaaggacgctgtttcagggcattcatatagtgttcagggcagattcagggtgttccccgatacgtgtggcacgcgcgagttgctgtaatggaaccatgagcaatgcaaacaatgatccgctgggcgatcgcggcaacgcagggccgcagcccgctgctggacaaccgtattatcagcagcctgcgtacggttcgccgcaaccttcccgcggtggccgtttcttcgcgtggattcgttccagccaggtcaagcgtggacatgaccgttggattggcggcgtgtgcgatggcatagcacgtcgtcttggatggaataccacgttggttcgtgcgcttgtggtggttgccacgctgtttttcggcgcgggtgccgcgttctatggtctggcgtggtttgtgctgccggatgagcgtgacaatcagattcttgctgaggatttgattaacggcaagtgggattggaattgcattggcgcgttgctgttctgcattgtggccatctgtttgccgggtgcgggatggcttgctttcgcgttggccgcgttggtgctgtggcttctgctcaataggcagatttatgcgccgaatgttcgttcaaatcagtgtcagcagcctccgtatggtcagcccccatatggtcaggctccgtacggtcaggctccgtacggtcaaccgcaatatggtcagcctcaatatggaagtccttcgtacagacagccggtgcatcctgcatcgccgtctccagcgcaatcgaatccttatactcagccgatgcaggcgagcggcgcatataacggggcggccaacacggcttcgtcaccggaatcgcaatcgcctcagccccaacgccctcagcctcaacagcctccgtatcatgcctaccaacagcaggccaacggtccggccgcttttgccacggccaatgttcctccaacattcaccgctccggtagccccggtagcgcagacgcctacgtcgccaagaaggggacgtcgtaaaccggctggtccgctgttggtgttggtgatgttcggtctcacgatgattgcatgcgcgctatgcgtatggtgcattatgacgtacggcgtccaaggcgggcagcggggcatcgaatacacgttacaggcatccgcggcatgcgtcggtggcatctgcctagtgacgggaatcgttattgtcgcgctcggattcgtgggcagaagaacgggaggattgcatcctctgacatggatatccgtattcatgtcgttggtcatggtgatggctttggcgggttattcgctgttcagccatcggattgacacgggcattccctcatcctacaagacggtcaatgtgtcgggaataaccaccatgggctccaccgccagtgaaatgagcaaatacgagcagggcatcgtcgcgcaaggcaatgattacgccaccgacgtgctgcatatcgacttaagcgattacgcgaaaaacaacggtccgcacaaagtggatcttcaggatggcacacagggcacaacttcctgccctaccggaacgttgaatgtggtggcctcaagcgcgcaggtcgtggtgactttgccgaacggttgctggtggacgttcgggtctgacagcaatttctataccatcaccgatttcgtcggcagtccggacgggctcacgttggattccggcggggtcgagttctcgattctgagcaacgattccacgaaatcggtagtgaaaaagcgtgcgctgggaacttacgattggagttgcggctcgtacggagacgaatccggcatcgaggatttcgatgatgaggccgatacggaagatggcacggataccggcaccgattccactaggaccgattcccctttcaaggacggggatgtagacaaggcctaccgcgaaatctacgacaatcatcaatattggccgtgcttcaccggtgatgacaaggctccggtcatgccagccggactgcagatcaatgacgtggcaacggtcggcggcagcgtcgcggtgcagtatgcgtccgacaacacattgggcaaagcgggaaaggagtgaccatgagtgacgacaaaacccaggaaatgccggttatgacggatgccggagatatgcctaccgaaacgttgcataccgtggatgcgcagtccacgtatgaccagtcgcagcacagtgggcgtgcaacgcaggatgataagccgcgcgtggaatccgttccagcgcaaagcgttccgacttataccgcttcggcagccggtgcgaatggcgggcataagaatcggcagattggagacgacatcatcagaccttccggaagaagcggttcgaccatcgcgctcggcgtgttcacgtgcttcatgggggtggtgacgttgctttgcggcatgcatgtgccaatgaatctctggtggtgggccagcgatccgaaacagtccttcgtgttcctgcttggaggcatcggcgtgctgcttatcgccgtcgccgtgatttgggcgatagtcagcgcggtgcgttcaaaccgatccaagaatgaaaacgatgtggacagcgacgatccattcgacgctccccatagctcggataccacggccttttcgactgattcggataagtctccgctttcggaacgatcgtgagaatcagctgaataactcctgatgtcagccgcaccaacgaaatcaaggctgacatcgcaaacaaatgtgtggccaccatggcatgaccaaatccaacacttgcttttccatcttgacgttggattttggtcgtaccatggtggccatttttatggtgatgtacggggcttactgcagttttcggtaattttcacggtgtgttttcactgtgttttactgtgcggcctcagcctgtgccaagtcctcaaatccagccaaacgaaccgtattgcgaatcgtctcttcggtgagattgcgctgttcatgccgcaaacgctccacaaaatcgcggtacaatgccacagtgcggtcggaataggttcccaattcgccgcgcagatacgtttcgaacgacgtggtctctggcgtatcttcgacagtggtcagcacgcgcatcgcctcgccaagatggggaaaacgctcacgaaaatcacgcgcccacgccacctgaactgctatgatgccttcctgcaaggcgttgcgacccgcggaaatccggggaatatacggcgcaatgtttgcacaatactcctgtggatatgtggattgcatcatgcggccatacttttccgtcaccaaattacgtccaacacggtcggcttcctgcaagtccgaccggtagctgcgcagcaattcctccggccacgtcatgaactgactggcacgcatctgatgaaacatcggccaattgccttggcaggacgcgcggccgccctcattattggtttgctgaaactgattccactccagtttgataatgggttcaacaagatttgctgtatcgtgaccgtctattacatctgaaattacgttgccattcatatgatttcgattcttgagttcgtcttattgctgatctagatgtgcgatgcctgcaatgaagttattgcaatcacaagctgtgcagacaacttgcatcggacttgatatggtcctcaacatacggacgttgccattccacaaaagtttcgtgagattcggtcaatccctcccgcagcaattcatccacaacatcactgcagatgcgctcaacggtggcgataatatgctctgccgcaggcttcgcacccttgccgccctcaccgaaaccggcaccgccgaaacatgcggcggaactcaatcgcaatatgtcttccaactgttcgcacacgcaggcaagccttgttgccatacggtggcttagcttacgcatggcagcaaactgccatttgtaatatggtagatacccaacgctcaccggctcattgatcagaaacaccaacgaagccgtggcgttcacgaactcatgaatgcttaacatcgcagcagcgccatcgccacgttgcagcatgcgcggcagattgtattgccccgcctgagccatcatgcccaaacggcgagaaatcaaggaaagtcgaacatcttccggcatgaacttaaacccctgccgagtcttggaaaacacccccagcggatcggcgaacacctgaccgtttgtggcagtggcaagtgtcgcatcgtccaaactcagccaagacgcatagtcgttttgcaccggagcctcacgaaacagtgtgatccgctcgaagaaatcaccgatacgaaacacgccatcgcggcggaactcgccttgtgcacgcggcgtaagtggcgattgagatgcggcaagagcgttggaatcagccgaaccttgccctgcaaaatgcggcttgccttgctcatcaacagtgaaatcgcgactcaacgcatcgtaatcagcctgcaattgctcgccaatcgcatcataatcctcatcggtaagccacaggcagaaacgcggtgcaaaatcatgatcgcgagaaaactcatcgtcgaaaccgaaacattccgaaccataaccgaccaaacctgcggcaatccgcccctgatatgccgaatatgcgccggcaagcaacggtttgccgagatcattccagaatgcgcgagacaaagcaagtcctgaaatatggtgagaaatcgcaggaatcgaagatgcgccggattctgccatatagtgcggttcacttgattgctgagattcgcttgatttcggtgaatgctgagatttcaaggattcttgcgattcttgatattcttgcgattcctgcgttttatgagatgatggcatgcgcttatgcaacgcctgttttgccgcttcaagattggctgcagtcgtgtgatagtagtcggtgttgcgtccgtagcattcttcaatcacactcaacgcatgctcataaccggaaactgcatcctgcaggcggccggccatatagcaggcctgcgcatagccggccagcgccgaagcataatgcgcactatgttccaaatgcccggtacggtagattgtcaacgctttctgagcgtgctgtatggcgtcgctcgcccaataccggcccatctgcaggagcagcaacgcaagattggtgtgcgtggaggcgacgtctatgtcagcgctcgcatcgggggaagattgctccaacaggtccagcgcctgttccagctcgcgcttcgcctgattgagacgaccggtttcgctgtacaacatggacatattgttgtgcagcgcggccaggcgtcggtcggtgggggagaagacggacgtggccgcgtcaagcgcctgacggtacagctgttcggcctcctcgtaccggcctgcggctcgcatgcccgtggccacgttgattagcgtcgtagcccacgcctgcgggtcgatttcctgaagatgcaaatgatccgcaatgcttaacgattcgcggataatcggcagattgtcggtatgtcgaccttgcgaacggtaaaaccctatcgtttcgttcaagaccgtcagcaaaccggcgtcattatgactgtgttcggcttcggtccgcgccttctgcagatacggttcagcctgttcaggagccttatgcgcatcgaaaatcgcatcaagaccacgcaaaaatcgctgtacatcaaacgttgcgcatccgtcatcgcaattattcatattcagattgacatcactgtctgccatcgcaatcccttcatcggtgacttccatcatctcccgaaccgcagacggcatcgcagacggcgaaacaacgaaagatggggaacatgcgatacgtcgtacaaagaacaacgggatatctcatcacaataattgtgatgagatatcccgttacataacagaaataatcgaaataactgactgtcgaatgtcagacatgcacttcgcgcatacgctccgtagcacccgtatgcgtttcgtaacgacgcgaataggtgaccagcataatcaccgcgatcaaagcgatcggagcaccggccaaaccggtgtaatggtagttcatggtgtttgccgtcaatgcggcaccaccaacgatcgaaccaaccgcattgccaaaattgaacgcgatctgcacggccgcgcccgcaatcagctcgccgccgccctcaccggcctgcaccatcagcagctgctgtggagacgagttgaagaacagtgcgaaaccaatcaggaatgtcagcagagcggtggtcacatgattgccaggaacaaagaacaccaacagcaaaccaaccgtggcgatggcctgcgaaagcccggcggtggcaccaggcttccacaaatcagtcaaacggccgcccgcaataccaccgatcaccatgccgaaaccggcaagcaccattaacaggggaaccagcgaagaatcccatccaccgaccttctgcagccacggcgaaacgtagctccaccagcagaaaataccggaattaccgcagaacaccgccatgagaataaaccacggaccggcgtgagtgaggaaacggaactgccccttaatgccagcgtccttgatcggcgcgacgaacggcacccacgcaatcaccaacatcatcgtcatcaacgcccaagcggcaagaatcgcaaacgccaaacgccacgacagcatttccgaaagcaatgtgcccgcaggcacacccaacatattggccaccgtctgacccgtcaccatcattgacacggactgcgcttccttgcccttatcggccaacgtcttggcaatcagcgtggccgtaccgaaaaacgcgccatgcggcaagcccgagatgaaacgagcagccaacaacatgggggaattgaacgaaaccgcgctcaacgtgttgccgaccagtgcgatgatcatgaacagaataatgagattcttcggcggtaccttacggccgaacaccagaatcagcgtgcccacgcacacgcctatcgcatatgcggaaatataatggcctgccgcaggaatgctgacctgcatggcggcggctgtctgaggcaaaatgcccatcatcacgaattcggcggcaccaagaataaaggcgccggaagccaaagccagaatgcttcttttcacagtctctcctccatgaatgtgaagcgtgttggtgtgcgcgcttgtttacgcgcttgtgtattacgtgttttttgatttttcaggtggttgcgtctcgcatatgctgttttgcaccgctgatgcgctggaaataaaaaaggcggaaccgaagttccgccttgagttgtcgggctggcgggatttgaacccgcggcctcttcgtcccgaacgaagcgcgctaccaagctgcgctacagcccgtttggcaacagttggaaatattacacgattgcttaggtaatgcaaatacggcgtgtcgcgtgtggtgtagtggcttctcggtacactgtgggcttatgagtgagaccatcgaatcgcaagaaaatcagaatgaagaggctgccgttcccgctatgactacggtggagcgcgccgaaatgctgctgcagcaggatgcggctatctacgccaagatcaatgacggcgccaccctggatgaggccgtcgatccgggcaataaggaattcggcccgctggcgcatccggaacaggtgcagatgcgtgtggccaagcgtgccatgatgcttaaggacggcattcagccgtacccggtgaccttggacgtcaccgccaccattgaagaggttcgcgccaagtatgacggcaagcttgaagcaggagatgaaaccgaagacgtggtcggcatcgccggtcgcgtgctcttcctgcgtaacgccggtggcttgtgcttcgtgcagctttccgctggcgacggcaccaagatccagggcatgatttccaagaaggagattggcgccgattccttgaagcagttcaagcagctggttgacttgggtgatcacctgttcatcaagggtcgtgtgattgcctccaagaccggcgaactgtccgtgttcgccaccgaatgggccattgcagccaaggcgcttcagccgctgccggccctgcacaaggacctgaacgaggatacccgcacccgcaagccgtacatcggcatgatcgccgacgagaagatgcgcaacatggtgcgtaaccgctccaaggccgttgcttccctgcgcaagaccttcgccgatcatgacttcctcgaggtcgagactccgatgttgcagaccgtgcacggcggtgctgcggcccgtccgttcaccacgcacatgaacgcgttcgaccttgacctgtatctgcgtatcgcgccggaactgttcctcaagcgttgcctggtcggcggcatcgaccgcgtgttcgagatcaaccgtgacttccgtaacgaaggcgttgacgccacccatgctccggaatttaccatggttgaggcctatcaggcttacggcaactacgacaccatcggcgcgctcgtcaagcagctcgtgcaagacactgccatggacgtgttcggcacccacaaggtgaccctgctggacggttccgaatacgatttcggcggcgaatggaagaccatcagcatgtatgattccctttccgaagcgctcggcgaggaaatcgtgccgaatggcggcccggacaatccgggtacttccgtggaacatctcggtgccattgccgacaagctcggtgtggaacgcgacgatgtggagaaccacggcaagctcgtcgaacacctgtgggagcacttctacgaagacaagctgttcgagccgaccttcgtgcgtgacttcccggtcgaaacctccccgctggtcaagggccaccgttccaagcccggtgtggtcgagaagtgggatctgtatgtgcgcggcttcgagctggccaccggctactccgaattgaacgatccggttgtgcagcgtgaacgtttcgtggctcaggccaaggatgcgctcgcgggcgacgaagaagcctgcgatattgatgaggacttccttgaggctctcggcgtgggcatgcctccggcaggcggcatgggcatgggtatcgaccgactgctgatcgccctgaccggcgccaccatccgcgaaaccatcaccttcccgctagtgaagccgctgaattaaggcaaagccttaattcaatatcggcttcacgcgaggcggaaaagctgacggcccagtgggccgtcagcccgccggagccatccttataaaaattgccgctgaattaaggcaaagccttaattcaatatcggcttcacttgaggctgcttgggtacaaccaggcagccccgcgtcttttaatccccaattctgttttattccctaatttctggcgctggtcctgtgctttcgcgcacgacaagcgttggtggaaacaatagcgtgcgctgcgcgtcttcggactgatgtttggatagtaatgtggcaagtgttgctcgggtcatttccgccagtggctgccgcatggtggtcaatggcggtccgagatgccgtgcgctgttgatgtcgtcgaatccggtgacggacagatcttcgggaatcgacagtcccaactgatgtgccgcgtcatatatgccgaatgcctgcgtatcgctacaggcaaatactgcagttggacgattcttttgctgcagtagatcaagcgcgtgcaagcgtgcattttccgaccagtagtcgccttcgcgcacttgagtgtcattgagaacgatgtcatgctgtgctagtgccgcacgaaatccagccaatctggcggggtagcaggtggtggacattgggccggtaattgccgcgaattggcggtgtcctaagttaataagatggctgccgatttcgaatccgcctgtccaattgtcgatgcgcacgtccatgcaatctttgcatggtgttccggatgggtcgactaccgcatatcgagctccaagttcttggcaaagcgttcgatctcgcattggcacgtaggcgttgtcgaaaatcactgctttgggtctggctcggcggattgcttgccggtaggtgtcgttgaggatgccatcggaggcgtttttcgcgcagatggtcacggtcatgcttcgtttgacggcggtgtcggtggctccttgcatgatgtcgagcacccatgggttgtccatggattcgagcaccaacatgatggttgtggacagcgcgtgtttgactggcggtttgctgtattccatgtctttgagcagcgcttcaatgcgttgccgtgtttcgtcggagactccggaacgtccattgatgactttggagacggtggatggcgtggtgttcgcaagtttggcgatgtgcgacagcttcggtcgttgactggcggtacgcatattggtttgcgatgaagacagtgtcatgatagcagtatagtagagaaatttcttctaatgattgctatgcagtgtaatcattgtgttggagtgcatgataattgctgtttatctgctgtatattgacatttgcaagaaagaaatttccttatcatctcaagaatttgcatttcattttctctactctgacatcagacggcgaaaatgcaatatacgcaatgagcgcaggtgcgaatcggccgtcagggataagaagcattgtcatcgcgttgctgcgaatggcatgatggctcgtattgcacgggctgttcgggattctcgacaaaggagttgttgtggacaacgcgaacgttaagctctcccttaaggagaagctcagctatggagcgtcggattgcgcgtacaatctggtgttcaacgtggtcaccacgtacatgatgttctattacaccgacgtggccggcattagcctgctgtctgtcggtacgctgttcctggtggtgcgtgtgcttgacgcgattgcaggtccggtggtgggtgcgcttattgataaaacgcataccaagtggggcaaggtgcgtccatggttcctatggttcggtgcgccatttgccatcataggtgtcatggcgttttcggtgccgaacttcggcggcgtaatcaagatgatttatgtgtacgtaacgtacatcatgatgaatttcctcgccgtcacggtgaccacgccgtgcaccgcgctgctgccgaacctcaccaccaacgcccaggaacgtgtcaatgcaaatgctttccgtaatgtcggcggtcagatcggcgtgattgcctctggtatgcttactctgccgttggtcaacctgatcggtggtggcaatcagcagttgggctttaccgtcaccatgatcatctatggcgtgatctgcgtgggtctgttgctgctgacttttgccaatacgcgtgaacgtgtgtttacccctaaggagaaggagccgccgttcatcaagagtttcgtggccatgctgcacaatgggccatggtggattcttgtcaccctcaaccttgtcatgttcattggtgtggtaaccaaggcctcgtccatcgtgtacttcttcaagtacaacgtcggcaacgaaactctttcctctttggctaatggcatcaattcggctggcatgattgccggtatgattcttgctccgttcttcgccaagaagatgaagaaccgcaatatcgccatcatgttcttcggattcggcattattggtctgcttggtctgtacgttggtgccaagatcatgtccattccgctgatcttcgtatccatggcggtttcggcattgttccagactggtcaaagcatgggcttcgtgatgttggccgatgtggttgactatggcgaatggaagaccggtgtgcgtagccagggcttgattacttcctgcgcggccatcggtgttacctgtggtgcgggcatcgccggctggctctccagttttgtgctggaaatcaacggttttgtgcctaatcaagagcagacggcgcaagctctgaacgccatcaacatcaacttcgtgtggattccgatcgcctgctgcgctatcggcactgtgctgatgctgctgtacaaggtcgatgatcagatcggcactattcgtgaggaactcgcagtccgtaatcaggtcgttgctgagtaaacgcaccctgcgtatcgcgcttcgggcttcgaaacggtttgatcccaattcccttttccgttcgaagcccggaacattcgttttacaaaccaataaggaaatcatcatgagtgttatggaacctgctgttttcacagtggaacgtgccgacggtacttctttgacgttacgaggtacccgttatctgccggaaggtttttcggaagacggacattcgccggtggcggtgctttttcatggcttcgggggcaatcgcatcgacttttccggatttgtcgtgcaaatggcgcgagaacttgcttctcgtggtctcgtggtcgttacttacgatcgtgctggtcatggcgaaagtgatggtactttcttcgataccaccgttagtggcgatgtcgaagacgccttgcaggtagtggagcaggctcgtcatatgagcggctgcgatccggataatctgcatttcgctggactgagccttggcgcggtgatttgcacgctgttggcaccgaaggtgcctgggcagcccaagtcgatcgctctgtgttctacggccacttcgtatgttgatgagattgccggtgggcatattcagggtaagcctctgtctgccatcgaagagcaaggctatcttgactttatgggtgttgccatgggaccggccatggtggaggatgcgggtcgtaccgatccttacggcatggcttgcggatatcgcggtaaggtgcttgccatccatggcaccaaggatttcattcctgttgactatattcgtcggtacgaggatgtgtatggcgaaaatatgcagctcaaggtcatcgaggatggcgaccatggtttcggcaatgtgaagcatcgcgaaatggttatgccggctctcggtgattttgtggcagagcaggcaggtctgtaaggccggaaggctttgcgccgtatcggacttcttgtcagtgcacggcaagaataatctgcgacctgtagtgttgtgacctggtcgcagatttggggcattcgttcgcgaatgccctttttcccgtatccctttcgtaccacccagcttgcctaccgcagaatacatgggcgtgaggatgctgaatcgcagggtgcgattgaagctctccatgttttcaaaaaagaaatcccacgggtttcatgatatttcgcatgagtgacgttctggggcattctccggtattgtgtcgatttctggaaacagacgaaatatcaatgagtatggtcaggttgtgaatctggaatgcgggtaggcggttggaaggcgaatcgtgagtgtgattctagaatggcgttcatgggaatgacgatttggattcgtggcgctcgccctcaaacgctgccgctgggtcttgccccggttctggtcggcgttgccgccagttggcggtgggaggctttgggtggcctgcggtcgtgcccagcttttccgggaagattgctggaagagcatgatgctggtgatgtgctggggtattgtgcgttttctcggccgtggtttgcggtcgttgcgatgttgtgcgccgtggtggcggtcggtctgcagattgctgtgaattatctcaacgattatgccgatggtgtacgcggcacggacgcccgacgaggcagtgacgccgcgggacctcggcggttggtcgcttccggagtggatcccagtcacgtgttgctggctgccgcggtcgctgctttagccgcctgtgccgccggactggtcgctgtcgtcataactggtcgctggtggctgatagcgcttggcgcaacctgtctggtggcggcctggggatataccaacggtcggcatccttacggatatcggggtctgggcgaacttgcggcattcgtattcttcgggttggttccagccctcggcacgcagtatgcgctaagcgggtcgatcaccgtgacgggggtggccggttcggtgatctgcggcctgctgtccgtcagcgtcatgatggtgaataacctgcgcgatctcgaagatgacgccgcgcacggcaagcgcacgctgatggtgcgcatcggcagtgggaagggcaaatgctggtgcatgcgtgcgctgggatgggctgctggtctgacggtggttttcgccatgccattatcggtgtatgccaaacttctggatctgctcataaagctgcctgcggaggtggatcgcgaccgttcatgcacggaatatggcatatgcggtgactggtcgtggggaaacgccgattggatgagccttgcggcgttcgtatccatcgcagggtgtgtggcgattgctactcgtgccgtcgcggccgtccggcatgaccagtggcgtcgggcgttgccattgtgctcgatgacctcgttggtcgcagccggcgcgttcgtgctcaatgcctgtcaggccggtttcatggcgtagctgcatcctgcatttacgatttcgtcattgagcaccggcgattgcctgatgatgcaaacggcatgcaacagaatgaaaattgttgcatgaacgtaaccaaataatcgtcatcgacggttgtgttgggcgtgctaggcggtagactggcaggtatgacttacaaactagtactgctccgtcatggacagagcgcatggaataaaaccaatcagttcaccggctgggtcgacgtcccgctgaccgagcagggtgtcgaggaagccaagaacggcggccgcctgctcaaggagaagaacgtccttccggatatcgttttcacctcgatgctgcgtcgtgccatcaacaccgccaacgtggctctggatgaggcagatcgtctgtggattccggtcaagcgcagctggcgtctgaacgagcgtcactacggcgctctgcagggcaagaacaagaccgagatccgtcaggagtacggtgacgagaagttcatgctgtggcgccgttcctacgccactccgccgccggagatcgatccgaacgacgagtacgcgcagaacaatgatccgcgctacaccggcgatccggttccggaagccgaatgcctggccgacgtggtcaagcgcgttgagccgtacttcaagtccgacatcgagccggagctgaaggctggcaagaccgttctgatcgccgctcacggcaactccctgcgcgccatcgtgaagatgctcgacaacctctccgaagaggagatcgccaaggtcaacatcccgaccgcaatgccgctgctgtacgagctggacgagaacttcaagccgatcaagccgcgtggcgagtatctggatccggaagccgccgctgctggtgccgccgctgtcgccgcccagggccagaagtgagtttgttgcgattgatacgcaggtaatcgcgttcaatcgtacggaacgtatatgaaaaggtggaaatccacagtatgtgggtttccacctttttgcgtccggtatctttgttgggttattacgtccgtctgccggatgaaatacggaacatgagatgtgcggcagacggacgtcaatcgcaatcggctcagatcacgccgtattccttaagtaacatcggaatatcggtggaatcgagcttcttcagaatctgcttcaacacggtcttttcaatggggttgagtttcatgtcggtaatcggcttgccgtcacgcagcatcactgtggcgttgagcaggttgcgtacgtcgtagaccgaaccccacacttccggcacgccacggtccacatcgcacagcgtgtacaccgcttccatgccggtgcgcatcgaatactcggtggtgaagatcgtgtcgcgcggggtttcggcgaactggccgaggaatgcgaaattcacggcaccatcaggcaccacatcagggcggtcgccggcggaacgaggcatgaagaacgcgtcgatgtatggcatcatcaccggaacggtgttcgcatggttcgtggcgagttccttgatcttgtcggtcggcacgcccatatggtagagccattcctcgcagatttcctcgccagtgcattcctgcatcggcttcttcacatagttgccgggcttgtcggggaacagaccgtacacccacacgcacagctggtctttcggctggtcgcggaactgctgttgacggttcaacgtccagctcatcagccagttggaatcctcaacggttacgatgccgccggtcaccacatggccggtgaacgggtcacgcttacagatcttctgaatatacggcggaatctccatgtcaagcgtggtcacggtggcgctcatccacttcgaatgctccggatcgccgcagaacacgtccgggtgaccgaaactcgggtcttgcttggcaatgcgacgccacatgtcccagccgccgccgggcttgatttccggagcccatgcggccgcttcggtttgcgagcccatggtcgagttttccacgcagccaccattggtgatgaacaccaagtcgttttcgcccaaatcaatgcttcgcgcggtgccatccgcttcggtcaggtcgatgcgcgtagccattttcttggttggcgaactgtacggattgcgtacgaacacgccggattcagcctgcttcttcaaaatcgtgtcttgaccggtgccggtatgcgaacgtaccggtcccatgcctccgccaatcttgaaatcgacattctccactttcgcgttgtagtggaactgcacgccgaatccttccaaatacttgatcatcggcagaatcatcgactcatactggttgtaacgggtgaaacgcaacgcactgaagtccggcaatccgccaatatgatgaatatatcgacggatatacagcttcatttccaacgcactatgggtgcgccagtacatccagaaattcgaattgaaaacctcatcgtcgaaataatcagaaattttcttgccgtacagttcctcattcggcgtgaagaacaattgcatgatctccatcgaggctttgtctgacagattgaatttgccgttcgtgcctgcgtcaacgccgcgcgctttcgtggagcggcagagtgagaagttgggatcttccttgttcagccagtaatactcgtcaagtacggaaacgccttccgtttcgatggatggaatggaacggaacatgtcccacatcacttcgaaatggttgtccatttcacggccgccgcgcatcacatagccaacgccgggaatatttgcgccatcgcaggcgcctcccggaaccgcgtccttttcgaatacgtgaatgtggctgcccggcagttgcgcatctcgcaccaggtaacaggctgcggtgagtgcggccaagccggtgccgatgatgtacgcgttcttgctgtccatgccttcgggtttcttcggtcgggcgaatgcttcgtaattgccgttggaataatacatgactgcctcctttggatgtcactgcacatattgtgccgcgacattgcgtaaaagtatatgggcaaaaaatagacagattgtttaatttttcttacggcttgacgaaagtgaaataatgcgggagatagtgcttgacgattcgtgctgaaagattgcaaaaacaaaacaagaaggcggcttcagtggggaacggaagccgccttctcaaaaagaagatgaaaaagaagatcgcaagaaaaaaatcaggcgatgtcggtgtcttcgtcgcgggtcggctccttggacgggtcgaaaccggagacgatgtacaccacgcggcgagccgcggacacggcgtgatcgccaagacgctccatgaagcggccgatcagcaccacgtcgatgagctgctggttggtgccggaccaatccgcggactgagccagttcaaaggtcttcttgtgcagttcgtcgagcttgtcgtcgttgatgatgatctgttcggcggtcttggtgtcgcggtcagacagcatggccacggtctggtcggcgacgtcgttcaggaacgcctgcatttcggcgaacagcggttgggcttcggccggcagcggggaagccgggtaggtgcggcgggcggcttcggcgatgtgacgggccagatcgcccatacgttcgaaggtggtggccaaacgcatggtggaaacaaccacgcgcagatcggtggcaaccgggttctgcttggccagcagcttcacgcactggtcgacaacgctggcttcgagggcatcgatttcgatgtcgccgtcgataacggcctgggcggcttcaagattctggttcagcagcgcgtcgccggcaccgttgatcgccttgcgcacgcctttgaccatgtggtcgagatcatcggcaacagccttgagctcctcgttgaaaataacgcgcatgtgacttgcctttcaatgcttcatatatatctgggttcgatataacctctcacaagtctattagacaaacgccatattcgtaaccactgctcgtgttgttccgtcaaagttcaccaacgcgttcaccttgtgttcacgaacgagcggtggtgtcgcgagttggggagcctcaagagtgtgcaacaatgaaaccatggttgaatctttgggttcgtggtggcgttcgctgacgcaccgcaacgacgatgatgagcatgatgccgatgacgacacattggatgatgccaccaacgcgttgctttccatgctgccgttggcttccgtcgtagttgacgagcatgacgaagtgattcgcgcgcacccgtcggcgtatgcgcttggcgtggtgcgcgatgatgccatcgcggaagagaccgtgcttcgcgcagtgcatgaggtgcgttcctgtggcggcaacaaacaatttgatttgaccaccaccacccaatatgtcgcccagcaagtgccgaaggcaggcaaaccaaccacacgtgaaatcgcgcgccaggcactgatagggcagtcaaaccccaatacttccggcgcaaccgtttcccgacccaactggctgaaaatcatcgtcggcaaactcaatgagaatctcatggttgtgctcatcagcgatgtgagcgaaagcgtacgattctcgcaggtgcgcgattcgttcatcaccaacgtttccgaacaattgcttgagccgacgcaatcattggaacagctggcggacattgtggaacggggcggtgccagccaacaggacgtcgaacgcaacgccacgcagctgcgtcaatcctgttcccgtcttgagcatatgatttccgatctgctgctgctgatcaaagcgcaggagccaatcctgccgaccgccgacaatcgcatcaacgtgatggaacaggtacaagccgtggtgcaggcgcatctcgatatggctgcgcaacgcggcatcaccatcgagaccggcggtgacgaatcgctatgcatcaatggcgaagccgatcagattcaggcggcgctcgcaaaattgattgaaaacgcgattacgtattcaaaagacggttctacggtgaatgtcgtcgccaaagccaatgaggagcatacggaagcggtaatcagtgttctcgatcgaggcaaaggcatcgccatcggcgaacagaaccgtatttttgaacggttctatcgcggcagcaatcagaatgagcattccggtgacggcattggcttgggacttgcgattgtcaagcatgttgcgttgactcaccatggttccgcgtcggtgtggagcagcccggggcagggaagcacgttcgccttggtgctgccgttgggcggggaatgatgtaagacattcggcagatgttgcaaatatctcaaatggagataatgcgatgcccgtctcgctttcgataaggcaagacgggcatcatatttttttgaggatttttcgggggtatattgccgattactcgccaagacggcgataatcccaacggtcgaaatgctcccaaaccagcatgagcacgccgatgaccgtacccgcttcgcagacggtttgcgcgcgttccgcgtcgatgccgaatgcgataagtacgatgcagaccaccaaagcgatggcccatagcgcggtgccaaacatgaataccttgcgtaggtcgacgcgcaccggtttcggcgaaggtttcctcacgctgggatcaataatcggagcaatcttcatatcgccacaccttaccttgcatcagagatgttccaccacgtagtcgatacagcgggtgagcgcatccacatcgctgggttccacggacgggaacacgccgatgcgaagctggtttcggccgagcttacggtatccgttggtgtccacaatgccgttttcgcgcaatgccgccaccacttgggatgcattgatgccatcgttgatatcgatggtgaccacggcgttggagcgcgcgttcctgtcgtttacgaacggggaggcgtaatcggacttctccgcccactggtacagcagggacgcagaccttgcgcagcgggccgaagcccaggcgagcccaccgttgtcgttgagccaacgaacctggttttccagcatgatcagcgttgccactgccggcgtgttgagcgtctgatccttgcgggaattctcgatggccgaagtcagggaaaggaacggaggaatccagcggcgtgcgcccggaagatccacgcttttggcgatgccgtaggcgcgttcgattgcagcgggggagagtacggcaatccatagtccgccatcggatccgaaagctttttgcggcgagaaatagtaggcgtcggtctggctgatgtcgaccggcagcgcgccggcgccactggtggcgtcgatcagcgtgagcgcaccctgctccttggtgcctgcgatgcgtttgatcggtgcggcaacgccggtggaagtctcattgtgggcccagcaataagtgtccacgtattccgtgagctcaggcaggcgatatgttcccggctctcctgcgaaaatctccggctcctcaaggaacggtgcggattgcgctgacttggcgaacttcgagctgaatgagccgtacgtgccgaatgcggccttgcgggtgatcagcgaggcgcaggcgatatcccagaacgcgctggctccgccgttgcccagcaccacttcgtagccatcgggaatctggaagaattcggacagtccttcgcggattgagccgaccacctgcttgatgggggtctgtcgatgggaggttcccagaagattacgggctcccttatcgagcgcttggatttgctccgggcggattttggtcggccctgagccgaaacgtccgtcttccggaagcacgttggaaggaatggtcacagtgttcgtcatgacaacctagggtagtcagatggtcggattgtgcgtggtgatgaccgcttttcggaaccatgacgtggcgatgatgactgcgatatcccggtgtcggtgtagcctgagcttccgtgacggttctgtaaccacgcggtcataagcctgctgtggttgaagtaatccgcaaggagtgttgatatatgaggcatgcggcgcataaagctgccaaggtttcgaatgagcgtttcagcgttgccaaggcgctgttcacctcgagccgcggttcccacaccgccaaggccgttcgtatggtccagctggcaaatggtgggggtgccgttgtaggtcttgagcctgcggttgccgaaaagctgaatgaagtggctccgatgagccgccgcgccatgcgtgaagccgctcgtgcggccggtcgtcgctccgcattcatggcttccgcatcgctggctgcgttggttggcaccgcggccactgccatggcggtcggccagcagaatgcgtctgaaatgacttttgccgacaatgccaccactaccacgcagatgaagcgtgtctccgacgatgcggcatcccgttccgagtcccgtagcgatctagacgctctggcctccaccagcaatagcggtgattggcagcttggcgaaaccagttcctccatggacacgaatcttctgtcaaagtccattgccgacaatcccaatgtcgccgttctcatggatcaggacgccggtcttcttccttcgggcttcaatccgaaccacggcaccggtgataccggcaatgactatccatacggtcagtgcacatggtgggcgtatacccgtcgtgcacagcttggcctgcctgccggaagccattttggtgatgcgcggagttggggtgattccgctcgcgctctcggctattgggttgacaatacggcacgtcacgttggcgatattgtggtattcgctccaggccaaatgggcgcggacagctattacgggcatgtcgcgattgtcgaaggagtgaatgccgacggttcgattaagatttcggaatccaacgtcaggggtcttggcgtgatttccgatcgtacgttcactgcgcaggaagcttcgcagttgacatatatccattactgatttctctgttttcgttaatctgcgcttgccgcacttttttggcgtagcgtgattgcgtcggcgtgtcgcgtgatatgacactgttctggttatcttgctgttctgctgcgggggaacgtgtatggtagcttcagacacgatgaatattgctaaacgtttcacgagtatcttcgccgttgttgctgtatctgccttgttgggtgcggcggttcccgccgcaagcgcaggcggtgctatggctgataccacggtaaccgctacacgttctttcccgaagaccaccgcggccaagcgtgattttctcgccgagcacacatccacggatgttgaatctaacgccgattggggtggcatcgaaagcttggatgttccccagaccgagtctcaggcggaaaaggaccagaaggctcaggagcaggctgaggccgaagctcaagcacaggcggcccaagctcaggcacaggctgaatctcaggctgccagtcgttcttccgatcgtgcttccatcagcgttcctacggctcccgcgagtgccactgggcaggctctggccgactacgctctgcagttccaaggttatccttacgtggccggaggcaatactccgtccggctgggattgctctggtttcgtacagtgggtgttcgcccagttcggggtaagcctgccgcattattctggcgcccagatgagcgttggaacggcagttggaagcattgccgaagcagctcctggggatatcatcgtcaatactcagcatgccgcgatctatattggcaacggcatggtgatcaacgcgctgaatccggctcagggaacgcaggtcacttcgctggccgtgttctcaggtggctatgcgattcgtcgtgtgctctgagtgaacatacggtttgatttttttaaggcgtatcctttcggggatacgcctttttgtatggaaaagaccgagtcgttactgacaaaaccgcatgtcgcgcggtatggtggagcctagaggcgacgcatggtcgcgttgccgaggtgattcaaggaggtcgtccatgattaacgacaaggcaatcctcgttggtgttgatggatcccacgccagctataaggccacttggtgggctgcgaactatgcgaagcatgcgggactgacgctgcagatcgtatgcgcatactcgttgccgagctatgccgctgtctccttcgacgcgacatacaccgccatgggggatgacaatgcggcccatagcgacgcgcaggagattctttcgaaggccaaggccatcgccgacgagcagggtgttgaggctaccacgcttattgttacgggcgatccggcttccgtattcgtggaactgtctcgtaactacaatctcatcgtcatcggcaatcgcggcaaaggcggtctggcggaacgtctgctgggcacgaccagctccagtctgccggcgtatgcatactgcccgatcgtagtggtgccgtacactgacgatgacggcaatctgatgcacttgaacaacaccatcaccaaggtggccgtcggctccgacgaatccaagtggggtttgaaggcgctggagatcgcggcgaatttcgccgccgcatgggatgccgagctggatgttatttccgcggtgccgaacatgaagggttccgacgacgaaggtgtgatggcctcgttcaaggatgatctggaagtgcgtatcaagccgcttgaggaagcccatccggatttgaagatcaacaagcagatcgtgcctggcccggcggttggcgcgctgaccaaggccagctatgatcacgacgtcgtcgtggtcggttcccgtggtcgcggcggcttcactggcctgctgctcggctccaccagccagggcttgctgcagcacgcggtcggcccggtgtatgtggtgccccgcaagtatgtcgaggctgcggaaacccgtcttgacacggttccgagctcgccggcggaagtcaagccgaaggctcttgacgatatcaagggtgtcgaggaggtgccggtttccaaggccgagccggatgtggtcgaagccatcgaaaccaagatcgatcccgatcgtcagtaaattcaacaggtacatataaaaaggcgattgcaacactgcgaaagcgttgcaatcgcctttttttttaaaaaaagaaaacgtcagtgcttgatgatgacgtccatgcggaccggagtcttctccacgtacgtatgcttcaccgtgcagcccttgtcgatatgacgagtgacgcgttccttaagctttgccgcatcctcatcgctcagaccggcgtcggtggcgtcgatgaccacctgttcgtcgaaaccgatgtatgcgtcattgtcggcgtcataggtgccgtccacaacgattttcgcgcccttgccctcgcccagcgtatgctcgatggcgaactggcttgacagtgcggcgcaaccggccagcgcgatcttcatcaggtcgcccggcgtgaactgtccacgacccttgccgaacttgatatgcgcgccatcctcgccgaaagcatcccaagaaccgtctttgttacgctcgacccacagtcttttgcccatggtgaactcctcatcgtcttgccgggagcgccgttcgctcctcgcctacatacctaatgtaatccattgatgcctgttcgctaggaggcattccgaaaagcgtaaacaatcaacgcgcgggtggcatatgcttgacctgccgttctgtactgttaagcttgcaaccatggctttgacacctgaacaacttgcagatatccgtacccgtattccggcacgcccggaaaccgacattcccatgccatatgaagaccttgtgcgcaagatcctgacggaaggcacgttgaagtccgatcgtacgggcactggtaccgtcagcctgttcggccagcagatgcgattcgacctgagcgagtattttccgctgctcacgacgaagacggtgtttttcaagggacttgcctatgagctgctgtggttcctgaaaggttccacgaacgtgcgttggctgcaggagcgcaatgtgcatatttgggacgaatgggccgatgagaacggcgatttgggtcccgtatacggcgcgcagtggcgtagctggccggcgcccacgcccgatgatccgaaccgtaccatcgatcagatcagcaatgtgcttgatcttgtcgagaatcacccggattctcgtcgtatggtcgtgtccgcttggaatcctgccgaagtggagaatatggcgttgccgccatgccacgcgctcttccagttctacgtggcggatggcaaactttcgtgccagctatatcagcgttcctgcgacatgttcctcggcgtaccgttcaatatcgcatcctattcgctgttgacgttgatgatcgctcagcaggcgggactgcagccgggggagttcgtgtggacgggtggcgactgccacgtgtacgacaatcacatcgaccaggtgttggagcagttgagccgcgatccatacccgtatccgcagatccgtattaacaaagccgattcgctgttcgattacgattacagtgattttgaaatcgtcggctaccagcaccatccaaccatcaaggcgccggtggcggtctgagagtcgtcgccagacgttagactactgaccctagttcgactgcaaggagtgagtgaaatggagcatgacagtagccgcagtggctatcacgaacccgagcccggacttgccgggcttgaggacgaggaggattggggcgatgatttccccaagacgttctcggtgaatctgatttgggcgcaggcctgtgacaaggaaggtcatgacggcgccatcggattcgagggtggcatgccatggcatctgcccgaggatatgaggcgtttcaaggagcttaccgtctcgcatccggtcattatggggcgtaagacgtgggagtccctgagcccgaagtatcgtccgctgccgaatcgcgacaatatcgtggtttcgcgtgatccggcttacactgcgccgggagcgaccgtggtcgacagtctggatgatgcgcttgatctggcacgacaggaagccattccggatgacggtcttgaccgcagcgaaatctggattatcggtggcggccagctgttccgtgaggccatgccatttgcggacaaggcgtatgtgacgcagatcagcatgcatgccgatgccgatacctacgcgcccgacgtgaagtcgctggtggaatccggcgcttggaaggtgcttgaagagggcgtgtggcagaacacgcggaagggttccggagatatcgccggattccgtttcatgacgtatgcgaagaatcgcgaggagtaaccgtatgtataccgtgatgaccgtgtgtaccggtaatatctgccgttctcccatggccgaaatcattctgcgcactgaattcgagcgtcgtggccttgccgacaaggtcaacgtcgagtccagtggcgtgagcgacgaagagtatggcaatccgatcgatcgtcgtgccgtcaaggtgctccgtgagcgtggatatgagctgccggcacatcatttcgcccatcgcatcacccgcgatgagatcgagcgtaccgacctgtttctgccgatgaccgcttcgcatatgcgtgcgctactgcgtcagctgccgcaggccaagcgtgagaacgtgcatatgtaccgtagtttcgatccgaatcttgccaagcctgtcgcaggctacgaaagtgagattgatttggtcgatccttggtatggcggcgcccgcgaattcgaagtggcgattgaccagattgaggaagtggccccgttcatcgttgattgggttgagcggcagctctgacgattgcatacgatttttccgtcgaaaagcccggttcgcaagagccgggctttcttgtatccgtatgatttcaatgatttcgaaagatcttaagaaatcgcaagagattgcaaaagtaatattgcgcaattgatgtaaatcagagaaaaatagaaatgaaaaataaaaaagcgaccccggccggacttgaaccggtgacctccgccgtgacagggcggcgctctaaccaactgagctacggggccgttgtttcagccttgcgactggcaacagatagatatattacggcaaagtcgctatcgtgcaaatttcggcgtgtcatcgatgaatattcgtatgaattgctgaaagaaagtatttgcttaaactgcggcagtagtagggaagaaaagcaacggccggtcgcatatgaggggaaaacttctcatatgcgaccggccgttaccgttgcggtgccgtgttgtcgctcacgacactacgaattgctggtggaatcagtcggtctgtttccaggtctcgacgtcgatgtggtgttccggattggcctgccatgcatcccaagcggacttcacgatgtcttcgacgttgtactgtgcgtgccagcccatctcttcgttgatgcgcttcggggagccgatcaggtgcggcggatcgcctgcgcgacgggccatgacggtctcttcgaacggcaggccggtgaccttcttgacctcatcgacgatctgacgcacggaggtgccttcgccggtgccgacgttgaaggcgtcgtacttgcgttcatcgcggtccagatacttcagggcggcgatgtgggcgtcggccagatcggagacgtggatgtagtcgcgcacgcaggtgccatccggagtcgggtagtcgtcgccgaagatcgcaggggccttgcccttcttcagacggtcgaacagcatcgggatgaggttcaggattgccggatcctcaagctcgaccgggccgcagccggccacgttgaaatagcgcaggccgcagaagcgaatgccgtacggctcttcgcaggcgcgtgccatccactcgccgaacagcttggtctggccgtacgggttgatcggcagcatcggaacgacgtcttccggaaccacgtcgaccggcggaacgccgtaggtggctgcggaagaggagaagacgagcttcttggcgccggagtcgcgcatgccgatgagcacgttgagcatgccgttgatgttctgctggtagtaccacagcggcttctcaacggattcgccgacctgcttgcgggctgcgaagtggatgacggattcgacgccttcggccttcatgatttcggcgaggcgttcgccggcacccggtgcggcgatatccatgccgtacaggcgggagccttcgatgcgggttggcttgccgtagctcagatcgtcaacgacgacgacctgttcgccggcctggtgaagagcgtggacgacgtgagcgccgatgtagccgcacccaccagtgacgagaactgtcatgttctgtcctttcctccaaaatgagcgttaaagcgctttgttcgaaaaacaaacgtccaacgaacgttgttcacttttgctctagtttgttaccttttgaacaatttgagtataacacatgaacaggaacgcacataatcgaccctttcctgcgtttcctctataaattagggtatgcaagaagatgtgaacacgccgactgaaaatcaagttaacggcgaaaacgaacaaagcatgtcaaaaacgcaagatgaacaacgggctgatgctggccagcgtcctgccttgtatgggcgcaaggtgttgtccttcgtgcgtcgttccgccaggctcgacgcacgcttgcagcgtgcatgggatgcctatgcagatacgtatctgctgaaaatcaacgcgggcgaggggtcgcttgatgtgcgaggcgatctggtgttcgatcgggcgtatatcgcggatgtgtggggcaatgtcaatcctctgattgtggaaatcggtaccggccagggggaaaacgttgttgcggccgctgctgaacaccccgatatgaacttcctggcgcttgaggtctatgatccgggcgtggcgcataccatgctgctcgcaggcaagcagggcctgaccaatctgcgcatcgcgcaggtcaacgctcctgagctcttcaaagccgcggcggatggatcgatcgctgaagtatggaccttcttccctgatccgtggcccaagatgcgccaccacaagcgtcgtatcgtgcagccggagcttgccggcgagattcatcgcacgttgcgggatgggggagtgtggcgtatcgccaccgacatcgaagactatgcattgcatgtgcatgaggtgatggatggtcttgaaggattccataatgacggcatgcttacggtgagtttgccggtcgagcatgttggcaagggaaatgccgacgaagcggccggtctgcgacacgccgatttcaccgaatccgagcgtttttccggacgaattctcacgaattttgagaaaaaaggacttgctgccggtcgtgtgattcatgacctcacctatcgctgcgtatagtgccggttggtctgttgttgaagtgctgaaatggcttgatttcaacgattttcagcactttggcaacgggttgatggcgattttgcgacgctgcgacacgccgagatttgcatgttctgaggattcgcgtatagttaagcgagttgtcacgcggaaacgctgaaagcgcccccttcgtctaacggttaggacaccagactttcaatctgacaacgagagttcgactctctcagggggtacttaccttggtaacaaggtggcaatggccccgtagctcagttggttagagcgccgccctgtcacggcggaggtcaccggttcaagtccggccggggtcgctcgaacagattcctgttcatggctctgtagctcagttggtagagcgaacgactgaaaatcgttaggtcagcggatcgatgccgctcggagccaccatggctttgaaacctcggaaacatccgaggtttctttgtttttgcccacacgtatgacgattgcggccgtatgtctagcgccaagccactgatgccggctgttggttgaatacgcgctcgcattgcgggtaatccccctaaaatggtcgacgcaagtcatgttgacttgcgagttactgagaaatgactaagaaaacctccgttagagggggagtctgtctgctgtttggctacactggaacaccgtaaggcagtaacaatgggggtttgtgggcagagttatgccgtaaccccgttaagggagtattcgctggggtggcggcatggaagtgcttctggtcggcaacaccgacttcattaccaagcagtggattcagcattcctttccccgagaccatgtggtgatagcggaacgagaaggcaccgtagacggcaatgaccgtctcagaatcgtcaacatgtctgacgccaacacccttgccgaaactcttaccacatacgaattcgatcgcatcgtattcttttccgaaggcctcaccccgcgaagtgagcgtgacggcgatctcggatatcttcgcagattgctgcacgccatacgtaacagatccacgcaaatgctgatggtatgcggaccggaatccgaattcacctatccggaaaacgccgacgtacgtgataccagcaaaagtctgatgtctcgagcgtcggaagaactctgcctgtattacgcgcgcacctaccgtctggaagcgaaaatcattcgctgtccatacttgtatgcacccgagcgcaatggagcaaccgcatatttcggcagactgttcgaacaggcatcggcagggtcgatctcattctgcgaacgcaaacagcaacagacatgctttctctgcgccgacgatcttgccgaactgatctaccgcatgttcgacgattggaccgccgaaagcgaaatcttccatgtgcccaacgtgttcgacttcacatacggtgatttggctgatgcgatcagcgcggcatttcccggattatcggtgacttttggcaaagacagaccccaacattacccagcagacgatcatgtgctgcgattgcgctatggctggtcgccgcgatattcgctcaaacaggatcttccccctgtgcttcagcgctggaaagaagcgcgtgctcaggaacaatccaagaagcacccggtctgggattttctacgcaaccattcaaaaccatggatcgcaatcgaaatcttcatcgcgttcatattggaagaactgcttcgcaccgcggtacaaggcaacagccagttgggaaccgtggatttgcgcctgtttttcgtggtgatcgtcggcacgatgcacggactgaacgcaggcgtgttcgcggccgcgctcgcatgtgtcggcatggcgttgtcgtatgcatcgaagggcgcttcattcgctccgctgttttacgacacgtcgaactggcttgcgtttgtggtgtatttcgttgccggcgcagtatgcgggtatgtgcagctgcgtaatcgcgaaaacctgcgattcatgcgtgacgaaaacagtttgctgcgtgaacgacttgcgttcctgcgtgacctgtaccacgatgtgctcgatgatcgtcgtatgctgcgcgggcagattatcggcaggcgtgacagtttcggcaaaatgtatgcgatgacacgtgaattggacgaagtgcagccgcaaaagctgtatcacacgaccattcgcattatgcaagacacattgggcggcgatagtttcggtgtttaccgcattgacagcggcggtcgattcgcgcgtttgatggctgcgagtccgcaaaccgaatccctgttcagcaagtcggcgctgcttgagaattatgccaacattattacagctttggatcatggtggattgtgggtgaaccgcaatttcgaaccggaccttccgatgtatgcggcaggcgtgcatgccgatggcaagctggccgtggtgattgtgcttgccaaagcgcagcccgaccaaatgaatctgtacttccagaacctgttcaccatcatgtgcggcttggtggaatccgcgatggtgcgtgcgttcgactatgagaatgtggcgcgtcaggcgatgctggtgccgggcaccgaattcctgaacactcgggcgttcctgcccaaagtgcttgccgccaacgaactcaagcacgaccatatgggcgatcacctgctgctgcgtgtggatgatgcttggcaagacaatggcagccgtctcatgggggccattcgtcagacggacgaggcgggtgtactgcaagacggcaacgtgtatgtgttgatgaaccaggccggcaagcatgagctgcctatcatcaacaagcgtttggcccaagctggattgcatgtgacacgcgtttccgggcaagaggaagacgcgctgctggatgaggcttcggaacaagtggccgccgaatcgcacgaaggcggcacggcatgaacacaacggtagtgacgatgctgcttatcgtcatacatgtgctggtatgcgtgctgatgtgcgtattgtctcgttttggcgtgcttcgtgtggaagggcgtctgcttccttttatgctgttggtgccgctgtgggggccgttatgcgtgctcttgctgcatgtgcgtacgctgattcgtgcgggcgagcatacggctccagatctcgaacagatgcgcgtggacgatgaggaacgtcgaagcattctcgttgaggaacgagccgatttcgccaataccgtgccgctggaagaggcgttgatcgtcaacgattcgagtcagcgtcgcagtctggtgatgtccattctcaacgacaatcccagccattatatcgatgtgctgtcgcaggcccgactgaatgaggatgtggaggtcgtgcattacgcggctaccgccatggcacagatcagtgccaaggaagatcttgcattgcagcgctgccgcaacgattatctgcagcatcgaaattccgaaacgatgttggaacgctattgcgatgcgctggaacgatatatcaattccggtattgcgcaaggatacgcattgcagttgcagaagcagcgatatgccgaagtattgcaggaacgacttcgccaacatggcgattattacgttgcgtgccgtcttgcgcaaatgcaaatcgatcttggactctttgatgatgccgcgcacaccattgacggcgctatggaacagtggccggatcaaggcgatgtatggctgatgcgtctacgactcgatgccgcacgcaatgatggcgatgcgttgcgccacactgttcagcagatcgaaagcaagcatatttatctcggtggccaaggaagacgtgtgctgcggttctggaccggaaccaaggaggctgaacgcgcatgatcagaggattcctgtcagacgtgttggccaagtggaaacgattccgctggcaaggtttggtcaaagtgtgggccgtgttcatggccatcgcattggtgttgctggtggaaagcttgggcgtgcattacggtgtcacgcggttcgacatcacgtatttggatcgaaacaaagccattcctgcagccaatgccatcgctggcgaaaaagctacgaatctgttggtggtcgacagttcgcaggagggcgtcagcgatgccgaagccatgctcgaccagattctgcttgatatgaaagtccccaccactacggttgacgtggctgacgaaaacgctgaatttccagcgttgactcactacagcaccatagtggtggccatgcctaatctcgaccgtctgggcgagcatgtgctgcaaatcatgcaatgggccaaaaaaggcggaggagtcatgtttgccatgactcccgaaaaaaccggctatttggatgtgatcggcccgcagatcggcattgaatcgtccgcatacgaatatgtgctgactaagggcattacaccctccaaggatttcatgttgggcggcggccagacatacacgttcagcgatccgtttgaatcgtcgctgagtgtcgcattgcatgatcgcgcacaggtcaaggccgtcagcagtaatgggcgcacaccgttgatttggagcacgttcgtgaattcaggttcggcggtggtgtgcaatatcggtatttacggcaaggtgcttcgaggattttacgcttcggcgttcagcctgctcggttctgccacggcctatccggtgatcaacagcgcggcgttctacttggatgattttccctctccggtaccgtcaggcaatggcaaatacatcaaacgtgactacaacatgagtattgctgaattctattctcaagtatggtggccggatttggtgcgtcttgcggaacggtacggtattcgtttcaccggtgtgatgattgagaattacggcgatgacaccaaggatgatccggtacggcagacggacggcgcacaattcgagtattacggaggattgctgctgcggcaaaacggcgaaatcggatatcacgggtacaaccatcagccgttggtgttgccgaatacggattacggtaaggaatacgcgtatgtgcagtggccgaatcgcaaagccatcgtcgattcgttgaacgaactgatcgcattccagaaagacgtattgcctgccgcaacatcgtcggtatacgtgccgccgtcgaatatcctctcccaagaaggacggaagatcataggcgaggatgtgtcgcagattcgcgccatcgccagtacgtatatgccttccgacagttccttgacgtacgtgcaggagttcggtgttgcggccgatggcgtggtggaggctccacgtatcgtgtccggcggcatggtgggtgacatgtacatgcgtcttgccgcggtttccgaactgaacatgcactatgtgagcacgcacttcatgcatcccgacgatttgcttgatgaagatcgtggagcgaaagaaggatggaagaagtactaccagggattggaaaactatcttgactggctggaatcgtcggcaccgtccattcgtatgcggacaggcacggaatgtgccgcagccatccaacgtttttcgggattgaccgtttcgatggaaacgtccgacgatagttgggatctgaaacttggcaacctcaccgatcaagggtggctcatgttccgtgccaacaatggcacgcctggcagggttcgtggcggaagcctcaccaagctgaccggcaacttgtatctgctcaaagccacgaacgccacggttcatatcgaacgcaagactgggggagaggcatgagaatctgcctggttttggaaggatgctacccgtacgtgcatggtggcgtgtccacgtggatgcacagttatatcgaagcgatgaaagagcacgagttcgtattgtgggtgatcggcgccaaagccgaagaccgcggcaaattcgtatatgacctgcccgacaatgtggtggaagtgcatgaggtgttcctcgacgacgccttgcgtctgagcggtgaacgcgcgcaagtgtcgttcaccgaagaggaattgcggtcattgcgcgaactggtgaatcttggcagcccggattgggatgtgctgttcaacctgttccacaccagaggcgtgcatccgctgtcgttcctgcaaagccgtgaattcatcgacttgtttacgcaaatctgcatggaagaatatccgtatgtggcctatgccgacgctttccataccgtgcgctccatgttgctgccggtgttgtacttgatgggctgcgaagtgccggaagcgcagatctaccatgcgatttccactggatatggcggattgttggcttgttttgggggggggggtatcaaccatgcgccggtattgcttacggaacatggcatttatacgcgtgaacgcgaagaggaaatcatttccgccgaatgggtgtcgccagcgttccggccgcgttggatccgcttcttctacatgctttcggaacagatctaccatcgtgcgtggcgcatcaccagcttgttcggtcgtgcccgtcttatccaaattggcatgggtgcgcccgccgatgcctgccaagtgattcccaatggcattcaatacgaacgtttctgcgatattcccctgaagcccgacgacggttgggttgatatcggcgcggtggtgcgcatggcgcccatcaaagatgtgaaaaccctgattcacgcgttccatgagctttcctctcgcgttgacaatgtgcgcttgcatattctcggcggtgttgacgatcaggagtatgccgacgaatgctatgagcttgtggaacagttgggtgtgcgcaatcttgagttcaccggccgtgtgaacgtggtcgaatacatgcgcaagcttgatttcaccgtgttgaccagcatttccgaaggccagccgctgtcggtgctggaatcgttcgcagccgcacgcccctgcgtgaccactgacgtcggctgctgccgtgagcttttggaaggcgaggaaggcgacgatttcggcacggcaggcttctacgtgcccccgatgtaccgcgagggcctgagccgagccatggaacgcatgtgttccagtcgcacgctgcgtgagaccatggggcagattggccgtaaccgtgtgaacgcctattaccggcatgagcgcatgcttgacgattatcgcaagctgtatagcgataccgcggatcagttcggattgaatcagttcggattggagcgctgatatggccggtattggatttgaactgaagaaactgttccaccgtagaggcttgatggcgatgctgcgagcctacggctatgccggcgtgatttgcgctggtccgatgctgttgggtgtactcctgcagttcggcgtgctgatcgtgagcagctggtggcaggtgggccgccccgaccgcgatctgctcgtatgcatgatcacctacacgctgcttgcctcgttggtgttgacgagttttctgtcgatgccggtcacccgttttctggcggatatgttgtttgatcacgatgagaagatgattctgccgtcgttctggggttctactggcatcatgctggtggtgggcgcggtgttgtacacggttttcctgctgttttccggtgccacgttgatgcagggcgcgttgtgtttgtggctgtttcttgaaatgatcgtcaactggaatgcgatgagctatttgacggccatcaaggattacaaaagcattctgtattctttcgtggctgcggtgttggtggcgttcgttacgtcatgcgtgttgcttgcgttggcctgccctcctgtggagtcgctgttgttcgcagtggtgcttggctatggtgtgatgctggtgtgggatgtgctcttgttgcatcgttattttccgcaaagtcgtaagcatccgtggctgtttttgcagtgggtcgatcagtttctgccgttggcgttgaccggattgctgaccaccatcggcctgttcgcccatttggtgatcacatggtgcggtccgctcggcatcaaggtgaagggcctgttttatggcgcgccatattacgatgtgcccgccatgctggcgtttttgacgattctgatcaccacggtgaattttgtggtgtcggtggaggtcaatttctacccaacatatcggtcgtattacagtctgttgaatgatggaggcacggtcaaagacattaccgttgccgaaaacgaaatgttggctgtgctcaatcgagaattgcattacacggcgttgaagcaattgttggtgaccgctgccgtgatttcattggaaaaaacagtgctgaacgcgcttcctttaggattcagcgatgtgatgcacggatatttccgtgtgctctgcgtggggtatgccctttatgcggtcggcaacaccgtgatgctgattctgctgtattttaccgattattccggtgcattgacggcgtcggcattgtttgcgggttcgacggttgtgttcacagtaatcggacagttcttcactacgtcgctgttcggtttcggttttctgatgggggcatcgctgttcgccatatatgcgacattccggctcgcctcatacaccgacaatctgccataccgagtgctggggcagcagccgattgtggcgcaaacgaaacgtggacgtttcaccgaactgggcatactgcttgaacatggcgaacagcgggtcgaccaatcattgcatcgctcagggcatgcacggtcttctgacaaggcgaatattgcagaaacggatgtcataatcgggaggaatcgtaaatcatgacatggtggaaccgacgcaacacaaaagccattaccatgcttgtcaagcaaatagcggcattgacggcaatgctgacggtgctttcctgcgccggatgtgcgacttcgtcacccaacgataatgaacaatcgcaatcatcggattcgtcacagacgcatgagcaagtcaagaaaagcgctgaacaaagcatcgacggcgcacacttgcgcgacaacgaatcgttatacaaggtgtatgacgacagcggtgtcgaaaccatgtatttgacggtatcgcgcggtaattcgtcggaaggcaccgaccatagctggagcgaaatcaaccagtattccgttgatgactatgcggccatgggcgttgaccgctacaaggtcaatggtttgctgcaggtcggcgacgaacaaggaccggtttccggggagcttggttttggtgaaagcgcgccgaacgccaccgtgcagatacgtggccagtcatcgagtaaaaacgagcagaagaactacaagatcgagttgaaaagcggcaaaggcaagtggcgtgggcagcgtaccatcgcattgaacaagcatatgggcgaaggtctgcgtttccgtaacaaaatggcgtacgatctcatcaaaggcatcgaccagatgatgggactgcgcacgcaattcgtgcacttgtacgtgaaagacgagaccagcggatcggattccttcgacgattacggtctgtacacgcaagtcgaacagctcaacaaaaccgcattgcaggtgcacggactcgataaaaacggacagctgtacaaagtcaattatttcgaattctatcgagacgaagacgtgatcaaactcgccgatgatcctgactacgatcaagcgaaattcgaagaaaaactggaaatcaaaggcgacaacgaccataccaaactgatcgccatgctgaacgatctcaatgattattcagtgccgatgggcgaaatcctcggcaaatatttcgataccgaaaatctcgcatattggatggcattccaattgctgaccggcaatatcgatacgcaaagccgcaatatgtacctgtatagtcccacgaattcggatacgttttacctgctcgactgggataacgatggtatgctcatgcgcaaggaatacgagatcaggcaacgttccgagggccaaagctgggagaacggtgtcagcaactattggggcaacatactgttccgacgttgtctgcaaaccaagtcgttccgaaccgcgctcggcaaggccgtgaaagacgaatacaagtatatgagcgccgatcgcatcaattccatggtgcggcggtaccgttccatcgttgaaccatacgtgcggaagatgcccgactgcatgcatgagcctctgacgtcaagccaatacgacacggtggcaaaccaattgcatagcgaaatcgaacagaactaccagacgtaccgaaccgggttcaataagcccatgccgttctatatcggcaagccgactcctaccaacggcaagctcaaactcagctgggatgtctcctatgatttcaacgatgaggatctgcgctatagcgttaccgtggccaaggattacgaaggcaaagacgtggtgttcacacagagcgacctcgtattgccggaagccgtgatggatatgcctggtgaaggccagtacttcatcaaggtgagcgtgcgcaatgcatcaggcgagacgcaggacgcgtttgactactacgtcaccgacggcaacaaggtctacggcaccaagtgtttctatgtgaaagccgacggcagcattgtggaggatgccaatgtgcagtgatggtggcaatcgcggaacgtcgctgctgcaacgtatcaaacatcgcgtcggcgaggaattatccgttccaccgcgcacagccaaggaacggttccgtcatgagctcaaatatctgatctcatacgcgcaaaaagccgacttgaacgtgcgtatggcgccgctgcttggcctcgacaagcatgcgaaaaacggcggctatatgattcgcagcctgtatttcgacgattattggaacaccgcatatcaggaaaaagtcgacggtgtgctgctgcgtaggaaataccgtattcgcatctacgattacagcgatcgtgtgatcaaactggaacgcaaacgcaaaagcgacagttggatctacaaggaggatgcaccgctcacgcacgagcagttcgaccgtattcttgccggcgattatgaatttctgcgtgacagcgagtatcagttgtgccgcgagttttatgtggaatgcatgtgcaatgtgatgcgccctcgcgtgatcgtcgattatgagcgcgaaccgtggattcttgacgccggtaccgtgcgcgtcaccttcgatatgaacgtgcgtgcggcggttggaggattcgatgttttcgactccacactgccggtactgcccgtgcttgagccgggaaaactggtgatggaggtcaaattcaccgaattcctgccgcaagtggtgcgtgatctgctgcccggcaaggcgcaggagttgacatcggcttcgaaatacgtgctctgttatgacaaagcctcgtatttgcggggattcggctactggcaggaaggttggagcgtgccgagcctgtaaagccaagtctgtaaccagctggcatgttgactggcattccagcaaaaacaaacgttacgaatcaaggaagcaggagagaaagaaaccatatgagtgtcaatgacatgatcaaaaagtcggtgctgaaatccttcggccaatacaatgtgcccaaaatggcgctggcgttgctggtggcgttgatcgtcggcatcgtcatttactgcgtgtaccgccgtttctacacgggtgtggtgtattcgcgcagttttgccgttacgttggtgggcatgtgcgtgctcacctgcatggtcacgctggccatcagtacgaatattgtgatttcgcttggtatggtcggtgcattatcgattgtgcgctaccgtaccgcggtcaaggatccgatggatctgttgtatttgttctgggcgatcacgtctggtattgcggcgggcgccggcatgtatgtgctggtgattgttgccggattggtgatgatcggcatgttggcgctgttctactcgcgtcaagacaaggggcgcgtgtacattgcggtgatccactatgtgggcgatgtagtgggagatgagatcacgcgcgcgttcggacgcaccaaattcttcgtcaaatccaaaaccatgcgtggcgaacgcacggaaatggcggttgaagtattctgtgatgataaggacatgacgttcgcggaacgcgttcgcgccattgagggtgtcgaagacgtgacgctgatacagtacaacggtgagtatcatgggtaatcaattcgatgttgccgcaggcgcgcggctggaatccacgggcagggcgcccagcaacgacgaaatcgtacccagattctctcttgacgacatcaaccaggcgtttgacaacaacgaattctgcttctacctgcaacccaaatgcaatgctgaaaccggcgcaatcgtgggtgcggaggcgttggtgcgttggaatcatccggaatatggcttggtgtctcccggcgaattcattcctctgcttgaacgtgagtcaatggtcacgcggttcgatttgttcatctggcgttccgtgtgtgaaatgctgtcgcgttgggatggggaggggcgcaatctggtgccggtgtccgtcaacgtgtcgatgacggatatcgaggcgatcgatgtggcgcgagtgcttggcgacctgctcgatcggttcagcatcgatgctcgcctgctgcaggtggagatcacagaaagtgcgatcgcacataacatggatgtggtcgaagagaccattcgggacctgcatgcgcgaggcattgccgtgctgatggacgattttgggtcggcgtattcgtcactcaacatgttgaaggacatcaacgtcgatgccatcaaactcgacatgaaattcgttgacctgaatgctgacaatgcggcgaaaggtttgaaaatcatcgaatccgtgatcgacatggcctaccagctgagactgtcgatcattgcggagggtgcgcagaccgccgaacaggtgagcaagctgcgtgagctgggatgcatgtacatccaaggatattatttctaccgtccgctcactgtgggaaagatggaggatttgctggaacaccgcccggatgaccagcatttctggaatatctccaaagatctgatgcatcgcgactaccgcatgtcgacgaacggccgcagcatgctcgaatcgtcgtcattgtcggcgcatatttttgaaatccttaacaagggcgttgcggaactgtcccgactgaatctcatcacgggagaatatcgcaccatcaaacgcgatccgaaacttccggacgtgtatgcggatgattttcatgatttctgccatgcattggtttcaaaacggatcattcatccagatgatgccggagaattcctgaaacacacgcgattgtctgatttgcgcgaccaactattcagtaagaaaaaatcggaattcacgtattttagaagcgaggtcgaggcgaaaaccagcgtgatcgcattcggtatgctggtaccccctgattgcagcgaggccaatccgtgggccgtggtgctgatcggattcgacctgtcgctcgacctaatcgccaagaacatgaaggaaatctatcggcaggactccttgacgggattgctcaaccgcaatgcatacgacagcgatgtggagcagctgcggagcgccgacatcggggcggtggtgtgcgtgtatgcggatatgatcggcctgcacgaggtgaacaaccatctcgggcataagcagggcaaccgcatgttgtgtgagttcgcggacgcggcgcgcgcgttcttcggcgatgaccggttgtatcgcatcggcggcgacgaattcgtgataatcagttccgcgcatacggaagcgcagacacgcaagcagctgaactacatgcgtgagcgcttgcatacgcaaggctgcgagatatcagtgggcgtagcgtcgagcgagtcgacttccgatctgccgaaaatcgtcgaacaggccgaaaacgagatgcgccgcgaaaagaaggaatactacgtgcgaggcggcagcaaacgccagctgcgcgggctcaacaaaaaacttgaggacattctggtgcgtaatcaggatatggaatcgttgctgcggcatttgaacggacgctattcaatcgcatgcatggtgaatctgcgtactgactcacagcgtgcgatcatggtgcccgactatttccagaagatgcttgacgcgcatgacggttcgttcaaaagcgcgctgcatgactattgcgaacgattggtggcgccgttctgcaaagacagtttctccctgcttatggattacgacttcattcatgcccgcgtcgagtcggtcggcgtgttgcagtacgggtacacgcgaaacgacggagagaagttcctgcttacgattttcgccgatcgacgttccaaagacgagaccatgtgggtgttctccaaggatgatctgccgcaggtcgagctggaattattcgagtcataaggccgtattgtctggttttatgcgtttttgtgtgatgcgttcgcatattttgtgagaacgctcacagaaaaggttgtgtcgatttccagccgaatcgcaacatggggtctatgatgagaatcgttggtcatggcaacggttgctatgacacggcgaacaagcacagtcgcttaaaggagacatctatggtctatcgcatgattttcaaccagactgcatacttcggtcgcggcgccatcaaggagatcccgggcgttgccaagtcccatggcttcaccaaggcgttcatcgtcaccgatccggtactgctggaaaccggcaccgtcaagaaggtcaccgatgtgcttgatgaggcaggcatgccgtacgaggtcttcgacaatgtcaagccgaacccgccggtcgaatgcattcaggatggcgttgccaagttcgccgcatccggtgctgatttcctgatcggtctgggcggcggctccccgcaagacacctgcaagggcatcggcatcatcaccgccaacccggagtttgccgatgtgctctccctggaaggcgttgccgacaccaagaacccgtccgtgccgatcttcggcgtgccgaccaccgcaggcaccgcttcggaaaccaccatcaactatgtggtcaccgataccgccaacaagcgtaagttcgtggccgtcgacccgcacgacattccgatcgtcgccttcgtcgatcctgatctgaccgactccatgccgcgcggcctcaaggtcgccaccggtcttgacgccctgacccacgccattgaaggctacatcactccgggcgcctggagcctgtccgactgcctgagcatgcagaccatccgcatgattgccaagaaccttgccaagagcgctgacggcgacgttcctgcaggcgagcagatggcctacgcctcctacatcaccggcatggcctactccaacgtcggcctcggtctggtgcatggcatggcccacccgctgggcggccgcctcggcgttgcccacggcgttgccaacggcattctgctggcaccggtcatggaatacaacaaggacttcaccggcgagaagtatcgtgacatcgccgacgccttcggtgtcgaagatgcctacaccggcgatctcgagacggttcgcgaagaagccgtccaggccgtgcacaagctcaccgtcgacctgaagaacccgaccaccatctccgaagtcggcgcaaccgaagccgatctggaagcactggcccacgacgccttcaacgacgtgtgcaccccgggcaacccgcgtcaggccaccgaagaagacatcctcgccatctacaagagcctgatgtaatgcgaaaactctcacgaatcggcaatcgcatgcagcgaatctgcagtgaaacccgattgtgagagaacatcgctgaaagcattaaaaatcgtggtgcgaaacttcacaaagcattcgcaccacgatttttatatctgcacataaattacggattaatcgaaataatgtaaacaataatccgtgattatcaatcgcaagtattggaattactcgtgcttttcgctccactcctcatcggtgggagtgtcatcgtaccattcgcggccttcctgctcggccaattccatctgctcgttgatccacgccgcctccgcaggattgatatcggcggtgtcaagcaccttctgccataccggatacagcagatgcatcaccggatatagcgcggtgagcagaatctccggcttatgcttgcgcgaatgctgtggatgcgcgtcgaacgtgttcttgaaacgacgcatgtaattgttgaacgacgtgagcgacgtgtccatacggcgggcgctgatgccggcgatcatacgcgggcagtacacggttttcagatccttgcccagcagatgcagcgaaatatcgatatcctcatgcatcacatcggccttgtctcggcacacttcgtcagaaatttcgcgccaagctgaagcgcggaccgccatattcgagccaaacagcaacggctggccgccatcggccttgtaaatacgcttgcgtgtggaattatccccacgcaaaccaaaatggcggctcggcagatcgtaatacatcaccggaccagtggcacccatggcctccgggtcctcagtgaaaatgccggacaccacttcgacccaatccgggcgaatcatgcaatcggcgtcgaaacggcccagaatgtcgccggtggcgtggttcaaaccataatcgcgcgtcggaatcagcccctgctcctcatcctgatgcagcagacggatgggtgcttccgggtggtctttgatgaactgctccaccatggccaccgtcgaatcggtggaacgattgtcgacaacgatcacttcatggggcatcacggtctgcctagtggcattcaacaggcaatcgttgatacgctcctcttcattccaagcggggatgacaattgaaacgttcagcataactaccacaatagctcagcctgtacacgacgcctatcgctacaatagggagccatgagcgacagcgaacagcgaatgaacaatacgcagagcgaaaacggtgcgaacaccagcgaacagcgatgggacctcggcaccctgtttccagccaaaggagatccccgaaaaccaccggaatggctgggacgtgcgctgctatacatcgccatagccattgtggggtttactttctgctggcgcagctggggcaaaatcgaatacctggtgatcgacatcatcgtctcgctgttcatcgcgctcgcggtggagccggtggtggtgccgctggtcaagcatggctggaaacgttcgttcgcgtcgctgttctcgctgctgatgctggccgtgatgctcggcgtgctgttcacactgttcggcaacctgttcgtgcagcagatgatcgccttggtgaacggtctgcccgacctgtatgagcagatgtgccagttcgccagtcagtacgcgaatttccagcttcctgagatcaataatctcggcaatgagattctgaagaacattcagacgtcgtgggtcactgatttcgcgggtaccgcgctgaatacggtgtcgggattgttttcgttcctgattaacctcatgacgataatcatgaccacgtattacatttcagcggctggtccgaaactgcgtcgtgccgcatgccagtggatggctccggcggctcagcggcgattcctgttcgtatggacggtgagccagagccagatctcgtcgttcctgttctcccgcgccattctcgcgttgctgaacgcgttcttcacaggaatctgtctgatgctgctgcacgtgccctattggctaccgttggcgctgttctgcggtgtggtttcgcagttcattcctatgttgggtacgtatatcggcggcgcgttgccagtgctgttcgcatggggtagctgcggattgtggcaggccgtggcggtgctggtgtttatctgcgtgtatcagcagatcgagaatctgattttcgcgccgaagatctcccagcgcaccatggatgtgaacgatgccgtggcgttcctcgcggtgctggcgttcacctcgctgttcggcgcgttgggcgcgttcctcgcattgccggtggtcgcatccgtgcagacgatcttccgcacctatacaaagcggtacgagctggtcgattccccgctgatggacgatccggtgcctgaaaagaagtcgaagctggtggaaggtgccgaagtactcagcgagcatctgcacaatatgcctcgcgcggtgcagggatccagtgcgcatgtgcctattcccgacgaagtgcggcagttgcaggagcaggcgtacaatatcacccgttccgaggaatcgctggaatcggacgaaaccgtcgccatcccgaagcacgtgttggacaaaacggaacgcaagccattgcagggtcttgagagtgaaaacacatctcaggaatccaacgaaaatccggaatccggcaatgaacggaagaacggcgagtcgcgggaagctgaaggaagtacgaaaaacgcggatgacaatccaagaagtaggtggcgttaatggtactgctgagcgtacttgacattctgctggtcatcgtcggtggcgcaggggtggtctatcaggcggtgtgcattctcatctccctgttcaccaagccgatcaaatttcccgacgcgccgatggacaagcgttacgcggtgctgatttccgcacgaaacgaggcgaacgtcatcggcaacctcattacctgcatccaaacgcagacctacccgaccgaactggtcgacatttggcttgtcgccgacaattgcaccgacaataccgccgaagtggcgcgcaatatgggctgccatgtgatcgaacgcttcaacaaggagcttgtgggcaaaggctacgcgctgacgtatctgctcgatcagatgaacgattccggtgcatccgacccgtacgatgcgttcttcgtgttcgacgccgacaacaagctcgacaagcattacgtcgaagagatgaacaaggcgttccagtcgggattcaagattctcaccagctaccgcaattccgtgaatttgtctgacaattgggtctcttccggttctgcattgtggttcattcgtgaatctcgattcctgtcggcctcgcgcatgtggctcggcaacagctgccatgtagggggtactggcttcatgttctcgcgggagatcatgcgtcgcaataatggttggaaattccatttgctgactgaggatttggaattcaccatggattccttgctgcacggtgaccgcatcggctactgcggtactgcggttctgtatgacgagcagcctgtcaccttcgcgcagagctggcgtcagcgtttgcgttggagcaagggcttcctgcaagtgttccgttattacgggccggctttgatcaaacgtgccatcagggaacgtgatttctccgccgttgatttcacgctgttgttgtgtccgttcacggtgatcggtattgtgcgcattctacttggtttgctgtttgccgcatgcggattcgttacatggcagagccagttgagctcgttggccggttggacgtccggcattgtgacgtcggtgatcggcatgatggcgttggccgcgttgacgatcattgtggaacgcgatcagattggtgccaccaacaaggagctgttcgcgtacgtgctgagcttcccgatctacatgttcagctatgtgccgatctcgttccaggcgatgttcgccaagtcagaatggaagccaatcgagcataaaggatgacgttctttcgctggctttcgcgtttcctgctttttcgttttcatttcgatttctgcttatgactggagtgttgctgttccatggatgattcggctgaataccggcatgtgaaacgtcgtcgatacatcacggtggcgctttccgtggcgctcactacggtattgtgcgttggttatgtcgtggccgacattttcgacaagctgccgggtgttcttaccctgcaggaggtcgaacacatcaccgccaagacgccgggcaacgccgttcctgcggcaacggtgatcggagggcttgacgcttcaaagaccgtggacgcagctgcggcgaaggcgctgatcagccaattcgaaacggccgcctccgacttcggtgacgaatatgccatcgccatcgccgatgcggccggcaatgtggtcgccgagcatgctctcgacaagtcgtatacgccggcatccaccatgaaaacgttgacggcatatgcggtggcgaccacgcttgacatgggcgagactctggacacgcaaacctatctggaacagcgcgaggacggcacttcgcgattggtgctcaaaggcaatggcgacatgctgctcggtgccggtgcgtccgattcgtcgcatatcaatgggcgtgctggattgggaacgcttgccgcgaacacggcccaagcgttacgtcagcggggcatcacttccgtgacgcttgtctacgatgattccctgttcggtaacgaccgttggccaagcggcatcgccgaactcgattcaaaccacgtgtactacgcgccgacctcgtccatggcggtggacggcgggcgcaattggaacggtgccgatcccgccgatcccgatatgttcagcacatatccagctttgagcacgcagccagcccgcgaggccgcacaggtgttcgcgcaacgcttggctgaacacggcattgccgtgaactcttccgtggaacagggaacggtccccgagggcaccagtcccatcgcggccgtgcgttccgcatcgctgaatgagatcatggcgttcatgcttcggcattccgacaattccttggctgaggaattcggcagactgctggctttgcatctcggcgccgacaattcgccgaccggggctgtgcggtcagtcgaacaggtgctggttcagcagggaatctccaccgaaggtctcatcatgctcaactgttcgggtctgtccgaggagtccaaactcaccgcgcgtaccctgcttgaagtgcagcaacgcaacctaacgagcggtgccggagctgccgctgccgaaggactgtcggtcgtggggttcgtgggcactgccgcgaatcgtttgaacgatgacaacgaggctggtctcatccgtgtcaaaaccggcagtttgggagatgtgacctccatgaccggcaatgtgtcgcgtcacaacggaggcgcgttgagctttgccgtgattgtcaataatcccgatgatttcgaggccgcgaaatccgctatcgacacttttgtggccgcgctgccgaagctgtgatgccatggtgtattcgtctcgtttgcgtaagggtgtcggtgagttgcgggccgcgctgaaatcggccggatttggattgcaggatgcccgattcgcccgccatggcgagcacacgcccgatgcggacgctcctctgattatggtggcctgttccggtggccgcgattcgatggcgttggctgcggttgctgcgaaaacatgcgcttcattgggattgcgatgcgggacgattatcatcgaccatcagttgcagcaaggctctgccggggtcgcgcaaacaaccgccgatcgttgtgttgcgttgggtcttgacccagttcgtgttcgtgcgattgacgtacccgactcccgcggcatcggtgttgaggcagcggcgcgtgaagcacgctaccatgcgattgtcgacgcatgttccgacgcttcggccgtgctgctggctcatacgaaaaacgatcaggcggaaaccgtgatcatcggtttgttgcgttcctcgggcctcgatgcggtttgcggtatgaacggttccttcatacgagacggggtgcgttttctacgcccgtggctgaatatgacccgcgaagaaaccaccggcatctgcgaggatctgcggcttgcctggtgggacgatcccacaaatgggccggatgtggggaattcgggcggaaacgagcctcttcccgcgaactatccgctgcgatcccgaatacggcacgatctcatgccatatcttgaatcatttgcgggaagcgacgttgtgtcgaaacttgcgcttggagcgaggcttgccgaagacgatcgcgcatatcttgacggtgtggcgcaacgcgtgtgcgaacagggcgtaaccgtgaacaacggcgagataatcatcgacgcgcgtgcgttgcaatcgcaagacattgccatcagaagacgggtgattgtacgctcgcttgcagaagcaggcatttcgtgcatggcacggcaggttgaaggaatcgacaggctgatctgcgactggcacggccagaaaggtgtgaatcttcccagcggatattcagcatatcgccagaaacacgtcattcgcgtgtgccaagatggtgggcatgcgaatcgctgacgtacaagaagatattgatcacgagctgatcagcaaagaagagattgccgacatcatcaaccatgctgctgctcaggccagtgaagactaccgtggcaagaacccgctgctggtttgcgtgctcaagggtgcagtgaacacgcttgcggcgttctcacaggccatgagcatccaggcggagatggatttcatgagcttgtcgagctacggttccggcactcaatcgagcggcaagatcaccgtgcggcaggatctgtccaccgatgttcgcggtcgtcacgtgcttattgtggaagacattatcgattcgggcgtcacgttggcgtggctcgtcgatgaactcaagagccgcggtgccgcttccgtggagatttttgcgctgttggaaaagccggcgcgccgtaaggtggatgttcctgtgaaatataagggacgtgagattcccgatgaattcgtggtcggtttcggcttggattatgacgagcgataccgcaaccttgattcgatcgcggtgctgaagccggaagtgtatgaaggaggtcaggcatgagttttcctggtccgggacagtcgccgaataacaacggcggcggcaataacccgttcaccaatccgtttggacgcaacaataatgccggcaatggcaaagattccaacggcaacggcgataagtccaacggcaacggatccaatggcggtccgcgtccgttctggcagtccccatggctgtgggttgtggttgtggcattgcttgccgtgaccatgttccagattttcgccggaaccggttcccagaccatcgacaccaaggatggtctgcagatcctcaacggcaacaatgttgaatacgcgcagatcgtagacaacacccagcaggtcaagctcaagcttaagagcgactactccgctaccaaccctgataccgggcgtatgaagaactacggcaaaaacgtgcagttctactacacgtacgcgcagtccgcgaccgtggtcaaggccgtgcagaaggctgatccggtcaagggctggacggcgaccatgcagcagagcagcatttggacgtatctgctgacctcgctactgccgttcctcattatctttggtctgttctggttcatgatgagccgtatgggcggtgccggcggcatgttcggtatgggcggtaagaagaacagcggcaagctgctcgaaggccagactccgaccaccaagttcgccgacgtggccggcgaagaggctgccgtacaggaagtcgaagaaatcaaggacttcctgaaggatccgtctcgttacaaggctttgggcgcccgtattccgcgtggcgtgctgttgtatggtcctccaggtaccggtaagacgctgctggcacgagccatcgcgggcgaggccggcgtgcctttctattccatggcaggctccgacttcgtggaaatgttcgtgggccttggcgcatcccgtgtgcgcgacctgttcgatgaggccaagaagaacgctccggccatcatcttcatcgatgagatcgatgccgtcggtcgtaagcgtggcggttccggtatgagcggtggccacgacgaacgtgagcagacgctgaaccagctgctagttgagatggacggcttcaataacgataccaatctgatcatcatcgccgcgaccaaccgccccgacgtgcttgatccggcactgcttcgtccgggccgtttcgaccgtcaggtggccgtcgaagcgcctgatttggaaggccgcgaggctattttgaaggtgcatgccaagggcaagccgttcgtgcctgacgtcgatctgcatatgattgccgtgcgtacgccgggcttcaccggcgccgatctggccaatgtgctgaacgaagctgcattgttgtgcgcccgcgccggtgcgcagctgatcgacaatcgtgccatcgatgaggccatcgaccgcgtgcaggcgggcccgaagcgccgttccaagggcatggcgctcgacgaactgcgcaacaccgcataccacgagggcggtcacgcgctggtggcagccgccatgaacgataccgatccggtcaccaaggtcaccattctgccgcgtggccgtgcgcttggctacaccgcggtaatgcctaccgaagatcgttattccatgtcgcgcaaccagctgctcgaccagatggcgtacgctatgggcggtcgtaccgcggaagaggtcgtgttccacgatccgaccaccggtgcttccaacgacatcgaaaaggcgacgaacatcgcacgtcagatggtgcttgactacggtttctccgacaaactgggtgccatcaagtggtctgatgacgagcagagcgaccttggatcgctgaaccacaagtattccgcacgcaccgccgaaatcatcgacgaagaagtgctcaaactggtggaaaccgcgcataccgaagcgtggaacgtcatcaacgagaatcgtgagattcttgacgagcttgtacgtcagctgctcgtcaaggaaacactcaacgaaaaggagctcgcggaaatcttcgctaatgtcaagaaggcaccgaagcgtgaagtgtggctgagtgacagcaagcgcccggattccgacattccgccggttccgattcccgaatccctgaagaaaagcgcaggattgaccaactgatgagtgataccgaagcattcgataccctcttcgatgacaaggcccgtgccgcccatacggccgggcctgtcggctatgacgaggaaggcgtgcgccaggcggtacgtctgtttttaaaatccattggcgaagatccggaccgtgaaggcctgctcgacaccccagaccgtatcgggcgtgcttgcaaggagctgttcgcaggccttggccacggccccgaggaagtgctcaaaaccaagttcaaagtcgatactgacgaaatggtgctggtacgcgatattgaactcttctcggtatgcgaacaccacctgctgccgttccatggcgtggcccatgtcggctatattccgtcaaacggccaagtggcgggcttaagcaagcttgcccgactggtggaactgtatgcccgacgtccgcaagtgcaggaacgcctcacccaacaggtggccgacgcgctgatggaaggcatcgaagcacgtggcgtgatcgtggtcaccgaatgcgaccacatgtgcatggccatgcgtggcgtaaagaaggcgcaatcgcgcacggtcacgtcggcggtgcgcggctgcatgcgagacgcgacgacgcgagccgaagccatgagcctgatcctgtcgcagcattcgtgatcgacgcggccgcagcaagtcgaatcgtaaataacaataaccggatataggaggggaaaccggatgaccattgatatgaaagcgattcatgatagtgaccgtactctggtgatgggcgtgctcaacattacggaggattcgttctccgatggagggctgtggctcgatcccgcgaatgcgaaagcgcacggcgaggcgatgatgaaggatggggctgacatcatcgacatcggtgccgaatccactcgccccggagccaaacgcgtcagtgaggaagatgagcaaacccgcgtgctaggtgccgtggatacgttgattccggaaggtacggtgctgtcaatcgacaccacacgcgcatcggtggctcgcatggcgttggagcatggtgcgcaaatcatcaacgatgtgtccggcggtcggctggaccgcgaagtgccccatgtggtggccgagcattcggaaagcctttacattgtgcagcattggcgcggctggcttgccggctccgcaggcgacgtgcctgacgctgatacgtccgtgtacgccaatggcgtggtggatgacgtgtatgacgaactcatgaagcaggtcgacgacgtgcttcaggcaggcgtctcaccgtcacaaatcatcatcgatccgggtcttggattctccaaaccgagcgtcgagcataacttcccgctgatgacggcattggagaggttcaatactaccgggtatccggtgctgattggagcctcgcgcaaacgattcgtcggcgcggcgcttgccgatgctggtattgacaagccaaacatggatagcaaagacaatgcgaccgccgccatcagcgccctatgtgccgaacatggagcgtgggccgtgcgcgtgcatgacgtgaagaaaagccgcgatgcggtggcgatcggcaacgcgtggcgtgccttcgctaacgactgatgcacggtgctcgcatacgtcgtgcgttcccgacagcgtaggtgcggcaacgcatttccaccattaaaccttgagatatgcaaagaaaggctggcatggatcagattcgattgactggcgttcgcgcggtcggcaaacacggagtgcttgatttcgaacatgagcgtgcgcaaacgttcgttgtcgacgccacgttgtttcttgatcttgcgccagccgggtattccgacgacctgcgggacaccgtcgattacggtgccatcgccaaaggaatagtcgccatcatcgaaggcgaacatgtcgatctcattgaaaaactcgctgatcgcatcgccagcatgattcttgaatatcctgccgtggcacagacgcaggtgaccgtgcacaagccgagcgcgccaatcgtcgtaccattcgacgacgtgagcgtaaccgtggaacgttcccgtgaaacaacttcggctgcatcgcaagtgcatcatgccattattgccatgggtggtaaccaaggcgatgtggcggccaccttgcgtgacgcggtgcgttcgatcgacggactggcatccactcaggttacgggcgtttcgccgctgtaccgtactgatgcgtggggtatgcccgatggtacccccgatttttacaatgcggttgtttctgtgaccactaaactgtcggcaatggaactgctgcgaggactgcagcgcatcgaagtcgaacatggtcgagtgcgtactgaccattggacttcgcgcacacttgatctggatatcatcgattttgacgggcagagcaacgatgatccggatctgacgctgcctcacccccgtgcatggcagcgtgcgtttgtgctggggccgtggctggcactcgagccggacgctgaattgtcgggtgaacatgccggttccgtggcccagctattgcacgaggcatccgaccgcgaccatatcgacgaaatcgctgatgattggatggtgggaagcccgaccggctacggtatcgacgaccttgcctgcgatgccaataatgcgggcgatgcggatgatatggacgaagcgtatggtgcgatcgattccagcgatctgccggaaggaaccgccgcagccaaagcggcggcacttgcttctgcacagctagaacccgcatcgaaacgtgcggtgatctcactcgatagcccagcaaccgatgccgaacagcagttccgcatggccatcgtcacgttggacggcattcccggcaaccaagtcgagggcatctcacccctctaccatgtgagccaactcgacggactccccgacaaaatggctgcggtaatccagatttccacgcgcatgggcgcccatgatctgatcgaagcattaggcaatgtggaagcctccattggcgaagaccttgatctcgacctgatcgacatggaaggcgtggaatgcgacgaacccgactgcaaggtgccgtggcccaccgcacgcaatcatgccgcagtgcttgcgccatggctcgacatggatcccgatgcacgactgggtaaggatccggtatcattcctgctagccatggcccccgatgccgcgcaggtgggactgctgaccgacaattggattatcggaggtacgctatgaaagcgcgcagaaccccttggtggtgctacgttctcgctgccgcattaggattgcttgccggaataggattggcgaaatatggcgagatttcaggttttccattggtcggcgctccatggattgtgcccgtggtgttggcgattctgggattcgtcgtgctttatatggcattgcagatccacaaatacaccaccacagatcccgaaaaacgcgcgcagctgaaacctttggacccgcagaaggcgttcgccacactggtgtcgtgcaaagcgttgggcgtggcaggagcgtcgttagccggctggtatggtgggcagctcatcatgagcctgccgcatggtgaggcagcgttctacagccaagccatcctcgaatgcgcgatcgcggcaatcgtatgcataatcgatatgatcattggcattgtgggggagtggctgtgccaaatcccaccaatcgacggcccggaaagtccgaaaatgaaaacggccacgcaacgcaatcgttacgcggccgcggctaccaaatcagcgacacaatcgaaagtctgattacctcacttcttcagatcctcttcgggaacgcgaagcatcacctcctgtgtcatgcaggcaacaagctcaccatcctgcgtatacaccttcgcctgacccaagccacggccgtgagctgcagtaggcgtatcctgcacatacaaatgccactgagtgatatcaatatcgcgataccaccacatcgaatgatcgatcgaagcgaacgaaataccaggcgtggcaatactcaacccagcgcgacgtaacaccggctccaacatcacctgatcgcagcccatcgccaacatcgcacgatgcataacctgcggaacatcaaccgtgccgtcagccttcatccacaccatctgtttaccggaatcattgctggcgctcttcttatcggcacccaacataatcgtgcgcgtcacatgacgaatgtcgaacggcgacttttccgcataatatttggcaaacgaagacttctcggcaaatggttccataagctgcttcgcgctggtcaacgcttccggctccggcacaccctccggcatcggatcagcgaactcaacaccctcctgaccctgctcctgaaaactggcgatggcggtaagaatcgaaccctgagcctgcgtgacatttacacgacgagctgaaaacgagcggccatcacgcagattctccacatcaaacagcaaatcctgacgaatatcaccggcagaaatgaaatagccatgaatcgaattcggcaggcgagacggcgacaccgttttggatgcggccatcatagcctgcgcaatcacctgaccgccatacacgcggccagtggggaaatacaggctttcaccattcacatacatatgattgcggtacatggacggcgtgcccagttgaagcacctttgctaaccgttgcaatggtgtgattgccgtttctgtcatgacactcctcgattcttttgagtcgtataggtaacgcttcgttccggattcgagtctacgcaagggcggtaaatttcgccggattgttttgtaacgaatgcgtgagaagcgtgaacggcaggtaatcgtcaaacgattcgcatacggcaaagcgccgcacttcgtaacgaagcacggcgctttactgaaatatggggttaaccggccctgcaattatggccttgctttgcaaggctcattgttaccctcgttcggttctcgcctcactcaggttgaccctacgaacagtccactggactgttcgcttaacaggtcagcctgtggccctgcaattacggtcttgcttcgcaaggctcattgttgccttcgttcggctgtcgcctcactcagactaagcctacagacagtccataggactgtctgcttaacggcttagcgggtcagcttgcgatggagacggtgggggcgagccgcgtcttcgccaagacgagcgatacggttctcctgataggcctggaagttgccttcgaaccagtaccacttggccggattctcatcatcgccttcccacgcgagaatatgcgtggccacacggtcgaggaaccaacggtcgtgagagatcaccacagcgcagcccgggaagccgagcagtgcgttttcaagcgattcaagggtttcaacatcaagatcgttggtcggttcgtcgagcagcagcaggttgccgccctgcttcagagtcaaagcaagattcagacgattgcgttcaccaccggacagcacgccggtgagcttctgctggtcggaacccttgaaaccgaaggacgccacatacgcgcgggtcggcacttcaacgccggcaacctcgatgaagtcaagaccgtcagacacggcctcccacaggtttttattcgggtcaagaccagcacgattctgatcgacatagctgatctgcacggtctcaccgatcttcagtgagccagacgtcaacggttcaaggccgacaatggtcttgaacagggtggacttacccacgccgttcgggccgatcacgccgacaatgccgttacgcggcagcgtgaagctcaaatcgtcgatgagcacgcggtcgccgaacgccttgtgaatatgctcggcttccagcacagtagagcccagacgcggaccagccggaatctgaatctcggagaagtcaagcttcttattgttacgagcctcctgctccatctggtcgtaacgttccagacgagccttgttcttagcctgacgggccttcggcgaagaacgcacccaatcaagttcgctcttcaagcgcttggcgagcttggcgtccttggcgccctggatctccatacgcttggccttcgtctccaagtacgtggtgtagttgcccttatacgggtacagctgaccacggtcgacctcgcagatccactcagccacgttatccatgaagtaacgatcgtgggtaacggcgatgacggcacccttgtactggtgcaggaactgctccaaccacagaatcgactcggcatcaagatggttggtaggctcgtcaagcagcagcagatcaggagcttccagcagcagcttgcacaatgccacacgacggcgttcgccaccggagcacaccgtcaccggagtatccggatccgggcactgcagagcatccatagcctgctcaagctgagaatcaagatcccaaccgtttgcggcatcgatatcgttctgcagcttgcccatctcatccatcaaagcatcgaaatcggcatccggattggccatctcttcgccaatctgattgaaacgagccaccttttcagcgatctcaccgaacgccatcttgatgttctcgccaacagtcttggtgtcatccagcggcggttcctgctgcagaatgccgacggtataacccggagtcaaagaagcttcgccattagacacggtgtcgagtccggccatgatcttcagcagcgtggacttacccatgccgttcgggccaacaacgccaatcttcgcgcctggcaggaagctcaaagtcacgtcatcgagaatcacacggtcgccgaaggccttgcgggccttgatcatctggtaaatgaattcagccaatgttgtgttccatccttaagaaacgttggaattccagcgtgttgcatgagcggtcaacggaaactcaatcaaggattccggaacgcaacccacgcacaataccgtgcataattatcccataccccatctacacggcggtatgggcgaaagtcgtgcgctcaggcagtaagcggaagcagcagatgctcatgcaaagcaggacgaacgatattgtcgaaatcgccagattccgggcattgaatcgcaacaaccaaaccctgcttcggcaaaaccgtagtgatctgaccgtacgcaccatccgcacgatatgcctcctcataaggcgacatccagaactgatagccataaccgcacgtccaaatattgctgtacggagtgtcgatctgcttgccggaagcctgcttgacccacgattcgctgacaatgcgcgtgccatgccaagtgccatcattcaaatagacctggccaagtttcaacatatttgcaagcgacatgtagatcccgccgcctgcaatcggatgaccttgcgggtcacattcccaaacaggccaaccctgatccaacttggaaaaaatcatgccatacaaatactcgccaagacgcatgccggcagcctgctccaacatgcggcccgctaaatcagaatccgcagacgaatagcagaacgtgctgccgggctccgcctcaaccctgcgagagaacatgtaccgtaaataatcaggcgcaccaacaccactgcgccggtcagggttcatcaaatacgcatgattgaaaccgctcgacatagtcagcaagtgcctcagcgtgatctgacccaactccagttgcgcatcggagggaacatactcggggaacgagtcgaccaatcgcgaatcgagcgacagcaagccatcttcaatcgcaatgccgatagccgtcgaaacataacttttcgtatgggaataaatattacgatcctggtcgggaacgaaatgacgttccgcgataatggcgtcgccatccgcaatcgcaacggcttcgacgggcagggactcgctttcaatgagtttgacgaaatcgttgaacatattgatggcacccatgaaatctcctttgacactgccttacggtgcattacggaaactgtaacgtaaggcggttacgtacgattgttacatcaaacgatttttcctaagcctgtcgctagatggagcgcccgaaaaaccgctaggtgccatgcctgaaaaagtcgttaaatgataatgccttcgcaatgatcgatctcgtgctggatgatttgcgcggtgaaaccagtgaatgtggcatgacgctcgcggaacttgcgatccgcatacgagacctcaatgcgctggaagcggaccgtgcggcgctcgcctttgagggacagacagccttcggaggcgtcgtaggcgccgtctttcgcagtgatcgtcgggttgaacattacgaagatgcgatcgccgaaatcctcgtccacgaatgcaatgatgcgcttcgagacgccgatcatgtttgcggccatgccgacgcagccgttgcggtgtgcatcgagagtgtctttgagatcctgcgcgacggcaagatcctcgggcgtattgagcgcctccgccgacggctggctcaaaaacggaatggacgtcatgatttcgcgctgcatgtgatgtttcctctcgctggttcctttgctggtctgccaacattgtatggcgttattgtgcgacgccgtacggcgatgggacggatggccggttcgcgcctatccttttacggaatgtctcgtggcgattttgaaatgtgggaccgcaatcgacgcaatatgcttggaaccatggatgacatgcctcaatatcggaaatacatgacgcaggcgctggaactggcccataagggagccggttgggtgaatccgaatccgttggtcggcacggtggtggtccgcgacggcgagattctcgcagccggataccacgaccgctaccgcggaccgcatgcggaacgcatggccttcgactacgccgacgagcatggtgccgacatgcatggagccacggtcatcgacactctcgaaccttgctgccatgtcggatcgcagccggcatgcaccgatctaattctttcgcacggcataacgcgcgtcgtggtcggttcgatcgatccgaatcccatcgtggccggcaaaggacttcgcattcttgaggaaaacggtgtggaagtggtatatgacgtgatgcgggctgaatgcgacgccatcaatcgccatttcttccactacatcaccacaggaatgggggtgcggacgaaatgttgataaatcaacgttttttagaccctttttcctatttgacaaatgatttaactatagctattatgtgcttcgtaaacagaagacataaatttcgaaaggaggatgattcgtcaagtgcagtggttccgcaggacggaacccaggttttctgtttgtgggcaacaacgatgtgccgtttatttctcgcatcggcattcgtcggtgcgggagttcaccgatgaaagggaatgatcaatgaagatgaaaagattcgtggccgcggccattgctgcagtctcgtgcctgagctttgccgcatgtggttctgacaccgccagcaaggacgagaatgtgattcacatcatgtcctcgggcgattcctccgcgaatatggagcgggcgctggtcgacgaatacaacaagaccgccgatgtcaaggctgtccttgatctggtgacaagcgcggattatcagaacaagctgcagacggtcatgtcgaacccgaagtccgattcggctcccgacattttcttcaattgggcggatgctttgatgatccagtacgctcgcgccgatgtgagcgccccgcttgatgagtatatggagaaggatccggaactcaaggacaacttcctgccgtccattcttgacgccgccaaggtcgatggcaagtattacggcattccggtgcgcggagtccagcccattgtgttgttctacaacaagaaggtgctctctgacaacggcatcgaagccccgaccaccttcgacgagttctgcgatgcatgcgagaagctgaagtccgcaggcctgacgccgatcgcgctgggcggcggcgaccagtggccgacgctgaactggtattcggtcatctatcagcaggtgatgggcaatgacgacgtccagaagatgatggacggcggcgtggacgagtggagctcgcccaagagcaagaaggcgctggagattatccgcgacatggtcgaaaagggatacttcggcactacgtacgattcggtcaagcacaccgatggtgccgccccggctctgctggagcaggggaaggccggcttcgagctgatgggctcgttcggctattcgggccacaaggccgcggcccctgaattcaccaatgatgatctcggctatatggtcttcccgcccatcgatggggtgaagggcgacgccaaggatctcgtcggcaacccgtgcaactacttcagcatgaacaagtacaccaagcatcctgaagcctgcgtcgagttcctcaagatgctgtattccgataagtgcgtggaggatcagctgaaggccggcaacctgcccgcaacgaccaacgccagcgagatggtggagaaggtcgtggacaatgcctccgacggggctttcctcgagtgggagtctcaggcgctgaccgatgctcctcacttcatgatcacttggactccgaaccatgtgtcctcgtcgtctcagccgatgctcgacggcatgcagcagtatttcaatggctccatcgacatgggcaccttcatcgacgagatgaaggccctgccgaccgagtgatttcacgataggacagaccatggcaaagcgtaactcatctgagatgcagacggggaacgccgagggtcaggttcgtcgcccaaagaagggcgcctcctttgtcggaggcgcccggccttcgggcctctgggccgtgcctgcggcggtgttcttctttatcttcggcatcctgccgctgtttattgtggtggggttgtcattcttcaaatggaatggcttgggcacgccccagttcgctggagggcagtactgggcccagttcattcatgatcccaaagtcatgaaaagcgtcggcgtcacgcttacgctgacgattctgggcatcgtgacgcaaacgccgctctcactgttgcttggcgcctgggcggcgggccggcagcggtatcgtgcggtgtataccgccatctacttcattccatatctgttgtccggcacggccattgccgttgcctggcgcgccatgctcgatccgaacttcggcatgccgtcgaagatgcgttggctgttcggggacggcaatatcttcggcaacgcctcctcggccatcgcggtgctggtgttcgtcagcctgtggcagttcactcccttccatgcactgctgtatcagggggctgtccgtgccattccgaagactttgtatgaggccgcttccatcgatggcgccggtaggattcgtcagttcttctgtatcaccatcccccaagtcaggaacacgctgattacctcgctgctgttccaggtcgtgggcggcttgaccgcatttgacgcgattctggtgttgaccaagggcggtcccggcactgatacgcagaataccgcgtattacatgtattcgacggcgttcaaggcgtacaactatggctattcgagtgtcatcgccgtggtgctgatcgtgatagcgaccatcctgtccctggtgatggtgaaggtgtccggatatgacaagatgcgtagcgaattggagggtatctgatggccacgaaacatgaaacgggcgcggtgaaaattccgaagcgccgttcgctcgaacgtccaaactgggctgccggtgttttgtcaaccctatggctgctggtggtcgtcgtaccgctgtacatcatggtcaaggcgtcgattgaggacaagcctcattattccgaagaggggccattgtcgttgccgacgatgttcaccttagacaactacaccaatgcgttggatcagggattcctgcaggcattcatcaacacggcgatcgtcaccgtttcggttgtggccatcgtgctgatcgtggtgccgccgttggccttcgccatcgtccgcagccgaagcaaattcgtgaatggcgtgttccagatcatgctgctgggcattgcgatccccgtgcaggccatcatcgttccgctgttctttatgattcgctccgttggcttgtacgacaacctgatcagcgtgattgtggcgtctgccgcattctcgattccgatgtgcaccatcgttctgacggcgtcgatgcgtcagatcaccaatgagttgtatgaggccatgtcggtcgacggcgcgtcggtggtgaggattttcttccagctgacccttcccatgtcgaaatcgggactggcgaccgtgatcatctactccgcgatgggcgcatggaacaacttcatgttcccgcttatcttgacgcagtccgattccaaccgcgtgctgacgctgaacctgtaccagtatcagagccagttcggtatcgacatccccggcatgatggccgcggtcatcctgtccgtgctgccgatcttggtggtgtacttcatcggacgtcgctcgctcgtcgacggcatgatgggcatgggcggcaagtgagtatggtgccggggacgccataatgaggggtgtccccggcatcgtctccgtccaaatcaacgtcttcgatccgcacatggaggtgcggacgaatggtgaaagggtaaattgtaatgcagtaccatgtttctcccgaaggttctgataccgcccagggtgggccggataatccgttccggacgatagggcatgccgcgcaggtcgcgatgcccggcgatatcgtcatcgttcatgacggcgtgtatcgggaatgggtcgatccgagacgcggcgggacctgcgaggccgatagaatcgtctaccgcgccgccgacggggaaaagcccgtgatcaaggggtccgagatcatctgcgggtggagccgatacaaggatgacgtctggcgcgtgacgttggacgacgccatgttcggcgattacaatccgtacaggcagccgctgttcggcgattggctcgcgatgccgtcgcgtggcgaggaccccgacaaacatccgggcatggtgttcctcaacggcagggcgttgtatgaggtgacctcgctcgaggatacttttgcgccgcggtaccgtgaccatgtcaaggactatgtcacggatgtcgcatgtgcgatcgacgatcccgagatgacccaatgcgtatggtacgcccgggtcgaggacgaccgtacggtgctgtacgcgaatttccatggcgccgatcccaatgaggaatgcgtggaaattgcggtgcgtcggtcctgtttcttccccagacgccatcacgtgaactacatcacggtcagcgggttcgaactgtgtcaggccgccacgcaatgggcgccgcccacctcgcatcaggttggcgccatcggaccgaactgggccaccggatggattatcgagcgcaacctcgtccatgacgtcaaatgctcgggcatcagcctgggcaccagcgaggaaacaggcgacaacgaatggtatcggaccgagcgcaagaccggtcaccagtaccagctcgaagcggtgttcaaggggctgcgtatcggatggaagaagggattcgtcggctcgcatatcgtgcgcgacaacgtgattcatgattgcgggcagaacgcgatcgtcggccatatgggcggagcgttcagcaccatcgaacataaccatatctaccgcattggtgcccggcgcgagttcttcggctgggaggtggccggcatcaagcttcacgcggcgctcgacgcccgcatcctggacaactgcgtgcatgactgttcattggggatgtggcttgactggcaggcccaaggggtgcgtatcagccgcaacgtgttctacgacaatgcctgcgatctggagatcgaggtcacgcatggtccgtgtctgatcgacaacaatgcgttctgttcggcgatgacatacgacaactatgctcaggggacggcgttcgtcaacaatctgatcggcggcaccatctcaaacaacagcgtgttggatcgtttcactccgtatcattacccgcattccacggaggtggccggcaacgcattcgtctatggtggcgacgaccgatacgcgtccaacatcttcctcgacggcgccgggaccttcgggtccacgggactatccgcataccgcggatacccgtccacgatggcggagtatctgcaaagcgtccacgacatcttcgcgtccggggtcacgaatgggcacgatccgcagcccgtgcagatgctgtacagctgggacaacgcctacgtcggcgaggccgaaggccccgaaggggagcaggggaccacgcatgtggcgtcgcccgtcaacgtccgttgcgagttcaagggggatgacctgtacctgctgttcgattgcccgacggagcttgcggacaagaaggcggccgtcgtgggcacggctgatctgggcgtgccgcgcatcgtggatgaacggtatgaggagacggatggatccgatatcgtgatcgacaccgacatcgttgggcgccggcgcgcggaactgagttccgtggggccattcgctgagcttcatccgggatccaaccgtcagctggcctggtgtggcgcggtccggacgacgcacgacgcctgcccctcctgcggcgtcaaggaatggtgagaccatgaagatcaccaatccggtgctcaccggcttccatgcggatccttcgatgattcgcgtcagagacacctattacatcgcgaactccacattcgagtggttccccggcatccgcctgcacgagtccaaagacatggtgcattggaacacgttgccgtaccccttgggcgccgaacagcttgacatgcgcggcgatccggcgtccggcggcgtatgggcgcccgacttgtcctatgcggacggaaggttctggatcgtctattccgatgttcatatcgtcaacggcgcgttcaaggacgtcgtcaactacctgacgaccgccgaggacatccgcgggccgtggtcgaagccgcttcgtctgaacggcgtcggattcgacgccagcctgttccacgacgacgacggccgcaaatatctggtgcagcagacgtgggaccatcgtgaatacaagcatcagttccacggcatcacgctgaccgagttcgacacggcgacgatgcggctgaagccggagacggcccgcacgatctggatgggcgacgatgtcaagctcgtcgaggggccgcatctgtataagatcaacggctggtactatctgttctgcgccgagggcggaacggtatggactcatcaggaatccgtggcccgctcccgcacgctcgacgagctgtcgttcgaggcctcgcccacgaacccgttcatcacgaacttcgacatcccaggcagctacctgcagaagcagggccacggcgcgctggtggacaccccgtccggcgaatggtactacgcgtcgctgtgcggccgcccgtggcatcacgagacagagtcgttcaccgacccgcgcggctggtgcacgctgggtcgtgagacctcaatccagaaggtcgagtgggctgaggatggttggccgtacatcgtcggcggtcatggcggcgaacgttatgtggaggcgccgaaggacgcgatcgagacagtcgcgcccgcaagccgcgatcagcacgacgagttcgacgccgacgtgctcggtctcgactggaacacgttgcgtgtgccgttcgacgagaagatgggctcggtcggcggcggcagcctgaagctgatcggccagggctcgctgtgcaacacgttcgacctgtcgctggtggcccgccgctggcaggcgttcgatttcgacgccgagacctgcgtggcgttcgatccgaagacctaccaggcgatggccggtctgacgaactactacaacgaccagcattggtcgtgggcgtttgtcacgtacgacgaggaccgcaagtgccgcgtgatcgaggtggcgcagaacgaccgcaacaattacacctcgttcttgcgcgagaacgccgtagtggtgcccgagggcgtcgatcgcgtatggctgcgtgccaaggtgcgcacccagtggtacgcctacgaatactcgttcgacggtgagacctggaccgaattgccggtcaggctcgacgcgaggatcctctccgacgactacgtgaaccagacgtacggcggcttcttcaccggtgccttcgtgggtctggccgcggtcgactattccggctacggcgaagtggccacctttgaccacttcgactaccgggaaatttctgggatggaagactgatagatggtcgtttcgcgggatgtcttcccgcgaaacgaccatatcaataatcagtattgttttggcgcatgatggcaacgttttgcgaagatatgagaacgatatgagcagtgaagtatgcaatgaggtaggaatggctctggaatgttccgcccgacgagccgacggcgcgggacggtatgtgcgtcttgatgaatgcggtcttgccgtcgaagtcgactggcacggaggaaacgggtcccccgccgatccgtggcgttgcacggtaacggtgcgcaatgacggctccgttgcgttcgaaggggtcgttcgcatcgatatcccgattcgggctgacggtgaaccgcggttcttcctgccagggttcatgtatgggcgtaatcgtggagaggcgccgctgcgaaccgcgacgaaatttccccggcttcgtgaacggagcgaactgccagcctcatcatggtggatgattcgaggagacaggctgtccaatccatgtgcattggccgtgacccgttcccgtgtcgtcggtgtggtgtccagcccctatctggttgaccgcggtgatgggatgttggtcggacatgaggcatgtgatgaactgcctttcgtccagtatgcgggattcagctgcatgttgccgacgcctggaatcgtgccctgcgacgaccacgcctcggtgggcgtgactatcggctatgagaacgcgccctggttgttcgtcagctcgacggatatccgcgaacgtcctgactcggcggaagggccgattacactggcgcctggaggcgcggcgattatgcgcttggacgtcgtcgacgctcccgcccgggatgaacgggctatcataccggtgctggaaaccgtataccgtcgttttcatgaaccgccgcgtcaggtcggcgctcccgctcgggctatacgcgacattgcagtcgccgttgatagagacgcgtggctggaggacgaacacatgtacgcggggtttgtcttcgaccatcatagtccgggagatgagatcatcgaaggtaagccgtatatgtaccgccggttgggatcgagtagttggaccaacggcatggcctccgcggtaccgatgttggcgtcggcttggcggttgggggacgatgctatgcgtcgtcacgccctcgacggcatcgagcatatcatccaacattgcatcaacccgacgaacggattgccctacacggcggtggaacatgagcggtggagcaaccgcggttggtggttcgacggactgtccaatcccggacacagcgggtaccttgtcgggcagacgatgtactcggcgttgcgggcgtggcagatcgaacggcggttcggcggaatcgatcactcggactggctgaagatcatcgggaacgtcattccccgattggcggcagggcgcaatgcggttggcgaatacccattcgtgttcgatgagatggacggctcaggagccgagtacgaatcgttcggcggtgtgtggtgtctggccgcatccgcgtattgggctttgctgaccggcgaccactcggatctggatgggatgctcctatccgaacgtcattatcataaccggtacgtggcgcatatggaatgctatggtgcgccgctggatacatcgaaagccgtggattccgaaggtatattggggtatatcaaggcggtcggatgcctatacgccattaccggagacgctatgtatcttgaccggatgcgagaggcgttcgcctatgaatgcagtttccgtttttgctggaattcgcccgttggcgtaccgcctctgaacgaagtcggctggtcgagttgcggaggcagcgtcacttcgaccagtaacgcccatatccatccgatgtcaagtgtggccatcgaggatatggtttattacctccgatatcggaacgacacatatatcgcgtcgcgtttgtgcgatgcggtcggctggagctgccagacatataacctcaaggatggtgagtacggatatgggcgggtcggctggatgtcggaacggttttgtcactgccaggggtttttggacgagaggtacccggatggaagcctgtgcagcacgtggcgttgtctgatgccttgggcggcgggagcgatcttggacggtctgacgggtctgtactgggacgtcatgccgcatgatgagttgccaaccgtcaccatggtatcgcgggcgatgggttgcgtccatgatgagaaaggatgaaacaatgggtgcgggagccatgggtcatatggagaccagcatgttcgaacagtgcgggtacggccgcgaggccatccaggcccggctggaacgcaactggaccgagatgttcgaaggtccggacaagatctactgggagaacgacgagggccttggctacgtgatggacaccggcaaccacgacgtgcgcaccgaaggcatgagctatgcgatgatgatcgccgtgcagtacgaccgcaaggacgtgttcgacaagctgtggggctgggtcatgaagtacatgttcatgaccgagggcttgcacaagggctacttcgcctggtccgtggacctcagcggcgtgccgaacgccgacggcccggcccccgacggcgaggagtacttcgcgatggcgctgttcctggcctccgggcgctggggcgatggcgagggcgtgtacgagtactcccgccacgcccgctcgatcctgcatacctgcgtgcaccggggcgaggatggcgagggctacccgatgtggaatccggagaaccatctgatcaagttcatcccggaaaccgaatggaccgacccgtcctaccatttgccgcacttctatgaggtattcgcacagcgtgccgacgaggccgaccgcccgttctggcgcgaggccgctgccgccagccgtcggtatctggtcaccgcctgccatccggaaaccggtatgaaccccgaatactcaaactatgatggcacgccgcatgtcgacgagcgcgaccactggcacttctattccgacgcctaccgcaccgccggcaacatcgggctggactgcctgtggaacggcgtcgtgcccgagctgtgcgatgcgaatgcgcgtctgcagcgtttcttcctcgaacacgaccgcacctgcgtctacgcggtcgacggcacgccggtggacgagaccgtgctgcacccggtcggcttcatcgccgccaccgccgagggctcgctcgccgcgatgcactcgcaggagccggacgcgctcgataatgcgatccgctgggtgcgcctgctgtgggacacgccgatccgcaccggcacgcgccgctactacgacaacttcctctacgcgttcgcgttcctcgcgctcgcgggcgaataccgcgtgtggtgaatatggctgaaacaaggagttggacacaatgaaatcgacattgcatatcaatccgttgttcggtgaaggatgcgtgctgcaatctggcatgccggtgaggatctggggtggtggccgccccggttccacgatcgaggtctcggtcgcggaacggcgtgccgatgccatcgtcgacgccgatggcgcgtggacggtcacgctcgaaccgttggacgctggtggtccctatcgcatgacggtcagtgaaacgtcggaagcggcgacgcgggaatcattgagccatgacgtttatgcgggcgaggtgttcatttgcgccggacagtcgaatatggaatatcagatggaatttctgcactggcgttatccgtccgaattcacgcgtgaagccgactcgctgctgcgacattgcaaagtgccggtcagattcgatttccacgggccgcgtcatgaattcgatgaaccggtacaatgggttggcgctgcatcggatacccttgatgagttcactggaatcggctacttttttggacgtatgattcgggaatcgttcggtgtgccggtcggtctgcttaatatcacgctcggcggctcaccgatcgaatcatggatggatgaggagacactcgctgcatggccgaggatgctcactgatctggcaccataccggaatgatgatgaagcccgtgtgcgcaatgagtctagcattgaggcccgcacccggtggcatgaagatctgcgtgtgcgagaagtcaaccgatggaatgaggatgcggaaaccggaaccgtgaacctgcccgcattcctgtcggatgccgatcctcgtctagctgggttccgcggtgtgatccgcttgcggcgtacggttatgttgccgacgtatgcggttggacggcctgctgtgctgcacttgggggcgatggttgattcggacatcacctatgtgaatggtgttgaagtggggcggtccgagcaccagtatttctcccgtgactacgttgtcccggagaatgtgctgaaggccggccccaacgatgtagaagtacggctggtgtgcgaacgcggcacgggccggttcactcccggtaagcgcatgcatctggatgtgggcgatgactcgttcgatctgagcggagcttggcggtacatgatcggtgccgaaatcgatgaggattgtccgacggaagattccctgcagtggaagccattaggcctgtacaacggcatgaccgcgacctgcgccgggtacggcgcccgtgcggtgctctggtatcagggtgaatccaatactggtgatgtggccgatgagtatgggcatatgcttacggcgatgatcggctgctggcgacatgcttgggatcaagaacgattgccgttcctgattgtgcagttgccggtattttcaatcgacaatgtcgaggatggtggatgggccttggtgcggcagcatgaatggcaggtgtcgaagaccgttgatgatggggcaacagtggttgcgctcgacgccggtgaatggaacgacctgcatccgtggaacaagcgtgtggtcgccgagcggttgttccatgcggcctgcggtcttgtctatggtaaaaatgacgcaccgaaatcacctgagccgaagtccgcggtgttgacagacggtgagctcgtcatcgactttgcaggtggtccgttatacaccttggacggggacgaaccgcgcgaattcgagcttgtttgggaggacggctccgtgcatgccgtctccgggcgcgttgaaggcgacaaggtcgtcattcgtgtgccctggcgtaagccgacatccatccgatatgcgtggagtaatgcgcccggtcgtggtctactgtgttcggggaagggtatgcctgtgccaccgttcgccatgccgattgagtagagaagacgcgccgaaaccggatgttcgccgttcgaccaagtcgggacgtggccgaacgacgaacttgctatcggatgtcttgagcaattccaagaggtagcggagcgtatagaagtctgttgggcagaatgatcggttcgacgatttcgccgttcgccgaatccattgcgtaaccgagccgttcatgaaaggaatgaacatatgagaaacttcatcttccacaatcccgtcaagatctatttcggagaaggtcaggtctcgcatgtggccgaggaggccaggtctcgccccggtgccgcgtgctgctggtctacggcggcggctcgatcaagcgcaacggtgcctatgacgatgtgacggccgcgctgcgcgaggccggcaacgaggtcatcgaactctccggcgtgaccccgaacccgcgactcgacaaggtcttcgaaggcgtgaacctggttcgggagcacggggtgaacctgatcctggctgtcggcggcggctcggtcatcgactgcgccaagttcatctcgctgggttccggcctgggcgaggacgaggacctctggtacgactacgtcgaaaccggcaagcccgcccccgaaaaccttgtgccgctcggcgtggtgctgaccaccgccgtcaccggctccgagatgggcggcgtggctgtgctcaccaactgggcccgcaaccgcaagctcggctacacatccttcccgctgacgccgaagttctcggtactcgacccgacctatctgctcaccctgccggctgaacagaccacctacggattcgtggacatgttctgccacacctgcgaacaatatttctcgctacccagcgacgacaatctctccgacgagatggccgaggccatccaacggcatatcctgcgctcctggcgcgcctgccgtcgccatccgcgcagttatgaggcccgtagcaacgcgatgtgggattccacgttcgcgctcaaccgcgtcatctcgcgtggcaaggaggaggattgggtcacgcacggcatcgagcatgcgctctccgcctacttcgacatctcgcacggcgccggcctggccgtggtccatccgcactggatgaagtacgtctacacctcacgccccgaagccaccgcacgcttcgcccgctgggcggtgaacgtgtggggcgtggactcgaccggcaaatccgagcgcgaggtggccgaggagggcatcgagcactacgtcgactttctgcgtctggtcggtgccccgctcaccctgtccgaggtcggcattccagccgatccggccacgctggacaagctcgccgaccatgccggcgacgtcggcggctcctaccgccgcatcacccgcgacgatgcgcgcgccatcctcgccttgtgcgtgacaccggtcgtgttctgaggatgtatcaaggtgtatcgagggatggaggcgccgaagacttgatatccacacctgccgtatacacgtctatgaccacacattttgccctccacctgtacatcgatacgcagccgccacggtgtacggggagggcaagccgtacatggatgtgcgatgaaaggcggcatctccgcttcggtggcggggcaggctttcatcgccaccgaagccgttgccggtcacatgattcggcatatgccaatgtcgagcggccttattaccccgctctcggcggggtgcggaagtccttgaagcgttggattgcgcttccataccattccgcggcggaatcggacttggcataacggtttggtttcgccgttttgctatggtatctcggctgtggcatggtacggggcaccgttatcaggtgctatggtgttccgtatcgggatcgggtggtacggaacaccaatcgccgagtgttgcagaacctgtaccgcaaaggggcggccttccggttgtgatttcgatcgtgaacagccttgtcgccccgatgggaggcgtcaccgttggtggccgcatattatcggggcgtcaaccgcgtgcgaacagcgtcaacttggcgaagaggtcctcgagaatgaatcgactgtcaatgctgtcgtagatgcgtatcgttgggcgagacggtatgaaagcagtggagctgtccggcttgaccaatggtgccggcgcgtaatggaattcgccgcaatcatgcttcatcgccaagccgacggcgggcgaatctcccaatgaccagctttctcccgaagtccagaacgcgaaatcactgtcattgtatttcacgagattgtcgaacaggaactcgccgatagcgcccgcatcggcaagcttacattgtagttcggcaatgctcacattcatcgtacggtagacctgataaggcaccagccagagattcgcaccactggtcagcaccagattggcgccttccacgtcgttgccggagttgaattcgcgaatggcttcctcatcgttgccgggaagctgcgtgccgatccagatgatggtcatccggctgacgatttccgggtgcagcttgatggcggcggccacgttggtgatggcgccgaggcacagtacgaacagcggatgggtatcagcgctcagagcttcgtcgagaatcgcacgcgaagcgggggagaggtcctcatcagaggcgaggtgcagccccgccagcggcgtgcgggcgccttcgagtaccggtacatcggagttcagcagttgaacaaccgtggacgcggtgcggaagctgcgttccatactgcccgcttcgttgaaatgctcggcgcaaatcgccttgaccatgaacttcggtgtcagcaacgcctgagcgatagcgaacgggtcgtcggcctcgcaatcggcgtcggtgtcgatgatgacacgaatctgcttatcatcacggactgtgaaatgaaaagtcatcaatgttcctttcctgatggtgatatgcgatgaggctgctggccctcgtcgttccgacaacctcatcgtgtgacttcatcaaccgcgccagcgcacgtactgctcgtacacctgcggggttggttcgccggtcagtgtggtctcgactttgaccggccacgtcggcggttcggtctcgccggacagcacccaggcggcctgacgggccgcgccgatcgccacgtactcgtcggtttctggcagttcgacgtccatgccgaggatcgcgggggccagcgcgcgcacggccgcgaacttggttccgccgccgatcagcaggatgcgcttgacgtccacgcccagacccttgaccagttcaaggcagtcgcgctgcgagcacagcagaccctccacgaacgcgcgggcgatgttctctcgcctggtgttcgccaacgtcatgccgtacagcgccgccgtggcgtccggacggttcggggtgcgctcgccgtcgaagtgcggcaccagcgtgatgccgccggcacccggttccgcggccgcggccagttcggccagttcgtcgtagtccacgccgagtgcggcgcgtccggcatcggagatgcgcgaaccgttgatcgtgcaggccagcggcagccaatgtccggtgcagtcggcgaatccggtcaccgaagcggtcatgtcgtaggcgggcacgggggagatggccgcggccacgcccgaggtgcccagcgagatgctcacgtcgcccacacccatgctcaggcccagcgacgccatggcgttgtcgccgccgccggggccgatcgggcagccgccctccacgtccttgccggcgatggccggatcggccacgtcgccggtctcggtcgggccgagcacgcgcggcagcacgatgccggcgatatcctcttcgccgcgtcccagcgccatcgcgagcaggtcacggcggtattcgttggcggtcgcatcgaagtacgcggtgccggaggcgtcggaacggtcggtgaacagcgcatccaggttcgccttcatctcctcggcggtcgcgtcctcgcccagagggccgtggccggcgatgcgccagctcagccagtcgtgcggcaggcagatcgcggcgatgcgtgcggcgttctccggttcattcgcggcgacccacgccaccttggtgatcgtcaacgaggcgaccagcgaggagccgacggccttgacccagcgctggcggccgcgcatcgccggatcgtcggacaggtcgtcctcgctgccgtcggcggccttctcggcctcgcccagacaggcgatgagcacgtcggcgttcgtggcggaacgggtgtcgttccacagcagtgcgtcacggatcacgcggccatggtcgtcgagcagtaccatgccgtgttgctggccgccgaccgccagcgcggccacgtcgtcgagcccgccggcctgttccgcggcctcctggaacgcctgccaccaggcatcggggttcacgctggtgccgtcggggtgcttggcctgcccgaaacggaccatctcgccggtctcggcgtcggtgacgcgcaccttggtcgactgggtggacgtgtccacgccggccaccagaactctgctcattgtgcctccttgcaacatgccgccaaaaacgtcgggctgatggcgtttggccgaatacggtcgccattatacgcaaatagtttgacgaatgaactatactggtgtgtgtaccattttcacaatgttgtgggaggcacgccggaggcgatgaagcaccagaacacatagaggagagctacgtcatgactacgctgcgcagaatcaatcaggacgatctacgcaaccacaatctttcggtggtcatcagcacactgctgcgcgccgccgaaccgatgagccgcgccgaactggccaaacagacgggactgaccaaggcgaccatgtccctgctggtttccatgcttgtcgacaacggcgtcgtgcgcgaggggacgccgagcgtacaatcctcctatgggcgccccagcacgccgctgctcatcgtcggaggccgatactgcggcatcggtctgcaggtgaatacggacggctacggcaccatcgtgctcgacttggacggcacggtggtcgcggaacgctgggtcgatgcggatatgtccgacgtggacgccgacgacatcttctccgaactgaacgccctgtcacttgagcaggaacggctgctggctgaccgcggatacaccgtgacgggtaccggactggcattgcccggtctggtcacggatgacatgaggctcctcatggcccgcaacctgggatgggaacagttggatctcaagcggttcgacgtggtgcggcggctggatgcgactgcgggcaacgaggcgaatatggcggcgctcgcgcagattcccggatacgctatgcaccgtgaggacgacggcatcgtggaacccaacgcctcattcatctacctgtccacggacgtcggcatcggcggcgcggtggtccgtggcggacatgtggagatcggcgaccatggattcggcggggaactcggccacgtgtcggtggagctgcgggggccggtgtgccggtgtgggcggcgggggtgcctggagacctatgccggccgcagggcgatggtggagtccgcaggcatcgccagcgggtcggcggccgcgcggcgcgagtcgatcaacgagctgatcgaacggtggcgtgacggggacgtcaaggccgcggcggtggtggacaaggccatcgaggccatggtctccgccatcgcgtcggcgatcaacatctgcgacgtcgatacggtgatgctgggcggcgtatggtcgcagttcgggccggagatcgcctcgcatatgcagggcatgatgcggcgccaggtgcttggataccccgaggtgcgcgccaaggtgctgatggccgacgtgacgtccaaaccggcgttgatcggttcggccgccatcggtctgcgccgcttcatcgacaatccgatgcggttcgtctcgaccgactgacggtccgcacacggatgcacgcgtgttccaacctaggcctataacgtcgggggcgcggcaagaggagctgcctgatacagtggcacgtggcgattccgcccgggctgcgcaggtcaaggatcgtccgcgggtctccccgtgttcatgccgtgcgcagtcaacagggaacaggagcatcccatagccgaacatcctcaacaaccgaatcatcataccatgcccgccgtagggaaaacgtcggacatggccgacatgtcggcacggagggatgcctccggtcccgccggattgtcgtccccatcctccggcggccgggccgcggaccgtcgttggcgctggaggatggggacgacatcgccgtgggcgccgcgttgggcgtggcctgcggactggtgttctggctgttcaacttcgcctacgcatgactgtccccgatcatcggcggcatcctgcccggactggccagcatcctgtacccgctgtggtatttctccggcacgttggccgtcatcatcctgcgtaagcccggagccgcggtctatgtgaacctggtgggcagcgcggccgagatgctgctgggcaaccagttctcgttcgggttcgcgtccgcggcgctgcagggcgtgttcgccgaactgccgttcgcactcacccggtaccgcgtgttcaacctgccgatctccatgacgtccggcgccttggtggccttggaatacggcgtgtacctgatgctgttccggtatcagggcgtatcgttcctcagcccccgcggcgtcatccatatgatcagtgaattggtcggcggcgtgctgatcgccggcgtgatgagctggtatctgtacagggccatcgccgccaccggggcgttggatcgtttcgcttccggacgggcgcggcgcgacgatgccgaccgtcgcgggtgaccgctgtctccggtcggcggttgtcaggatgccgcccgttgacgagcatccgggcaaacgcccagcggtttgctagactatagggccggccacgaaccggcgtggggctgtagctcagtcggttagagcatcggactcataatccgccggtcacttgtccgatcagcaccaccagcaccaccagcaccgtcagcccggtgccgagttgcggcgacagccaggaggtcatcagcaccacaacggcgccgagcaggcccccgatccacatccacggcggattatgcccgcggatcgtcttaccgagatcgaggccatggtcacggaacacgaccacggcgcacagcagcacaaatcccaggatgaacgagacgaccgacgccttgatcggcgatccgagcgccgtacccagtcgtcccagcatggcggcttgcaccgccaacgacatgccgcagagtatgcccagtccacgccatagccagatgcttggcgagcgggttcggttcgtggagcggccgtccgcagggggtcgcaacgtgtccgcggacagcattgcggggggtgcgcgccgctccgtgccgcgagccgaacgggttcggaccgccgaacagcgtcttggcgtcggcggcggcgaccgccagcagcacgccgaggactgccagcaccagtccggctgcgcgtgccatggtcatcggatgacgagggttgcccagccagccgaactggtcgatgagcagtcccatcgtgatttgccccagcaccggcatgagcacggtctgcagactgccgagcctgggcagcagcaggatgttcccggtcatgaagatcacgccgaagagcccggcgaaccacatccaccaggggccgtggagcgccgactcaggtaccagcgggtacggtccgagcagcagtgccgcaatcgttgtggctgccaatcccacggtgaatgacaccagcgacgcgcggaacggtgtgcccaacgttccgcgcagtcgcgcgttgacgacggtctgcaacggcgtgacgattccggtgagcactcccagcgcggcaagcagcatatgatcccctttcgtctcggcgacattgtactcacgacgccgatttcgggggtccagctgtgcgctgggacgcggcggttcggattgggagggaaggcatgcatggcttcgcgggtgatgcgggaagatgcaggaagatgcaggaagatgcgggaaaagcgggggatacgagcaaatattaagcaattgatgtccgggtgtccggtttgtcgagacgtctgtttttcataggttcccggcctggccccgcctgggggtggacagtgccgcaaaacgcaggcaccaagatacggaagaggaggagtcgtaccatatgaacaacatgccgcagcgtttggtgttcttcgccctgggcgtcgtcatcaactcgttcggtgtggcactgatcacgttgggcaatctgggcacctcggccatctccagcgtgccgtacgtgtgcagcctgcagttccccatgttcagcttcggcgtgaccacattcatctggaacatcctgctgattctggttcaggtcgtgctgctgcgccgcgacttcaatccctcccagttcctgcagatcatggtcaacgtgctgttcagcgccatgatcgacgtaagcatggccatcctcggtgttctgcaccccaccatgctgtgggggcagttcctgtgcatcggcttaggctgcgtggcgttggccttcggcatcgtcatcgagctggcgccgaacgtggtggtggtgcccggcgaaggcgtggtccgtgccatcgccaaggtcagcggcgtgcgcgtgggcacggtgaaggccgtattcgacatcacgctgatcatcatcgccgcggtgctgtcattgatcttcttccacgggttgcgcggcgtcggcatcggcacggtgatttccgcggtgttggttgggccaatcatcaacatcgtcaatcgcgtcttcaccttccagcaccgcatccaggcgctggccttgtcccgcaacgggcgttgacgcctgaccgtccggtcgccacagggccgggaatggtgacgcggaaccgatcgagcgaattgtcgatgcgcaccggttcgcgcgcctcgttccttagcgcggcgccgatgcgcaggtatccggtgccgtcgtcgcgcagcacggtgccgccgtccggatacggggtggaccgcagcagcgagaacaggaatgcgttgcgcgtggacgttgacgcctcatgggtgagccgctgtttggagaccgcgccgaacaggccgcccaggttcgagacctcgattcggtcggtgaacacgtccacatgcacgggcgtgccgagcgcgtccggggagtagtcgcggtgggtcaacgcgttggcgatggcctcgcgcagcaccagttgcggatacatcggcggctgtggcgactgtgatggttgcgcgccggaatcggcgccgcctgggccggacgtccatgccatcagcgaggcgaccgcgtcatcgatcatgatcgggatcgggccggtgatggtttcggaggcgacgagccgtgcgtcgccggtgaacacgtcgtcgcgtgaggtaccggggtagacggcgatggtgacgttgagccggggaaagaacttctgcggataccggccgacggccaacagtcccgcaagcgtggggcgcggcacggatgcgatccgggtctcctcgtccgtgtcggtgtccgcgccgatatccgtgtcgtcttccctggacgcggttcccgccgggtcgcaatccgcggcatgtttcacggtgtcgtccgcggggtggccggttggcatgcgtctcaggatgcgcaggtccagcatcatgtccatgtcggaacgctccgcaaagacatgcggatggcggtcgcgctcgcattcgagcagcgcgtggacgagcgtgggattcaagtcgtcgagcgtggcctctggcacgaccgcgatgtcgtgctccggctggcgttgctcatcaagcagacgatcgacctcgtaggcggtcatcttgcggtcgccgtcgccggtgcggatgtaggagccgccgtgcgggccgaccgaggagacgaagcagggcttctcccgcggcagcatctcgtcgatgacggcgaacaccaaattcgcgccctcgaacgggcaggtcacgatcacgggccggaccacgggcgtgagcttctcgcaggcctggctcaacgcctcctgcatggcgcgggcgtcgaagccctcgaccggcgtgaaccccgccttctcgctcagccccaggatgatgtacccgccgttgccgttggagaacgcggacagcgtctcggtgatggtcgagctgattctgcgtttgcactccttaacctcgcattgctgcgtgtcgttgccaatgacgcgcagcagttcgatgagctcggtcatcttggccgtgtagtcgtcgttgtccatcgcgcctccgggagtgtgccgttgccacctggtgacgtctgtactccggccgccgcgggctcctgccactatcctatgccggcggcggcatatgcgtggcgatgacttgcacgggatcggtgccgtccgcgagtcggatatggtggggcccgcgacgggatcgttccccgtcgcgggccccaccgttaccgtatggtcgcgtggttcgcgggaatcagagcaccgcgtccatcgcctgcttgagatcggcgatgatgtcgtcggcgttctcgatgccgcagctcagacgcaccagatcgatgccgacgccggcctcctccagctgctcctcggtcagctggcggtgtgtggtaccggccgggtatagcgcgcagctgcgggcgtcggccacatgcgtggcgatcgagatcatccggaaatgatcgagcagcgcggagaccttgtcgcgtccaccggacacgccgaaggagatcacgccgcaggtgccgttcggcatgtacttcctggcggtctcgtagtacttgtctccgggtagatcggggaactgcacccagctgacgcgcgggtcggcgctcagccactgcgccaccttgagcgcgttcgcgcaatggcgctccatacgcacggccagcgattccagatgcatgcccatgatccaggagttcatcggcgccggcgtggagccgaagtcgcgcatcagctgcgcggtggccttggtgatgaacgcgcccttgccgaagtccttcgcgtaggtcaccccgtggtaggagtcgtccggcgtggtcaggccggggaacttgtccgcctgggccatccagtcgaagttgccggaatccacgatcgcgccgcccacgcaggagccgtggccgtccatgtacttggtggttgcgtgcgtgacgatgtccacgccatactggaacggcttgcagttgactggtgtggggaacgtgttatcgacgatcagcggcacgccgtgacgatgcgccgcgttcgcgaacttttcgaaatcaagcacgatgagcgccggattggagatggattcgccgaagaccgccttggtgttcggctggaatgccgcttcgagttcttcctcggtgcagtccgggcttacgaacgtgcattcgatgcccattttgcgcatggtcacgttgatgaggttgaacgtgccgccgtagattgcggaggatgcaacgatgtggtcaccgttgttgcagatgttgaagagcgcgaaaaagttcgccgcctggccggatgaggtcagcattgcggccgcgccgccttccatttcacagattttcgctgcgatggtgtcgttggttgggttctgcagtcgggtgtagaagtatccggattcggataggtcgaacagtcggctcatctgttcgcttgacttgtatttgaaggttgtcgcctgaatgatcgggggtgtgcgggattcaccgtttccgggctggtaacctccctgcacgcaggtggtgtcgacgttttcgctcatggatttccttctttcgattgggcgctgcggtgcaacaaacatgctcaccttatcactgagttgacaattgactatttttcaatggaaacgccgaatagttcactgaattgacaaacttaggaagttgattttattatgtacatcaagacaggcgggaatccgcttgacgggaaaacaatgtcttacgaaagtaaaatcaatagcaaaggagcaacccatgggtctgtgggatattgaaaagattccgtatgtcggtcgtgaaaagggaccgcaggagggtctggctttccattactacgatgccgacaaggttgttgccggcaagaagatgaaggattggctgcgttttggcgtcgcttggtggcacacgttcgatcaggagctggtcgatccgttcggcaccggcaccgcccagcgtccgtggtacggcaagtactccaatgctgaggatgaggctctggccaaggtcgactatgccttcgagttcttccagaagctcggcgtcgagtacttctgcttccatgatcgtgatatcgctccggaaggcgataccctgcgcgagaccgacaagaacctggacaaggtcgtcgacaagatcgaagagaacatgaagtccaccggcatcaagctgctgtggaacacctcctccctgttcaccaacccgcgcttcgtgtccggtgcttccacctccccgttcgccgacatctacgcttacgccggtggccagctgaagcattccctggagattgccaagcgcctgggagccgagaactacgtgttctggggtggacgtgaaggctacgagaacctgtggaacacgcagatgaagcgcgaacaggcgcacatggccaagttcttccacatgtgccacgagtatgctcaggagatcggcctggacgctcagttcctgatcgagccgaaggccaaggagccgacgatgcaccagtatgacttcgatgcatccacagccatcgccttccttaagacctacgacatcgacttcatgaagctgaacctcgaaggcaaccacgccaacctggccggtcatacctatcagcacgagatccgcaccgcccgcgaggccggtgtgctcggctccctcgatgccaaccagggcgacaagctcatcggctgggatatggatgagttcccgaccgacctgtacgagacttccaccgtcatgtgggaggtcctcgccgagggtcagatcggccctcacggcggcctgaacttcgatgccaagccgcgccgcacctccttcgccgccgaggatctgttccgctcccacatcgcaggtatggatgcattcgctgcaggtctcttggtcgctgccaagatgcacgaggacaaggtcatcgagaacctgcaggccgagcgctacagctccttcgattccggcatcggcgcgaccgtcgagaacggcaccgcctccctggcttccctcgaagagtatgctctggatattccgcagtccaagctcatcgaagccaccaagtccgatcacctcgagtccgtcaaggccacgatcaacaactacatgatcgacgccctggccgaggcgtgagccgaatagggagtttccgttagggctcctgattcatcgctggatcaagcagtgaggctcggctgtgacagagccggatgtggtgtgccgaagcgtcggcgttccggcacaccactcatctttccttccttcttcctagaatttccttcgcaggcaagtcgtctgccggttatgtcgccggtgtacggcttgtttgcgtttttgggccaaacgaaagtttcgattgttcgcaatgatgcgatgctcacgaacgtttctgaataaggtgtatttatgaccgcgactattaccattaccaatcccattcttcgtggaatgaatcctgatccgagttggatttgggatgatgagttccagcgaattgtgttggtgacttctacttttgagcttgtcccaggtcttcccatttacgtttccgaggatatgacgtgctggaagcatgtgtcgaatgtggtagatgctgacctggcaaggcgcctgcttattcctttcgtggatgattcgggcggtgtctatgcgccgacgctgcgcaggattcatggcaaatatgtgattgcatgcaccattgcccgtcttgatgatcgccgtgctatggaaggtggttgcacagaaagcgagctgatgcggttccacgccgcggagggcaattttatccttgaagcggagtctatcgaagggccatggcatggcccgttctggattgagggcgctgaaggcatcgatccagacatattcgaggacggggatggcaacgtgtactggactcagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcgccgcatggactgcttcgggcgttcgaagcttacgaacgggaagtatccgaattgggtgagtgcattccgcaggttcgtgacggggaacgctgctatcttggcgccgcaatccgtgccttccacgcggataagaagaatccgattctcacccaccgacatctgggtttgtcggaaccgctgcaatgcgtgggacatgcggacctgttgcttcatccgaaactgggatggtggctggtgtgtctcggcgtgagggagacacggggaaagcgtgacggcgaattattgagctacttgggaagggagagctttgtcgctccggtatcctgggaacataatccggccgattggaagctggacggcaacggtgcaccatatacgcatgagggtgaccccggatggccggtgacttgcgctggtcttggccgcttggccgacgagatcacggttactactgaagacgatggaatcgccatcgagcctagggtgaaatcctcgctcgccggtgacgtggaacccgcgctggtggatgtggctgatggctcgacgaacgatgtggtggtgcgcgatgagcgtgatgtcagctaccgcagaatagcgaaactgccgacgctcatgccgattcccatgtccggttctttagtgatccggcagaattccacacattacgcggtgttttcgatgcatggcacggatgtgcgttacgagatggtgaatggagacgattcgcaagctgggtctgttgtcgtacaggctgacggagtgcgtccggcggtacttttcgacgacaaccgcttgtcggtcatcgtgactggcatgcatggtctggttgattctgcgacgttcgtgcgtcaggggcaggtcctgctgagtgtcgatgctcgtttcctcagcaccgaatgggccggtgggttcgtcggttgcatggccggcttcatggcatagtttctacggaatttcaggatggttcactgctggtgttccgacgggccgtcttagaacgagttgaaaacgggtcgaaaggctaggagcgctgtgttctccccccggttgtgcctgtgaggtttgccccgctgattaaccttcgagttgctgtgtgctgttgcgtaccactagcgatgtcggcatgatgatgtgcggttggatcacgtcggtggacagcgcttcgaccagcatgcgtacggcggcccttgccatgtcttggagcggctgtcgtacggtggtcagcgccgggccaaggaatgcggcagtctgcacatcgtcgaatccgaccacggataaatcctcgggaatacgtaatcccagctgccttgccgcctcgtagacgcccatggcctgcagatcgctgccggcgaagattgcggtcggacgattcggtcgtttcaacagggagatggactgtgcgtaaccgccggaagtggtgaaatcgccttcggtgataagttcgggatcggcttcgattccatgttccgcgagcgctgatgtatatccgtccagacgtgctttggaacacatcatctcctccggtccggtgatgatgcctatgcgggtatgtccgagtgcgagtagatgcctggtggcgattacgcctccggtccagttgtccgcttgcaccgacagcgtgtctggatctggattaccgaatggatcgaacaagacgaagggaatacctctggaatgcagtttgttccgctcgatacgtgtcagactggagaagacaagaatggcgccatccgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggctttttgcacccgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcttttcatcatatccgaaaatgcgaacgaaagtttcggtttacgtttttcgaaactttcgatatgttggcaatgcttaaaaacgttgtaaaatcaacgaaaaatagttagttttctgattttacaaaaaacttgactttgtgtgatttgtttcggtagtctgtaggtacaacgaaaacgaaatggagactttcgaagggagtcaaaggctgattctctgtctgctaggggagctgcagcagcattcgttgcggtcatgcttcccgattcgacccactcgagagaagtcgttcctgtcgttgccatcattttgtcgatgatgatttggtcaataaggagaagacaatgaagttcaaaaccattgcagctgccactcttgcggtggcgaccatgttgggcatgggtgcctgcggctccagcgctggcgccaaagacgataagaccattacgttctggcataacgccacagctggtgacggcaagcagtattgggaggatctggccaaagcgtttgagaagaagaccggtgtcaaggttcagattcaggccatccagaacgaggatttcgaaggcaagctgaccaccgctatgcaggatcccgcctccggcccggatgtgtacatgacccttggtggtgccaagaccaaggacatggttgatgccggtcaggtaatggatattactgataagattagcgataccgtcaaaaagcaaatgtcttcctcattggattccatgtcttatgatggcaaggtctatggtgttccggtcgctgcccagcctggtggcatctggtattccaaggatttgttcaagcaggctggcatcgatgccgagccgaccactttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgttaatgacaaggacttctccgactcttgctgggtcaaagccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaggctatcctcgaagctatgaaaaagtctgatggcatgcagctgtggatggataccgctctcggcggaaatattggcaacgctcttaattccggagtggtgaatctgctttccggacaggggacttcggctgacatcgtcaaggcgatgaaggacgcagcgtccaagggctgatagtgaacatggctggttgacggccaaaggagggtggatagacagatcttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggctacgggcttccctccaagacaggtaaattcgttggtctccagaactacatcacagcgcttaaggatcccgcgttccaggcggcgattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctacagaagaagggcgccatcaatgagattctggccaacttcggcatcaatggtcctgattggctggccgacccgaaaatcgctatttggacgctgctgttgctgatcagctggaaatacgtcggtttcgccgtaattctgatgctcgccggcatgcaatccattcccgatgaactgtatgaagcagccaaagtggatggggcgagtttttggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgagcagaaagaagccgagaagcgtgccaggaagcgcgcaaaggaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgtatcactccggtgttgtacattatcttcggcggtttccgtaccaattcgcagatcaccaaccatccgtccgggatgccgaacccatggatccccgacaactacaagacggtcgtcgaaagtgatattttctggacggaactgaagaattctaccatcgtgggtatcgccaccatggtaggcgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatccttaccttcgtgggaagctggaatgcctacatgctgccgctgttcgtgctcagtgatgccagcaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacggaatgtgacaacccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccacgttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggatggcagattctggttgatctacactgatgtcaaggtggtcaatggtgcattcaaggattgcactaattatttggtcaccgccgaggacatccacgggccatggagcgagccgattcgcatcaacggggtcggttttgacgccagcctgttccatgacgacgacggccgcaaatacttggtgcagcagacatgggatttccgtgaataccaccaccagttcgacggtatcacattgacggaattcgacgtcgacaccatgaagctcaagccagaaacggcccgcaccatctgggatggcactgcggtgaagatcaccgaaggtccccacctatacaagaaggatggttggtactacctgtttgccgcagaaggcggcacggtgtatgaacatcaggaatctgtggcgcgttcccatacccttgacgagtactccttcgaagttatgccgaatggcccgttcatcggtaacttcgacactcctgacacctatttgcagaagcagggccatggagcgttggtggacaccccgtccggcgagtggtattacgcctccctatgtggtcgtccgtggcgtcatgataccgaaccggcccatggcacccgcggatggtgcacactcggacgcgagacctccatccagaaagtcgaatgggatgaggacggttggccgcgcgtgatcggaggtcacggcggacagcgttacgttgatgctccgaaagatgccatcgagactttggccccaacgacgcgtgacgaacatgatgagttcgattccggcgagctcggtccgaattggaacacgctacgcgtcccgttcaccgacgccatgggcacggtgggtggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctatgctggtcatgggcgtttatcacttgggatgagaaacgtcacgcaagggtcatcgaagtggctcagaacgatttcaaccaatatacgtcgttcctcaaggatgacgccatcgtagtgcccgaagaggctgaggcggtatggctgcgcaccaaggtccgcacggaatactattcctacgaatattcctttgacggagaacatttcaccgagattccggtcaggctcgatgcgaagatcctgtccgacgattacgtgaaccaacgttacggcggcttcttcaccggcgcgttcgtgggacttgcctgcgtcgatctgtccggctacgacgcgcaggccgaattcgactacttcgactatcgggagctttccgataaccagtagacagtgccggctggcgacagagcgtccgccgtcagccggcatactcgacgggattgaattctatgggcaatgaggagcggacgagcatggttttgcaattgccgaaactgcttgacgacggttgcgtgctgcaggccggtgcgaccatacatatctggggcgccggcgaccctggacgcggcgtgctggtacgcctcgatggcaaggaccggactacgcgggtgggggacgacggctcatggagcgtgccgtacggtccgatcaaagcaggcggaccgtacgatttgacggtgcgttatgaggacggaaccgaatgcatctcgcgccaatgctatgcgggagaagtgttcctgtgttcgggacagtcgaacatggaactgcccatggcttgggtgcgtgcggactatccgctggagtgggatcgtgagcctgacccattgctgcggcaatacaaagcgattcccgattgtgacttcaacggtcctcgcagcgatcatgaccatgcgttctggcaggggtgcgatgcggaaacccttggagatttctccgcgctcgcctatttcttcggacgcagaatccgtcagtggctgaatgtgcccgtcggcctgttgaacgtttcattgggcggatctccgattgaatcctggatggatgccgacgcattgcgggcgttccccgaagcgctcgctgaccttgagccatatcttggcgatggcgtggcgtcgaagaaaagccgcgattccgttgccgagcgggaccggtggtaccaggcgcttggatacgaggctgtggccgatgcccaccatgaatggctgccattgatcgcgtgggactgtccggaatccaagaacatcgagccgcgcgacgtggcatggcatgacatacgcctgcctggatggtataaggatcgcggacttgccggtttccgcggcgagattaccatgagaaaaaccgtgttcctgcctccgtcggatgcggggaagcccgccctactgcgtctgggcaccatgaatgatgccgaccatacgtgggtcaatggtgtgttggttggtgggcgaagcaatgtgtatgagccgcgggactatccggtcgcagccggcgtgttgcgcgccggcgcgaacgaaatccgcatgcgtctggtcgttgaacggcccggcggccgtgtgacgcccggcaaacggatgacactgaccatcggagacgatatcttcgacctgtccggcatttggcagtatgccgtgaccgccgaagctgaccgcgattgcccattcgaggatttcgtcagatggaagccgaccggcctgtacaacgccatgctcgccccgtgttttccatatgcggtgcgggctgtgctgtggtatcagggcgaatcgaataccggcgatcgcgctatgcaatatggtgacgagctgaaggccatgattcaattgtggcgcgtcaaatggcatcagccggatatgccgtttctgatcgtccagcttccaaaattcgacatcgacgccattgaggatggaggctggccactcgtccgcgaacaggagtggaacgtcgcaaacgaacttgaaaacgttgcgacggtggtgacgcttgacgcaggcgagggcaacgatctgcatccgtatgacaagaagctcgtcgcggatcgagtgttcaatgccgcgatggatttggtatacggtcgccaggctcagcctcaaccggccgtggaaaccatcgaggtctgcggagatctgttgcggatgcactgtgtgtggcggagtcgctcggacgagcggatccgatcggagagccgccggctgatgacgttggacggtgacgctccccaggaaatcgaatttctatggcgcgactgcgccacatccgcgcgggccgaggcatggttggacggctgtgatatcgtggtgcgcatgacggcgcgcaggccagatgaggtgcggtacgcgtggagcaacaatccggaatccggactcatctgcgacggcgacggcatgctgattccgccgttccgcctgacattgcccacggacgatgataaggggattcatgcgtagacaggtcgcgcttcgacaaggactcgtcgatggattctccgatacggactctgtaattaccgtgtttcgtggcatcccctatgccaagccttcccgttggcgcattacgatttgtctcgtgtcatgattcggtattggacgaatttcgcggcgacgggcgatccgaacggttccggattgcccgaatgtccggcgtgcggacccaatggccaacgatacatgctgctcggcggatgccacgatacatcggatagtatgtcgtatgccaggtcaagtagatgaatatagtatagtgtgagcgttcactatagcgtggtggaaatcgtgacgaaggagacgggcatgacgaaggagacggagacgcagatcgcgtccgacgaggatctgactaggctgttcgccggcaagccgacgcaataccgcaaatcgaagtcgctgccgaagtttactggcgaggccatgcgtacctgcgccacgatcaaccgcatcttcttcgatgatcccgacgaggcctaccgcctgttccacgagctcgttcccgacgcgggggaaggcgtacaattcacgccgccgttcaatgtggattatggcatcggcctgaccattggccgcggcacgttcttgaacaaggatttcatggtgtgcggcggcggatatgtaacgcttggcgaggattgcctgatcggcccgcgttgtaccattgccacgccgaatcatgccttggatgcggcaacgcgactggctggctgggaacatgcttcgccggtgacgattggtgacaacgtgtggtttggtgcgaacgttacggtcacgcctggcgtcacgattggctcgaattccattatcggcgcgggttctgtggttacacgagacattcccgccaattcgatcgcagtcggcaatccggcgcatgtaatccgcgagatacccgaacgcgatcccgccttcgccgatgtcgagggtatcgtctgacgttgggttacggtgttccctcagagcgaattcgcgtgttgccctactgctagacgtgttgtcgcacgatttcagttttgacctcacgatttgatcggaatatcgcacgattttgtttgagacgaaaatgggtgccgttgcggttggttgtgacggcacccattttgcgttgttttagtgcgatttatgctgattgatcagccgcgggcctttgcataggcctcgtacacggcttcagtcggttcgccggtttccacgccgtcgatggtgagcggccatgcgggcggttccgtttcgccggacagcacccaggcggcctgacgggcggcgccgatggcaacatactcgtcggtggtcgggcgggtcacgtccatgccgaacacgctcggcgcgagcgtgcggattgccttggacttcgcgccgccgccgataagcagaatgcgggaaatctcagcgccaagcgaacggataagctctaggcagtcgcgctgggagcacagcaagccctcgacgaacgcgcgggccatgttctcgcgtgtggtgttggccagcgtcatgccggaaagggttgcggtcgcgtccggacggttcggcgtgcgttcgccgtcgaaatacggcaccagcgtaataccgccggcgcccggttcggaagcgaatgccagggatgcgagttcgtcgtagtcgacgccgagggctgcacggccggcgtcaagaatgcgcgatccgttgatggtgcaggccagtggcaggtagtggccggtgcagtcggcgaagccggaaacggcaccggtcaaatcgtaggtcggattttcggaaatggctgctgccacgccggaagtgcccaatgaaacggaaacgtcacccacgctcatgccaagtccgagggacgccatggcgttgtcgccgccgcccggtgcgatgatgcaaccaccctcaacgttcttgccggcgatttccgggcttgccttgactgcggcggcatcgtgcggtccaagcacggtcggcagcatgattgcgtcggcatgctcgcgtgccgcttcggcaccttccgctggctcaagcaccatggcgatcagatcgcggcggtattcgttggaagcggcatcgtaatagatggtgccggaagcgtcggaacggtcggtgaacagcgcttccaagtgtgcgtcctcgccttctgcgaccgggccgtagccggcgatacgccagctcagccaatcgtgcggcaggcagatcgcggcgatcttcttggcgttttccggttcgttttcagccacccacgccaccttggttagcgtgaaggaagcaacgggggaggagccaacggccttgacccaacgctgcttaccacgtgcaatcacatcttccggttcgccttcttcggcgggagcctcgcccatcttttcgatgagggccgcggcctgcggcgccgagcttatatcgttccacagcatggcgtcgcgaatcacgttgccttgctggtcgagaatcaccatgccgtgctgctgaccgccaacggccagtgcctcaacgtcgtcaagtccgccggcctgctgggctgcctcgaggaacgcgtcccaccagaatttcgggtcaatagacgtgccattggggtgtttggcctggccaaagcgcaccatttcaccggtttcggcgtcggtcacgcgcactttgcaggactgggtcgaggtgtcgacgccggccacgagagttcgagtcattgtgtctccttgcagtgagctggcgcaacaaagtgcaaggaattcgcacggtccgccacctcatttagttagatgaatgaactataatgtctagtgtaccatcataaagtgatttgactatagagacggtgcgctttttcggcaaagacgcgtcaaagaggagggaaccatggcttcactgcggagtatcaatcaagacgatttgcgaaaccataatctttccgtggtgctcgactcgctgttgcgtgccaccgaaccaatgagtcgcgccgatcttgccaagaaaaccggattgaccaaagcggccatgtcggtattggtgtcgttgatgctcgacaatgagattctggtggaaggcgcgccttccggccaatcgctgtatgggcgccccagcattccgcttgaaatcaaaggtggacgcctgtgcggcatgggattgcaggccaacaccgacggttatggcgtggtggtgctcgatcttgacggttccgttgtgggggagcagtgggtcgacgccgacatggccaacgccgacgagcgggcgattttcgcccgtctcgacgaactggctttgcagcaggaagaagcgcttgccaagaaaggttatgtgcttgccggtaccggtttggcattgccgggtctcgtcaccgatgatatgcgattgcttggcgcgcgcaatctcggttgggaacgtttggatctcaagcagttcgatgtggtcaagcgacttgatcctgttgcctgcaacgaggccaatgccgccgcgttggcacaggttcccggctatgccacgcagcgtaaggattctgggcggatcaagccgacggattcgtttctttacatgtcgaccgacgtgggtatcggcggtgcagtgatccgcgaagggcgtgtggtgagcggtgatcacggtttcggtggcgaattgggccatgtttccgtcgacatgcgcggtcccgtctgccgttgcggccgtcgcggctgccttgaagtgtatgcgggcaggcgttccatggtgagcgcggccggaatcgccagcagcgatgccgccgcgacccgcagcgccatcgacgaattgatcgaccgctggcaccagcgcgatgcgcagaccgtggccgttgtggaaaaagcattggaggccatggcttccgtaatcgcatcgaccatcaatgtctgtgacgtcgacgtggtgatgctcggcggcttgtgggcgcgtttcgaacctgaactgattcgcagaatcgaacgcatggtacgcccgcaagtgctggcgtatccggaagtcgaggcaagcgtgcttgtggcggatatcgtcgatcgtccggccttgatgggcgctgcggaaatcggtttgcgacgctttatcgacaatccgctgcgtttcatgaagcaaaactagtccacccatttgctaaacttgccaagttggcatgttcgcatgttgcaacgtggggcgttagctcagtcggttagagcatcggactcataatccgccggtccacggttcaagcccgtgacgccccactctttcacaaagtcaaggcttctgatatactctgcaaggttatccggttcacgctctgccataggggctcagcgacccgggtcccccgaatctctaggagacaaactatgaagcagggtatccatcctgattaccacgcagtgcaggtcacctgctcttgcggcaacaccttcgtcacccgttccacctacagcggcgatcacatgaccgtcgacgtgtgctccagctgccacccgttctacaccggcaagcagaagatcctcgacaccggtggtcgcgtggcacgcttcgagaagcgttacggcaagaaggccaagtgagtcttattgcttaggcaatgaaaaacgccagtccgattatgggctggcgtttttcattatgcgacggatgcgcatgcgccggcgtgcatgcgatcgggatattcgtaagatgcgtgggatgcctgcgaaataccgcgcttcggcagcgtttccaaggcaccttatatgatggacaggttgagtggagttcagcgaagcgttcacgctgaagcgcagatttataagcagatagaaaaggcgtacattggcagacgagcagttccccgcggcagttaccgcacttgaggaatatcataatatcgaacagcagatggccgagccggaagtcgcgtcggatccggataagatgcgtaagctgggacgtcgtcacgccgagttgggcgttatcgtttccgcatacaccgcatacaagcaggtgaaagacgatctggaggcagccaaggaaatggcttccgaagatccggatttcgcggaagaagcgaaacgtttggagagcgagcttccggcagttgaggagaaactgcgcaccgcgttgattccgcgcgatcccgatgatgcgcgcgatacgatcatggaaatcaaggcgggcaccggcggcgaggaagccgcgttgttcgccggcgatctgctacgcatgtacatgcgatatgcggaaaagcgcggttggaccgtcaccctgcaaagcgaaaacaccaccgaactgggcggcgtcaaagacgtgcagctcgccatccgagccaagggcactcccgctccggaagacggcgtatgggcatccctcaaatacgagggtggcgtgcatcgcgtgcagcgtatccccgtcaccgaatcacagggccgtattcagacgtccgcagcgggcgtcattgtattcccggaagccgatgaagatgacgatgagatcgaaatcgatcagaaagatctgaaaatcgacatcttcatgagctctggcccgggcggccagtccgtgaataccacatattccgcagttcgtatgacccacattccgactggcatcgtggtgagcatgcaggatgagaagagccagatccagaatcgtgcggccgcactgcgcgtgttgaagagccgcctgctcgccatgaagcacgaggaggaagccgcacaggccgcagacatgcgtcactcccaggtgcgttcgctggatcgttccgaacgaatccgcacctacaatttcccggagaaccgtatcgtcgatcatcgcacgaactacaaggcgtacaaccttgacgccgtgcttgacggcgatctgcaggctgtgatcgacagcgacattcaggctgacgaagccgatcgcttggcccatcagaagtaaaggcggccgatggctaccgtattcgaactcgtgcgatccgcttcggccatgttgcgtgcgtccggtgttgacactccggagcacgatgccaaattattggccgccgaagtattcggcgtcgacctgcagaccgtcgacaaggccatgctgatgggaagcgaaacatccgaactggcgaagcaaggcgcgaagcagagcggtgaagacgctgcgttgaagcgattccacaccatggtggatcgcaggtccaagcgtgaaccgctgcaacatatcaccggccacgcgcccttccgctacctcgatctgaaggttggtccgggcgtgttcattccgcgtcaggaaaccgaactcgtggtgcaggaaggtgtcgactggatcaccaagcacggcatgtattcggcgaaagtggtcgatctgtgcgcgggaagcggcgcaatcggcctgtcattcgtgacggaagtgcccggcagcgaggtgtgggcggtcgaaaaaagcgagcaaaccgcgcaatggacccgcgtcaatctcaacgaaaccgcaaaaaagtaccccagcatcgccagcaactatcatctggaaatcgctgatgccacgcaaacgccgacgctgaaccagctggacggcacgatcgatatcgtgctcaccaatcctccgtatgtgcctcttgcggatattccgcagcaaccggaagtacgcgactacgatcccgatcttgcgctatacggcggttccgcagatggcacgcttattccggaacgcattatcgcccgtgccgcaaaactgctgaaaaacggcggtttgctggtaatggaacacgatattacgcaaggtgaacgattgtctgcattcgcgctgtcatatggattcagcaatgtgatggtgcataacgattacacaggtcgcccgcgatacatgaccgcgaaaaagcagtgatgcaacgcgtctcagaataagagatttttccaggggaacgtggtttttctgttgcaatagagttccagttggaagtccgaccattgcattagaccagttcagcggtaagcataccggttgcggaagcatccacaagatgaggcgtccggttgcgctgacaggaagagaaggaacggcagtgaaaatcaagaatgccgaaaaactggccgcactctgtcttgcggcggttatgggagtgagtgttacagcctgttcgggcggcaacatgtacgccaccagtaatgagagcgccaccatcgcggataacgatgtgatcaccatcggctcggtcaccaccaattccggtgcagccgcagcctatggcgaagccgaagtgaacgggttcaaactggcggtcaaggaaatcaacgccgatgggggaatcttcggcaaacagatcaaactggaatccatggacgacaagggtgatgtgatcgaggcgtccaacgcctttaaccgtctggccggcgacaagaacgtgatcgccgtgctcggaccgaccatttcgtcaacctccggtgccgtcgcgccgctcgccgaccagaaccagatgccgaccatcgctccggccgcaaccgccgattccgtggaaacgggcggatacctgttccgcacctgcttcaaggactcctaccagggcgagatcgccgccaagtatgcggccgaaacattgaaggtcaagaaagtggccgtgctgtatggcacgggcgatccgtattcgtctggtgtgggcaaggcttttgttgcggcggcgaagaagaacggactcgacgtggtggcggaagagaattcctctagcgccgacgataccgaatactcgtcgcagctgcagaaaatcgaagcttctggtgcggaattcctatatgcgccgtactactattccacggttggcccgtacattgtgccacaggcgcgagcggtcggctatgagggctacatcatgggccccgacggctacgacggcctcaaaaccacgggaaacaaagcgaactacaacaaggtgctgtacaccacgcattattcgccggatgacaagtccaacacgaaggtgcagcagttcatcacctcatacaagaaggccaataacggcgaatcgccgaacaccttcaccgcgctcggttacgattccgtctacatgttcaagcgggccatcgaacaagccggtgaaaacgccactcgtgccgatattcgcaacgccatcgcaggtatgagcttctccggcgtgaccggcgcattcacgctcgacaagcatggttctccgaagaaatcggtgattgtgctggaaatgagcgacggcgaaccgacatacaaagacaccatccagccggcgaaatagcgaaaaaacgcgaggaatcaagaaaaacaagacttcaactgacgaaacaacaagaaaggagggatgatgagcgattcggtcattatgttcatcggtcagatcttcaacggtctgaaaatcggcagcgtgtattcgcttgtggccctcggctacaccatggtgtacggcatcatccgactgatcaatttcgcgcacggcgacttcatcatggtcggctcctacgcgctgatgcttaccattccgttcattatcgcctgcggtctgcccgcatggttcgccgtgattccggcggtgcttgtgtgcgtggcggtgggtattatcgtggaaagggccgcgtacaagccggtgcgtgaaaaaggcaataatatgacggcgctgatcactgcgatcgccatgagcctgctgcttgaaaacggctcccaggcgctgttcggcgctgattatcagaccgtgccaaccatcgttgaaattccaacgctggtgcttggcaaactcaaaatcgacggagcgaccatcataacggtgctgctcggcatcgccatcatggtcgcgttgcagctgttcgtctccctcaccaagcagggcaaggccatgcgtgcggtgtccgaagacaaggaagcgtcgattctgatgggcatcaacgtgaactccaccatcacgttgaccttcgccatcggctccggcctggctgcggtggcggcgcttatgtactgcatttcctacccgcaggtctctccgatgatgggtgccatgctgggcttgaaagcgttcgtcgccgcggtgcttggcggcatcggttccattccgggcgctatggtcggtggcttgctgatcggcgtggccgagagtcttaccaaggcgtatatcggtacgattacggccggtgtgatcacgtcggcgttctccgacgccattgtgttcggcattctcatcatcgtgctgctggtcaagccgtccggtctgatgggcgagccggaaagcgagaaggtgtgattatgaagaaatcaatgctttccacgaagcaatcgtatgcattgtgtgccattggcgtgcttgtgctgttcggcattcttgttgcggtatgtgaaacgggcgctatttccctgtatgtcaagggtattctcatgacttgctgcattgcggtgatcatgaccacgtcgttgaatctgacgatcggtgtgctcggacagcttacgctcggctgctgcggtttcgaggcgatcggcgcatattccgccgcgttgatgagcaagctgctggttgccaacggcgttcagatggatgatacggtgcgtttcctgctggtcacgttcgtcggcggtgtggtggcatgtgtgttcggtgtgcttgtcggcattccggcattgcgtttgcacggcgattatcttgcgattatcacgcttggtttcggtgagatcattcgtgtgatcatccagaatctgaaagtggccggcggcaagggacttgcggacggccagcaggggcaggcactgatcggcatcgaccgtctcgccaatctgtatgtggtgttctgtatcaccgtcgtgaccgtggtgctgttgttcatgttcgcgcgttcccgttatggtcgtgcggtcaaggcgattcgtgatgatgagatcgcggctggcgcttccggcatcaacatcacctatatgaaagtgctcgtttttgcgatttccgcgttcttcgcgggtattgcgggtggtattttcgcgcaatatatcggtgcgctcacgccaagcatggccggttggctgcagtcgatcaattacgtgatcatggtggtgttcggcggtatgggttcgctgacgggttccattgtcgccgcggttggtctgacgattttgccggaattgctgcgtgcgttctccgcataccgcatgctcgtgtattcggtggtgctggtgatcatcatggtgttccgtccgcagggattgttcggcaattgggagttctcgctgccgaaattcgtcaacacgtggttctatccggtacgcgtgaagatgcacggcaaatcgggtgcgtctcaatcggcatctaagaaaaccaaggaaaccggcgagactaccgcatctagcgaaatcaacacatccagcgaagacaaggaggtgcaggcatgagcgagccgattctgaaggccgagcatctcggcatcaccttcggaggcctcaaagccgtatccgacttcaacatgaccatcaatgcgggcgagcttgtcggtctgatcgggccgaacggcgcaggcaagaccactgtgttcaacctgctgaccggcgtttaccagcccacggaaggtgagttcttcctcgacggcaaacgcatgaacggcaagaaaacgtatcaggtcgtgcgtgcgggaatcgcaagaaccttccaaaacattcgactgttcgatcaaatgacggtcgaagagaacgtgcttgtggcgttcaacgaatccttcacctaccggctgggcggtgcgatcttccgcacgccgaccttctggaagcaggaacgcgacatgcatgccaaagccatagacctgctgcgtattttcggactggaaggattggccgaaaccgaagccgcgaatctgccgtatggagcgcaacgtaagctggaaatcgcacgagcgttggcgaccggcatgaaactgctgttgcttgacgagcctgcggcaggcatgaatcctacggaaaccgaggatctgctgaactgcatcaacacgatccgcgaccgtttcggcatcgccattctgctgatcgaacatgatatgagcctggtgatgaacgtgtgccagcgtattcaagtgcttgattacgggcgtaccatcgcctccggaacgccagaggaaatcgccaacaatccgcaggtcatctccgcatatcttggtacggacgatgctgaaaacaatgccgtcgaaacgtctgaaacgaccgaaaggaaggacgcctgatgctgcagatcaagaatctttccgtttcctacggtgccatcgaagcggtcaaaaacatcagtctgacggtgaacgacggcgagatcgtgtcgctgatcggtgcgaacggtgctggcaaaaccacgacattgcataccatcacaggtcttactccggcggtttccggcgaggtgctgttcaacggcgtggacctgctgaaaacgccgaacaataagatcatgaccctcggcatggcgcatattcccgaaggacgccacgtgttcacgcgcatgagcgtgcaggaaaaccttgaaatgggcgcgttcagtctcaaagaccggtctcacatggcggacgatcttgccatggtgttcgacatgttcccacgcctgaaggaacgccgcaaccagaaggcgggcacgctttccggaggcgaacagcagatgctggcaatgggccgcgccctgatgagccacccgaacacgattcttatggacgagccgtcgatgggtctgtctccgaaactcgtcaaagagatcttcgccattattcgcaagctgcatgatcagggcattaccgtactgctggtcgaacagaacgcgaatatggccctgtcgatcgccgatcgtgcgtatgtgctcgaaaccgggcgcatcaccatggaaggcgacgccaaggagctgatggacaacgagcaggtgcgcaaggcgtatctgggcgcataaggtcagtttcaacgcagttgaagaatcctgccttacaatggtggggtcagcaagccgaaaagggaggtgtcatgagcgagattcgcactatttcagacgaatcccttgcccaggctgtcgaaatcgtacgtgacggcggattgattgtgattcctacggacacggtctacggcgttgcgtgcgatccgcgcaacattgaggcgatccgcaaggtgttcgcggcgaagcaacgcccgaaatacaagtcgttgcaagtgctattgccgtctattgaaagcatggagaagctgcatttggatctgccggtgccgctgaaccgcctgtccgccatgttcatgccgggcgcgttctctccgatcgccgtggccgatgacgattgcacgctcgccacggtacgtaccgatcccgccaccggcaaggtcacgcagggcgtgcgcattccgaattccacggccgccttgcgtgtgctgcgcgctaccggaccgttggccgccaccagtgccaaccgttccggcgatgaaagcgcgcaaaccgttgacgaggccgtgcaggcgcttggcgatgcggttgatttgtatttggacgggggagcgactcccggtcatgtggcttccacggttgtggcggctgaccctcatgggcgtgatggcattgcgattcttcgagagggagtgattcacgagccggttatccgaaaggccttgacgttgaatggcggtgctttgggcgtatgagaatctatctgttcattgctgcgattgctggcggcgtcacctatttgatcacgccgttgattcgccatatcgccattgagatcggcgccgtcggcgaagtgcgtgcgcgagacgtgcataccattccgacaccgcgactgggtggtttgggcatgctgatcggtttcaccgtgtcgatgctgttcgcatcccgcattccgttcattcaaggattgttcgcgcaatcgcaacaggcgtgggtgattctcgccggcgccattatgatcagtctgcttggcatggccgacgacttgtgggatcttgattggatgctcaagcttgccggtcagctgttgatttccgtgttcgtggcatggggcggtctgcagatcatttcgcttccgcttggctcgttggtgacggcgtcgccgagcctgtcgatggccatcaccgcgtttttgatcgtcgcgtccatcaatgcggtcaatttcgtggatgggttggacggtctgtcgtcgggcattgtggcgatcggcggcatcgcattcgccatttattcatacatcatcgcccgcaactcgccttcgtacgcttcgatggcgacattgatcgacattgccatggtcggcatgtgcgtgggctttttgatgcacaactggcatccggcgaagctgttcatgggagactccggttccatgctgctcggctatttgatcacgtgcgcgtcgattgtgatgacgggccgccttgacccggccagtattcatgccagcatttacttgccggtgttcatgccgattctgctgccgattctggtattgttcctgccgattctcgacatgtgtcttgcgattgtgcgccgcttgcgcaagggacagtctccgatgcatccggaccgcatgcacttgcatcatcgcatgctgcgcatcggccattccgtgcagggggctgtgctgattctgtggggttgggcggcactgatcgccttcggctcgattatgacgctgtttttcaaggcccaatacgtgcttgttggattcctgattgcggccgtggtgctgaccgtcgccaccatgtatccgtatgtgaagcataggattcccgagatgctggaggaggacgctgcggatggcggcagacatgcgtcggtgcggtcgtcgaagcgtcggaaaaactgattaaacgctttgcctagcggtatcagttaactttcgtaacacccttgtttgccgcttgttctgccgtgtcgcggtaagtcagcccgcgttcatatagtgggtctatggctacaattcctgatatgaatgcagattccacgtacgctccgcttcctccgattttcgcacagcttggcctcgcctatgacgatgtgctgctgctgccgaacgagacggatgtcattccgtccgaagtggacaccaccacccatctgacccgcaacatcacgatgaaggtcccggcgatctccgccgcaatggacaccgtcaccgagtccgacatggccattgccatggctcgtaatggcggcatcggcgtgctgcaccgcaatctttccatcgatgaccaagccgctcaggttgacatcgtcaagcgctccgaatccggtatgatcaacgatccgttgaccgtcagcccggatgtgacgctggctgatctcgacaagctgtgcggccgtttccatatctccggcctgccggtcgttgacaacgacaacaagctcgtcggcatcatcaccaaccgcgacatgcgtttcatcgcctccgaggattacgaccggctcaaggtttccgaggtcatgacccgcgagaacctcatcaccggcccgtccaacatctccaaggaagacgcccacgacctgctggccaagcacaaggtcgagaagctgccgctggttgacgatgaaggccacctcaccggcttgatcaccgtgaaggacttcgtgaagaccgagcagtatccggacgccaccaaggacgaacagggtcgtctgcgcgttgccgccggcatcggcttcctgggtgacgcctacaaccgtgcttccgctctgatggaagccggcgtggacgtgctcgtggtcgacaccgccaacggtgaggccaagctggctctcgacatgattcgccgcctgaagtccgattccgcgttcaagggcgttgacatcatcggcggtaacgtggccacccgtcagggcgctcaggccatgatcgacgccggtgttgacgcagtcaaggttggcgtgggcccaggctccatctgcaccacccgcgtggtggccggtgtcggtgtgccgcagctcaccgcagtgtacgaggccgctcaggcctgccgtgccgctggcgtgccgtgcatcgccgacggtggcattcactactccggcgacatcgccaaggctctggttgccggtgcctccaccgtcatgctcggcggcaccctcgcaggctgcgaggaagctccgggtgagaaggtgctgctgcacggcaagcagtacaagctgtaccgtggcatgggctccctcggcgccatggctccgcgtggcaagaagtcctactccaaggatcgctacttccaggccgacgtcacctctaacgacaaggtcgttccggaaggcgttgaaggcgaagtgccgtaccgcggaccgctgaacgcagtgctgtaccagatgatcggtggcctgcaccagtccatgttctacatcggcgctcacaacatcgccgaaatgccggaacgtggccgtttcatccgtatcaccgacgctggcttgcgcgaatcccatccgcatgacatcgtcatgaccgccgaagctccgaactactccggccgccagtgattgctgaattccagtaatcaaaatcggtaaaagcctcttacttctcggaaaagaccgaaagtaagaggctttactcgtatctgcaacgtgaatatttataaccgaacgtcgccctatcgccaagtagcggtattgattacgaagcaaatcgcgaaaaacaaacgtgacttcccagtgcgtgggccttccaatctccctacctcgcggtatcttcgaatgttcagctgaagcgtgccaagcggcacgcgcacacgcaaaggaaacgaggcaagatggttgacgcacatgacggcgaaacgtatacagcgaaagattcgcgactgatttggatcgattgcgaaatgaccggcttggatattttccacgatgaactgtgcgagatctccgtggtaccgacggacttcgacctcaacgtgcttgacgagggtattgatttcgtgatcaagccgtctaatgcggccgttgccaatatgaacgatttcgtgcgtgccatgcacacccgttccggactcatcaacgaatgggagaacggcctgagcgtcgaagaggccgaacggaaagtcaccgaatacgtggcccgcttcaccccggacggcgtcaagccgctgctcgcaggcaactccatcggatcagacaaaaaattcctcgaccgttacatgccgaatctcatggaacacctgcactaccgtgtaatcgacgtgagcacgttcaaagagcttgcccgccgctggtatcctgccgtatacaacaaccggccgccgaagaacggcggacatcgcgcgctcgccgacatcatcgaatccctggacgaactgcgctactaccgtaaggcgttcatggcagcggcgcccggtcctgacgcagccgaagccaaggcgatcgccgatcagatcgtggcaaccagcattttgaacaacaactgattccgcatatcgcacaatcgttggaaaatctgatattccaacgaaaacatggaaaggactccagtgagcgcagccgattggaccagcatcgaaatcccgcaagacattcgcttggtggttgccgatatggacggcaccctgcttgatgagcatagcgagattccgcaaggtttctggccgatgcttgcccggttgcgctcacgaggcgttgaattcgtgccggcgtccggacgccagtacgctaccttgcgtgccatgttcgccgataaggcggcgcaggtgcttgacggcggcgaactttcgtatatcgcggaaaacggcaatgtcgtggccattgacggtaatatcgccgaagtgcacggcgtcgataccgatgtgacccgctggaccatcgacacggtgaacgcttctgccgcggctggcgaatacgatatgggattggtgctttgtggcctgcgcacggcatacgtgcagcgcacggacaagccgttccttgacgaagtcggcaaatattatgcggcactggagattgtggacgatctgcatagcgtgcttgaagatgtgatcgcatcaaacggcgaaagcgacaccatgctcaaactggcgattctcgatttcgacgatgccgaagcgatggccgcggaaaagctgacgccactgaagaacgattatcaggtggtggtttccggcaaactgtgggtcgacatcatgaatgctacaaccaataagaaacagggcgtcgaagcgttgcagcgcgtgcttggcgtcactgcggcccaaacggcggtatttggcgattatctcaacgatttgcagatgctttcggcagggcagtggtcgttcgccatgggcaatgcgcaccccgcgttgaaacaagccgcgcattttgtggctccatccaatgccgatcacggggtgcttcaggttgtcgacaagctgattgcgtaaggaagccgtttcttcgaaattgatggtcgattgaacaggaaaggcggtgcggcatgcggcaggctgaggcattggcgattctgcaaagtggcgcgagcgtcttcctgacgggtgcgccgggtgctggcaagacctacgtgctcaatgagttcgtgcgtcaggcccgtgccgaaggtgcggcggtgtcggtgacggcgtccaccggtatcgcggccacgcatatcaacgggcagaccattcattcatggagcggtgtcggacttgccaacgcgctcaccgacaatctgatcaaaaccatacgtacccgacgcaaacgtaagctgcagggcgctgacattctcatcatcgacgaggtttccatgttgcatgcgtggctgttcgacatggtcgatcaggtgtgccgcatcattcgacgtgaccaacgcccgttcggagggcttcaagtggtgctgtccggcgatttcttccagcttccgccagtgagtgtgggtgggcgcaaccacgatttggtcacaccaagcccggaattcgtggcttcccgcgaacgatatgcgaaagcgggactcaatccagatggtttcgtcaccgaatcattggtatggcgggaattgaatcccgcaatctgttacctgaccgaacagcatcgtcaggatgacggcagtctgctcaccgtattgaccgatattcgcaacggttgcgtgaacgacgacgatcgcaatgtgctcctcaccagactgggcacaatccccgaacctggtcaacaggccgtcaatctgtttcccgtcaacaagcaggcggacacgctcaacgacatgcgcctgttcgaaatcaacgaggagccgcacgaatatttcgccgaagccgcaggaccagtcaatctggtggaacgtttgaagaaaaacatgcttgcccccgaacgtttgcagctcaaaaccggggctgcggtgatggccgtacgcaacgacaccgaccaccaattcgtgaacggatcattgggtaccgtgcgcggatttgccgccgaaaacaagggcggatggccgatcgttgaatttgaaaacggcaatatcgttaccatgaagccgaattgctgggaaatgatggacggcgacacagtgctcgccagcgtcaaccaagtgccgttgcgctgcgcgtgggcgatcaccatccacaaatcgcaaggtatgacgctcgagcgtgcggtgatggatttgcggcgcaccttcgcgcctggcatggggtatgtggcgctgtctcgcgtggaaggcctgcaaggcctgtatttgaacggtgtgaacgaacgcatgttcttggtttcgcccgatgcggtgcgattggatggtgagttgcgtctcgcctcggcgcaggcatccgatatgttggctcatgatggcatcgccgcgttccggcagaacattgccgttcccgacggtgacgagttcgcgcaggacgcgctgttctagtatggcgattgccttgtttgacatgtatgatgatttttgggattcgacggatatgactgttgtgttccgtccgtgcgttgccatacgtcggtgaacgggtggttggattgggcttacgtccccttgcctgagtagttttgggcatatgactaaagcacttcgtatgtccaccatgttcctgcgcactctgcgtgaggatcccgccgatgccgatgtcgtatcggataagcttctgcagcgcgcctgctacctgcgcaaggccgctccgggtatttggacctggctgccgctgggcctgaatgttctgaacaagatcgaaaacatcatccgtgaggaaatggcttcgatcgacgcccaggaagttcacttctccggtctgctgccgcgtgaaccgtatgaggccacccatcgttgggaagagtatggcgacaacatcttccgtttgaaggatcgccatgaggccgactacctgctggcgccgacccatgaggaaatgttcaccctgctggtcaaggacctgtactcctcctacaaggatctgccggttaccctctaccagattcagaccaagtatcgtgacgaattccgtccgcgtgcaggcctgattcgtggccgtgaattcatcatgaaggatgcctactccttcacgcttgacaaggaaggccttgtcaaggcatatatggacgagcgtggcgcctacgagcgtattttcaaccgtctcgatttgaagtatgtgccggtgcacgccatggcaggtccgatgggcggtttcgaatccgaagagttccttgccccgatggaaatcggtgaagataccttcgcacagtcgccgagcggcaaggcttggaatgttgaggcgctgaccactccggaaccggaagccatcgacttcagcaacactccggccgctgaaaagcgtccgacgccgaatgctgaaaccatcgatcagatggttgaatttgccaacgccaaccatccgcgttccgatggccgcgcgtgggaggcctccgacattctgaagaacgtggtgatcgccgtgatgcatccgcaggatgacgagcatgacgagccgtggcgcgaactggtggtcgtcggcgtgcctggcgatcgtaccgttgacatgaagcgtcttgaagcgcagttcactccggctgaaatcgaagaggccaccgacgaggatctgaagaagcatccggaactcgtcaagggctatattggcccgatggcgtttggcccgcaggctcgcggcggtgaaaaggctgaaaacgccaacgaaaccggcgaagcgttgcgttacctcattgacgcgcatatcgcccgcggttccgcatggttcaccggtgccgatgaagccggagtcgactactacgatctcgtgtacggtcgtgacttcgaagccgacggcgtggtggaagccgtgcaggttcgccacggagacatgagcccggacggttccggcccgctgagcttcgaacgcggtgtggaaatcggccaggtgttccagcttggcttgaagtattccaacgcgctcggcctgaaggtgctcgaccagaacggcaagaccgtgccggtgtggatgggctcctacggcattggcgtgtctcgtgtgatggcttgtatcgctgaaacccaccatgacgagaagggcttggcatggccggccatcatcgctcccgcccaggtgcatgtggtagccaccggcaaggatgcggctgcattcgaagccgccgagcaactgatcgccgatctggaagccaagggcatcgaagtgatcttcgatgaccgtaagaaggtttccccgggcgtcaagttcaaggatgccgagcttatcggcgtgccgctgatcgccgtcgcaggccgcgacactgtcaacaatggcaccattgaagtgcgtgaccgcaatggcgagaacgccgaagccgtgcctgtcgccgacgcagcccgggtgattgccgatcgtgtcgccgcgctgctgaagtaataatcgtaaaccatttcgattattccaaggattacacggaagattatggatgcaccatagtcttccgttttttttttaaaaaaaaagtgatcgaagaattgcagaaaatattcattgggaaatcagacgaaatcctacacacctatcgacggtgcattgctgtggataagtgaaaagatatccacctactatccacgactcgcccgaaatgacgtcctctatccacattcgtcagtcgagctggtgcaagcaaagccgattcggcgatagtgatggtaccgcggaaacgcaaggaagcggaaaggcgtgcagaacccctctctcgcaacccatttctccgactgcgcgttgctttcgcaccttcatcggtgctttccgcggcccctttattaccaatgcgacagaaagggccgatcatggcacaacagcaagctctcatcaccatcaccggatatgtgggcgccaatcccacgcaattcaacaaggatggcatgccccatgccagttcgttcagaatggcgagcaccagacggtatttcgacaatcgcacacagcaatggaaggatcttcccaccacatggatcacggtgaaagcgtaccggaacctatccgagaacatctgccaatctctgaagaaaggcgagccggttatcgtgatgggcgcgctcgccacggaaacgtgggccgatcagaacggcaaaccgcagtcacgcatagtgctggaagccagcgccgcagggcacgaccttaaccggggagtcaccacgttgcgtaagttcgtcaagccgaacgaccagcaccagccggaagcgaaaggaacggaaccgcgtgtgggagccgatccgttcgtcaggcagggcagtgtggcgccggtcgaaatcgtggttcccgaagatgacgaagccgccgaattctcgggagataccggggaattcgacggcgacatatattaggcggcaccgatgccttgcatgcttggctccgattgccagccgatgatgtggtttgttaccagatgcgcacgcgctgatcgggatcgagccacatgccgtcctccggcttcacgtcgaacgccttgtagaacagatccacgttgcgtgcgatgccgttcgtgcggcattcggcgggggagtgcgggtcgatctgcagatactgctccgccagctcgtcacgattcttggtgcgccagatggacgcgtagctgaggaagaaacgctgcaaaccggtgaaaccatcgatttccggcgcttcagacagcgaagcttcaatggactccgtggaaccgttcttctcacggcctgccgcctcgtcaagagcgaacgcatatgctttgagcgcaatgttcacgccactcaggtcgccgatgttctcgccgatggtcaaagcgccgttcacatgtggagcctgagctggatcgtcggcgtatttttcggcaagctgcgttggcacgaacgcgttgtactggtcgatgagtttctgcgtgagctgctcgaaattggccttgtcttcttcggtccaccagtcgttgagcttgccgtcgccgtcgtactgggcaccctgatcgtcgaagccgtggccgatctcatggccgatcaccgctccgataccgccatagttcgcggcgtcttcggcgttcggatcgaagaacggcggctgcagaatggcggccgggaacacgatcacgttcatggtcggctcataataggcgttcaccgtctgcggattcatcagccattcgtccttgtcgacgctcttgccgactttggccagctgatagccggtctcatacaagttggcggcacgcatgttctcggcaaaaccggcattctcatgtacgtcaagcgcggaatagtcacgccaatggttcgtatagccgatcttcggcacgaacttggagagcttctccaacgccttctgcttggtttcttcgccaagccaggcggagttggaaatggacacgcggtaggcgtcgatcagattgccgaccagctgttccatacgctgcttcgacgactcggggaagtgcctcttcacatattcgcggcccacatcctcgccgcaaatgccgttgaccagcgaaacgccgcgcttccaacgcacgcgctgctgcttctgaccagacaacgtcttgccatagaactcgaaattcgtctcatcgaattcgtgcggcaactccaaggtggagccgatgatcacatgcacgcgtgcccacagcttgagatcgtcgagatccgcggccttccagaatgcgttaagaccggtgaggaagctgggctcatgcaccaccacatggttgaaaatgcctcggaaatcaagcggctgcacctgagcggcggaagtctgatcatatgcggactgccaggattcgatccatgtgtcgagatcataatcggcgagcattccgctcaattccgcataatcggtgggattataggtcttcaccgaatcacgggttgccacattgtcccaatggttcgcggcgatacgtgtctccacgtcgaggaaacgctgggcttgagcttcggcctgctcgtcatcggcggcgagcttcgcgttcttcaactgcttggccaccatatcgacgtatgcttcacgaatcggcgcataatggtcttcacggtaatacgcctcatcgggcagtcccaagccagactgttcaatatggatgatgttggtttcgggagcgcccggatcgccatacacggcaatgccgatcaggtcagggccgccagccgggttcatcgcgcccaaagagcgggtgagttcagccttgtcggcagcgacgtcaatagccttcaactggtcttcaatggccgcgagtccggaagcgttgatggcgtcgacgtcaaggaaactcgcatacagggcgtgggacttctcggcagggcagtcgtcgtcttcgagaatctcacgaatctggttttcggcatcttcagcgagcttatcgaacgaaccataacgggaacgatcatcaggaagacgatacatgtcgatccatgggccgttgacatagcggaacagatcttgcgcagggccggtcacggcggagaacgatgccggatcgatacccgaattcaaagtggtactcatggcttcacactatccatctttggtgacaaaacagtgtatctgaaacgaataatcatcattccgcaacggcatgcataaggtgagatttgcataatcgtaagaaaagccagggagagccgagcactgtagggcgtacgaagtagggttagaggcatgattgaactgaaaacaccgaaagagatcgaagagatgaagcctgccggccgttttgtcggcggcattctgcgcgatctcaaggaatttaccaaagttggtaccaatctgctggaaatcgatgaattcgtgcacaagcgcatcgtcgatcgcaagggtgccgaatcctgctatgtcgactatgctccggatttcggtaccggcccgttcgcgcactatatttgcgtttccgtgaacgatgccgtactgcacggcgttccgttcgattacaacctgaaggacggcgatttggtcagcctcgatctggcgatcaacgtcgatggctgggttgccgattccgccatcagcttcgtggtcggcgagcataaggatcctgaggatctgcgcctgatcaagtgcaccgaagaggcgctcgcggccggtattgccgctgcgcagccgggcaaccgtttgggtgatgtttccgcggcagtcggcgatgtggcccgcgaatacggctatccgatcaatcttgaattcggcggccatggcgtcggacgtattatgcacggcgatccgcatgtgccgaacgatggccgcgcgcaccacggctacaagctgcgtccgggcctggtcatcgccatcgaaccgtggttcctcaagaccaccgacgaaatctaccaggatccgaaagatggttggacgctgaagagctccgacggttcccgtggcgcgcatagcgaacacaccatcgccatcaccgacaacggtccggtgatcctcaccgttcgcgacaagtgatcagacggtagcgtaaaacgcggcaaagctccaatacgacggagcgaagcgtacgaaaagaaggccgatgcccacgattattcaggcatcggccttttatatgcgtaatttcgcgcggaaatagtcgaattatttgccttgcaggaatgaagtatcggatgtcaatcgattgattttgagacgaaaccatgcttggaaacgcgcatgccatatagtgttcgatactttcgaacggttaaggagcgtgcaagtatggccacagccaatctgagtgtggaatccaaagacttcaccctgccggtggtcgaagccacggcgggtgcggacggcatcgtggtgtccacgctgcgcaacgacggctgggtcacactcgaccctggtttcctgacgactgcgcaatgcgaatcgaaaatcacgtacatcgacggcaagaactcgatcctgcgctaccgcgggtacccgatcgagcagttgtgtgagcaatccgatttccttgaggtcgcctggttgctgcgtcatggcgaactgccgaatcaggagcagtacgaccggttcatttccgacatcaaccatcgcacgatggtgggtgaggatttccgtaccttcatgggttctttcccacgcaccgcgcatccgatgagcgtgatggcatccgcggtcaacgcgctcgccaccttctatccggacactactgatatcaatgattccgaccagcttgacgaggctgcgaccatcattatggcaaaggcacgaaccatcgtcagctacattttccgccgtcgccgcgatgagccgatgctgtatccggattattcgcgcggctatgtcgacgatttcctgcgcatgtgctttgcggtgccgtacgagccgttcgattccgacccgctgtacgtgcatgcgctcggacgcctgctgatcattcatgccgatcatgagcagaactgctccacttccgtggtacgtatcgccggttccgcccacgccaacctgtattccgcggttgcggcgggcatcaacgcgctgtcgggcccattgcatggtggtgcgaatgaagcggtgctccgtcagctcaaagccattcgcgattcaggcaaaaccgtcaaggaattcgtggaagacgccaaaaccagcggtcagcgtatttccggactcggccaccgcgtgtacaagtcgtacgatccgcgtgccgcgatcgccaagaagtatctgcagaagatcatggaacgcgcggacacgttgaaattgcctgccgacgagcgtgcgctgttcgacgtcgccacggaattggagaaaatcgcgctgaacgacgagtatttcgtgtcgcgtcacctgtatccgaatgtcgacttctacacgggattgatctatcgcgcaatcgggttcgatccgtccatgttcaccacattgtttgcattggggcgtattcccggttggatcgcgcagtatcgtgagatgcttgccgatccgaacaccaagatcggtcgtccgcgtcaggtgtacaccggttataccgaacgtgattacactccgatcgaccgtcgatagttgctttttcgctgtttcatggacttgtgatgctgttcgccaagccctgcggctaaagtattgcacggaaacatgcaagtaatgcaatcactgttgtgaaggagcgaagaatgaccgatcagcgcactgcgtggggttggggtctgtccagcgtggatgcggccggcaacactttggacgtatggtacccggaactgaagcttggcgaggctccggaggaggtggcacgcccgaaccataattttggcaatctcgcccatgagggcgtcgatgcgcgtggcgtgcgccgcattccggtgttcacggtgtcgaagcttgacgaaccgatcgaagacgcagccgacgcatacctgcgtctgcatctgctgagcatgcgtctcgccaagccgaacaccctgaatctggacggcattttcgcagccctcaacaatgtggtatggaccaattatggcccgttcgcggtcgaggatttcgcgctgcgcaagcttgatgtgatggccgcggccaaccagtgcgttccgggactgccgaaggttgacgtgaacgtgctgtcgatcgacaagttcccgtgcatggtcgactatgtggtgccgaccggcgtgcgtatcggcgacgccgaccgcgtgcgtttgggtgcccacctttccgaaggcaccaccgtcatgcatgccggcttcgtgaacttcaacgccggcacgctcggcgtttccatggtggaaggccgtgtttcccagggtgttgtggtcggcaacggttccgatatcggcggcggcgcatccatcatgggcaccctgtccggtggcggcaagcttaagaactccatcggcgagcactccctgcttggcgcgaacgcgggcatcggcatctccctcggcgacaactgcgtggttgaagccggtctgtatgtgaccgccggcaccaaggtgaccatctacgacaaggccaaggtcgcggcgggcgaaccgctcgaaaccgtcaagggcgccgatctttccggcaaagacaacatcctgttcatccgtaattccgtgtccggccgtatcgaagcgcgctatcgcaagaccggcatcgaactgaacgaaaaactgcacaagaactaaatatcaaatatgaaaatctccctcattaccgtcggcaaagtcaaggaacaatatctgcgcgacgccatcgccgaatattcgaaacgactcagccgatactgcaagcttgacatcgtcgaagtggccgacgagaaaacacccgagcatgccagtgagggagtggaacggcaaatcaaagccaaggaaggcgaacgcatcgccaagcatattcgcgacgatgcgttcgtcatcgcgctcgccatcgaaggccagcagctgaccagtgaagaacttgcgcagaaaatcgacggtcttggagtgcatggcaccagccatatccaactcatcatcggcggatcgctcggacttgacccaacgattgtgaaacgggccgactacctgctgagtttttccaaaatgacttttcctcatcaattaatgcgcgttattctgcttgaacagctgtatcgtgcatgcaaaatcaatgccggcgaaccgtatcataaatgacgtgcaatcaatgtcgcgtaatgcgtacacaggttcgcgagtatgatatggcaggattgcgatgcggcaaaatatggtgagatcgccgaaagataataagtagaaggccttgcctatactagtaccccgtgagtgactacagaagcgaacgcgagcagcgagaacgccgtcgccgcaccatggtgcgggcggtgtgcatcgtcatcgctgcggcgatgctgctgagtctggttattcctgctatctacgcaggtctttgacgcctttggtccggtatgatcctccccggacctgcaatcccatacgtaacgagactggttcgcggctcggcaggatgggaacgagtatgtgggtacgtggaagaagctgaggattgtgcgaaagccgtatgaggctccatgacagaatataaagaacgcataaagaaatgtatggtgtaaacgatggcagaatttgatttttcccaggcaatcggcgaggcgcgcgccaaatacgagtcgatttccaaggcgcttgacgtcgaccgactgaccgcgcaggccaaagatcttgaagttcaggcggccgaaccgggattgtgggacaatcccgaaaacgcgcagaaagtgaccagcaaactgtcggcagtgcagtcccagctgaagcgtctcgcttccgcaagccagcgcatcgacgacgtcgaaacgttggtggaattgggtcaggaggaagaagacgccgacacgttggcggaagcgcagtccgaagtcgaaagcattcagaacgatctggccgacatggaaatccagaccctgctcgacggcgaatatgacgaacgttccgcagtggtgaccatccgctccggcgcgggcggtgtggatgccgccgacttcgctcagatgctgctgcgcatgtacctgcgttgggcggagcgcaatgggtataaggccaaggtcatggacacctcctacgccgaagaggcgggcatcaagtccgccaccttccaggtggatgccccttatgcgtatggtcgcatgagcgtggaaggcggcacacaccgtttggtgcgtatctccccgttcgacaaccaaggccgtcgccaaactagcttcgcggcagtggaagtggtgccgctcgttgaggcgaccgatcacatcgacgtgcccgattccgaaatccgcgttgacacctactgctcctccggccctggcggtcagggcgtgaacaccacgtattccgcggtgcgtatcacccacattccgaccggcatcgtggtgaccatgcaggacgagcgctcgcagatccagaaccgtgccgctgccatggccgtgctgcagtcccgactgttggtgctgcgccacgaagaggaagccaagaagaagaaggagctcgccggcgatatcaaggccagctggggtgaccagatgcgttcctacgtgctgcatccgtaccagatggtcaaggatctgcgcaccggctatgagacttcgcagacccaggccgtgttcgacggcgatatcgacgcgttcattgaggccggcatccgttggcgtcatgagcagcgtcgcgcggcggccgaagaggcggacgcctaaaaaccacgattaccgtaatcagaacagcacatagtggaggggtacgacgatggcgctgatttcgcttgaacatgtgagcaaggtgtatccgaaaggcaccaggcctgccttggatgacatcaatctcgacattgatcgaggggatttcgtgttcctcgtgggcgcttcaggttccggcaaaaccacattgctgagcctgttgctgcgcgaggaggaggtcacggatggcgagattcgcgtcgcaggtaatgatttgaggcgcctgtcgtcaaggcaggtgccgcattaccgtcgttccatcggttttatcttccaggattacaaactcctcaacaacaaaacggtatgggagaatgtggcgttcgcgcttgaagtgattggcacaagccgttccaccgtcaaatcgttagtgccgaaagtgctgcagactgtcggtctcaccggtaaggaaaacaactatccgcacgagctttccggcggtgaggcacagcgtgtggccattgcgcgagcgtatgtgaaccatccgcagattctgctggccgacgagcctactggaaatctcgatccgaccacatcgctgggcattatggaagtgctggacgccatcaaccgcactggcaccaccatcgtcatggcaacgcataacgaggaaatcgtcaactccatgcgcaagcgtgtggtcgaactgcataccggcaaaatcgtgcgtgacgagcagcagggatcctacgattccgcactgtacttcccggatgccgaagtcgaatccaaatcgcatcaggcgttgaacggcggcgacgtcgactcgaaatatcgtgcgccgggcgcgcttgaaatgtctgatttttccgatgaggcggtggacgtggaaggcgcgacgcgagccgaaaccgcggcgaacgcggttgatgccgtagctgcggccatccacagcggcaatggtgatgcgggcatcgcgcgtctcgccaattccgtgcattccggtcgcaccggtcgttatggcgaggcgttcgctccggtggagactacgctgacctggggcaagggactgaaacttgaggatcttgccgaacaggagcatgccgattcggctgcacgttcgcagaccgaagccaatgccgacgcgactggctcttcgcctgatacaggcatggaatcaagcaaagcggctgaaaacgagcaatccgcggagccaacggttcccgctcctccggcactgccgatgcctcccgctccgcccgcgcctccggctcctccggcagcgcccgccgcgactgccggtggcgaggcgaaatccgtcgaacaatccgatgaacagcatgaaacgtccgaaagcaaggagaacgactgatgcgtttgcgtttcattctttccgaaacctggagcagcctcaagcgcaacgtgcccatgttgctttcagtgatgctcgttacattcatctcgtttctgtttatcggcgcatcggtgctcactcaggcgcagatcaccaaagccaaaggcgattggtattccaaggttgaagtggtggtgtggatgtgtcccgatggcaccagccaatccgtgaactgcaccgcgggaaccgcggcaacgcagactcagatcaatgacttgcagaaaaccattcgcaacgagcttgccgatgatgtatcgcaaatcacttttgtaagcaaggaagatttctacaacgacactttcctcaaacaatatccgaacggtgaatatcaggggcgtacgctcactgccgacgatatgcaggattcattgtggctgaaactgaagaatcctgagaaatatcaagtcgtttccgaagtgctttctggcaaggagggcgtcgatactgtcagtgatcaacggcagatttttgagccggtgttcgcagtgctgaatcgtgcgaccattgcaaccgccgcattggccgcggtgatggtggtcgtcgccattatgctgaccggtaccacaattcgcatgtctgctgcgtcacgtcgaaccgaaacggagatcatgcgtttggtgggtgcttcgaattggaccattcggctgccattcattcttgaaggggtgatcgcatcaatggtcggctccttgctttcctgcgtcactttatcggcattggtgaaggtatttatcactgattggcttgcagcctccgtgaaatggattccatatgtgaatcagatgacggtattgtggatttcgccgattttggttgcaggagcggtgctgttgtcggtgattgcatccacagtgtcgttgcataggtatttgaaagcctgagaacattccgttttgtacggattggatacgtttatctgtgtcgcgttttaagcatgggatgctatggtatggaaccaatgatgggaggcaagtgaccgaatgacaagcaagaaagctctaaaaccggccgtcgcggtgtttgcaacgggggctttgtgcgccacgatggcgattgccccgttctcgtctgcggttccgcaggcgcaagccaatacatacagcaatctggtgaatgcccagaataagaaggctgccagctctcagcgtgaagcccagttgcgttcacagctttccggtgtgaagtctgatttggccgacaagatcgtcgagctggatgaattgacaaatacgaaaattcctgcagctcaagctgcagtcgatgaggcaaatgctactgccgcttcggcacagagtgaagctgatgctgcggcttcccgtttggaggccgcgcaaaaagataaggaaaacctcgaagcgcagatcgaacagaccggcaaggattatgatgacgcgcatgcggccgtggcacagatggctcgtgaagacctgcatggttccgatgcatccactgtgatgagcgtggtgacaggttccacgagcactcaggaattcattaattccatgcagtctcgtgatgcgttgagccgtaccgaagccaatgcggcaagtgatgcggcgaatacgttgaacacgtcgatgaaccgtagcgagcgtctttctgcaatcgagaagcagatcgccaatctgaaaaccgcagctgacgaaaaagccgcttccgcacagcaggctgctgcttccgcacagacccagcgcgactcgcttgaccagttgcgtgcagaaggcgaaacccgccgtgccgaattggaaagccaacagtcgcagctgaacggcagcgtggccaaacaggcggcgcaaacggttatgttgcagtcacaggtcgattccttcaaccgccagtatgcagccgagcaggccgcagcagctaatcaaaacaatggtggcaatcaagggcagacccggccaggcaacaacaataccaatagtggcggcaacaatgtgacgcctgctcccacgcctacgcctactcctacgcctgctcccgcgccgagtaccaataacaattccggtcagggaacctccaatggcgattacggcaatggctacgtggccggccagtgcacgtggtgggcgtacgaacgtcgtagacagatgggtatcggaaccccctcgtacttgggtaacggtggccagtggtacgctaccgcaccgtcgtatggtcttcgcgtggatcatagcccgcaggtcggtgcggcaatctccttcctgcccggtcaggctggtgccgatggcttctacggtcatgtgggtgtggtggaagcggtgaatggcaacaccatcaccatttccgaaatgaacgcggctggtggcccatatgtggtgtcgtaccgcacactgtacaacgcgtcccagttctggtatgtgcactgattcatcaaggggcgtttgagctttccttgagcgttgtgtcgcgggagcgcgccgcctgaatcgttgggcggcgcgctcccatgatattgtcgattgttgcgttgcagaacacttctttgaagaaccggaaaggaggtccgacatggccaaggagcaaggcgtgaagccgattgcgcaaaacaagaaggcacgccacgactatgccattgaagacaagtatgaagccggtctggtgttgaccggcactgaggtgaagtcgcttcgagaaggccgcgcatcgctggccgaatcgttcattaccatcgaccgtcgcggtgaaatgtggcttgagggagccaatattcccgaatatctcaacggaacgtggaacaatcatgcccctaagcgcaagcgtaagctgttgcttcacgcggcgcagatcgacaagctggctcgtcaaagccaagccaagggtttcaccatcattccgctgagcctgtatttcaaagacggtcgagtcaaggcggaaatcgcattggcacgaggcaagaaggaattcgacaagcgtcaggcattgcgcgaggagcaagacaagcgtgaggccttgcgtgccatgcgatatgccaacaagcaggtgcgataagtggtaaccggaaaatttccggtttcacatactgatatacagcggtggccgtaatctttttgtagcttgccctctctagtgtatggttcagattcggtcgaatagaccgagcgagacataggagaaggatatggaagcgaagaaaagtctgaaggcggttgccgcgtgtgcgctgagcgttgcgatgctgtttgctggagcggcatgcggcaccagtgatggaagcgacgatgcggcttcgtccgatagcggttcgaaagcgagcgaactgacgggttatgacgtttcgtcggtgcagaaagacgatgacatcgccaaactgttgcccgattatgtgacgaaggacggcaagctcaccatcggcatggacacgtcgtacgctcccgccgaattccttgcggaggacggcaagaccccggtcggcttcgatgtcgatatcgccaaggctttggcgcaggtgttcggccttgaagcggatccggaaaccgcgaatttcgattcgatcattccatcggtcggatccaagtacgatatcggcatttcgtcgttcaccgtgaccaaggaacgtttggaagcggttgatttcgtaagccattttgatgccggatcggcatgggccgtgaagaagggcaatccgaacaagatcgacacgtccgatctgtgcggcaagaaggtggccgtgcagaccgccaccatgcaggagaccgaagcgaacaagatagccaagcaatgcgaggccgacggcaaggataagcttgaagtgatctccagcaagctgcagaccgatgtgaccacgaacgttgtcaccggcaaggccgacgtgttctatgccgattcgccggttgcgggctatgccatcgcgcaaaccgatggacagctggaaatgctgggcaaggtcgaaggcgtcgctccggaaggcatcgtcatcaaaaaaggcgacagccagatggatgaggccgtacagaaggccgtgcagaagctcatcgacgacggtacgtatctgaagatccttaagtattggggtgtcgaggacggtgccatcgaaacgtcggaaatcaatacgccgggcgccgaataattccatgattgaaccgtccacggatcagacggttcaatgatcgcatgactggcgacgtgctgggaacaaagcgggttttgatcatattgtgatatggcaaaacccgctttttcgtaaggaaaaacggcatatcgaatagagtttgcgtactattaacgtggccgtagcaatcgttttctatggtgcctgcaggacttcggttcggccgtattcatacggttgggaatgaagagaggatccgcgatggctttcaataatctgaggaaactcgctgtttttgcactaagcgccgccatgatcgtttcgttgggtgcgtgcggcacatcggaaaagtccgattccgcggcttccagtgattctgagtcgtcgtcgaacaccaccggttatgacgtttccggcgtgacgaaggatgacgatatagccgcgatgctgccggaatcagtcaccaaggacggcaagctcaccgtcggcatggacacgtcgtacgctcccgccgaattccttgcggaggatggcaagaccccggtcggcttcgatgttgatatcgcgaaggcgctcgccaatatgttcggtcttgaggtcgtgccgcaaacgtcgaatttcgattcgatcattccgtcgatcggcaccaagtacgatatcggcatttcgtcgttcaccatcacgcccgagcgtatggaagccgtcgatttcgtgagcatgttcaaggccggttccacgtgggtggtgaagaagggcaatccgaacaaggtcgccacttccgacctgtgcggcttgaagatcgcggtgcagacgggcaccacgcaggaagaggaagtcaacgcggccgccaaacaatgcaaggccgacggcaagtccgaagtgcagattctgtcgaataagctgcagaccgatgtgaccacgaacgtggcgacgggcaaggccgacgtattctatgctgattcgccggtcgccggctatgccatcgcgcaaaccgaagatacgctagaagccctcggcgaggatgtcggcgtgaccaaggaggccgtggcaatcaaaaagggcgattccgataccgccaaggcggtgcaggccgcactgcagaagctcatggatgatggcacgtatatgaagatcctcaagcattggggcgtggagaacggagcgatcgacaaagccgaaatcaatccgactgacctcgactgaacgatcaaacgtaaggcagacatcgcacacggcgatactgtgacgccgatatgacggaaggcatgcgggtcaaatccgcgtgtcttccgttttcgtatatggatcttccgtgattcgacggagctacattgcgcgattcttggctgatacgtaaggtttgcgcaatgtaacgtacatgtagcattgcgctcttatcgtgcctatttgagatactgaggttctctgcaaccgaatggcgttgagattttcggtatggcaatgaagagataagaagaaggatatgcataccatgtctttgaagatcaagtccgttgtggcgcttgcgctgagtgcggcgatgttgttttccactgccgcttgcggcacctccgaggcgtccaattccggcgattcgtcggattcgtcgaacgctaccaccggttacgatgtcagcaccattaaaaaagatgacgagctggccaagctggttccgtccggcgatctggtgaaggacggcgagctttccgccggtatggagctttcgtacgctccggctgaattctatgccgaagacggcaagactccggtcggctatgatatcgacatgaccaaggccatcgccaagacgcttggtttgaagccaaacatcgtgtcttccatgttcgacaccatcattccttccattggctccaagtatgatctgggcatcaccgccatgaccatcactgaagagcgtctgcagtccgtggatttcgtgagctactaccgtgcaggttccacgtgggccgtgaagaagggcaatccgaagaagcttgacacttccggcatgtgcggcgcgaagatcgcggtgcagaccggcaccgtgcaggaagaggaagccaacaccatcgccaaaggatgcgaggccgataacaaggccgaagtgatgtcgtacaagcgtcaggccgaagcggccaccgcagtggcgacgggcaaggccgatgcgttctatgccgattctccggtcgccggctatgccatctcccagaccgacggacagcttgaagccttgggcgacgtcgaaggtgtggccaagcagggcatcgctgtcaagaagggcaacacccagcttgctgaagccgtgcagaaggccgtacagaagctgatggacgatggtacgtatatgaagatcctcaagcattggggtgtggaatccggcgctctcgacaaggctgagatcaacccgaccgatctcgactgatttcatccccactatttacatcaacaacggaggaactgaagcatcatggcgaagaaacaaatcgacggcgacggcctcgatattccgaatcgcatcaaggcgctgccggttaagcgtacgggcccgattgtggcggcggtcgtcgtcgctctgctcgccgccatgctgctgcagggcctgattaccaatccgcgtttcgaatggaatgtggtctggaagtacctgttcaacgagaatgtgctcgaaggcatcaaatacacgctgctgctgacggtcatctccatgggcatcgccattattctggcagtgattctggccgtaatgcgcaagtccatcaatccggtgctgcgtggcgtgagctggttctacatttggttcttccgtggcacccctgtgtatacgcagctggtgttctggggtctgttcgccgtgttggtgcctcgcatcggcgtgggtattccgttcacttccattgaattctggagcattgactcgcagtccgtcattaccgcgtttaacgcggcatggctgggtctcgcattgaacgaagcggcatatctggctgaaatcgtgcgtgcgggtcttgaagccgtcgatccgggccagaccgaagcggccaaggcactgggcatgaagcgttccatgatcatgcgtcgtgtggtgcttcctcaggccatgcgcatcatcattccgccgaccggcaacgagttcatcggcatgttgaagaccacttcgctggtcaacgccgtgccgttcacgctggaactgcagttcgccaccaccgcaatcgcaacccgactgtacaagccgattccgctgctgatcgtggcctgcatctggtacttggtgatcacctccattctgatggtgctgcaatctcgcctggagaagcatttcggcaagggcttcgatgcgcgaccggccggcgcgcgcggcaagcagccgccgctgccgggcaaaaccgaaggcgagccgaaagacgatatcgccaagcagaacgaggcaacgttcgcgggcatgaccgcgtgaggggagtgagcaatgactgaaccaaccaccaacggtgttgttcccgcagtgaaggccacgcaggtgcataaggctttcggtagcctgcacgtgctcaagggcgtcgatatgacggttatgcccggctcggtgacggtgattctgggaccttccggttccggaaaatccacgttcctgcgtttgatcaaccagttggaaacgctgaccggcggcgaaatcgacgtcgacggcgaaatgatcggctacaagtacgtcgacaaggacggcaagcaggtgctgcagaccctgaacgacaaggaagtggccgagcagcgttccaaactgggcatggtattccagaggttcaacctgttcccgcacatgacggcgctcgaaaatgtgatggaagcgccagtccacgtcaagcacatggataaaaaggaagcccgcaagcttgccatcgaagagctgaatcgcgtgggcatgggcgatcgcctcgatcactatccggcacagctttccggtggccagcagcagcgcgtggccatcgcccgtgcgcttgccatgaagccggaaatcatgctgttcgacgagccgacttccgcactcgatccggaattggtgggcgaagtgctgaacgtcatgctgtctttggcgaaagaaggcatgaccatggtggttgtcacccacgaaataggcttcgcgcgcgaagtcgccgatcagatcgtattcatggacggcggtgttgttgtggaacagggcggtcctgaaatcatcgacaatccgcaggaaccacgattcaaggacttcctgcagcacgtgctgtaaatcgccgcaagcataatcgtaagaatcagacacctcttcgtcgtaaggattgcgatcaagggaatggctgagaaaatccccatgttgaaaactgtcagcatggggatttttgtgttcatatatcaaaggttcagcgcgatgagacggtttcgtttcgaaaatgacaccattacccgataagctgaggtgttatgtgtggaatcgtaggatatgcaggaaatgtggaaaccgcgtgcggcaagccgttggaagtgtgcctccaaggcctccagcgtttggaataccgtggatatgattcggccggtgtggcgctgaccgcgcccggcatggatcatgtggaagtgcgtaagaaggcggggcgtctcgccaatctaatcgaagacgtggaacgcaatccaatgccgatggccaccgtgggcatcggccacacccgttgggccaccaacggcgtgccgaatgacatcaacgcgcatccgcatacttcgcgtgacggcaaggtcgccatcattcataatggcatcatcgaaaacgcctctcagctgcgtcttgatctgcagacggaaggttaccgtttctcatcggaaaccgatacggaggtcgcggcgaaactgctaggcaaaatcagcgagaaaatcgttgaggaaaccggcaagcctgatctgttcaaggccgtgcgacgcttggcgcgcatgctggaaggcgcgttcacgattctcgccaccgactgccgtcagccgggtatcgtggtcggtgctcgccatgattcgccgctggtggttggtcttggcgaaggtgagaattttctcggttccgatgtggccgcgttcgtcgcctacacgaagcgtgccatggaaatcgaccaggatcaggccgtgatggtgtccgccgataaggttgtggtgtctgatttcatgggcaacatcgtggccgatccgaagacctataccgtggattgggatgcttccgcggccgaaaagggcggttgggactccttcatggacaaggagatccacgaagggccggcggcggtgcagcgcacgctgttgggacgtcttggcaaggacggcaatctcaatcttgacgaggttcgcatcgacgagcatgatttcaaggcgatcgacaagattatcgtcatcgcctgcggtaccgccgcctacgcgggcatggtggccaaatacgccatcgagcattgggtgcgtattccggtggaagtggagcttgcccacgaattccgttatcgtgatccgattctcaccccgcgcacgttggtggtggccatttcgcagtccggtgaaaccatggacacgctgatggcattgcgtcacgcgcgtgagcagggttcgaaggtgctggccatctgcaacacgcagggcgcgtccattccgcgtgaatccgacgcggtgctgtacacgcacgctggtccggaagtggcggtcgcctccaccaaggcgttcgtggcgcagattactgccgcctacgtgcttggcttgtatttggcgcaggtcaagggcgcgatgttccgcgacgagatcgcgcaggcgttggattccctcaaagacatgcctcgcaagatccagtgggttcttgatacgcagaccaagaccgtgcatgatgctgccgcgcagatggtcgatgcgaagtccttcctgttcctgggccgtcatgtcggctacccggtcgcgatggaaggcgcgttgaaattgaaggaaatcgcctacaccttcaccgaaggttttgcggccggcgagctcaagcacggtccgatcgcattggtggacgaaggcgaaccggtagtgttcatcgtgccgccggcacgtggccgcaatgtgctgcacgccaaggttatttccggtatcgaagaggtcaaggcccgtggcgcgtacattatcgccgtggccgaagagaacgaccccgatgttgaacgctatgcggacgtggtgttctggcgtccggcctgcccgacgctgatgagcccgttggtggacgtggtgccgctgcagctattcgccatggacatggccaagctgaagaattacgacgttgacaagcctcgtaatctcgccaagtccgtcaccgtggagtaatcgttcatacgatgcgtcaacagcgtcagcagaagaggcatcgttacgttcttgaagaacctcatattccgttcgaatgtgaggttctttacgagaacgatgcgattatcgtggttgacaaaccgcattttctcgccaccacaccgcgtggcatgtggtatcgcgaaaccgcgttgattcgacttcgggaacagtatggcgaacctgatattgttcccgcgcaccgtttggaccgacttaccgcaggcatcatcgtatttgtgcgcaaaccggaattgcgcggcgcttaccaaatgctgttccagaatcgcaaaaccatcaaaacctatgaatgtttggcgccacttgcccccgaacagcatccgcagtacggaacaatcgtaagaatcgacaggcatcaaccctttccggcaatccgagcatcgcatatttgcaaggatcgcgggcgacttcaggcgtacgaaattccggaaaccatcaatgcgcaaacgttgattgagcggggaagtacggtacgttgcctcgacggcaaagcatatgtgaattacgtgctgcacccgaaaaccggcaaaacgcaccagttgcgtgtgcatatgaattcgttgggattgccgattttgggcgatgatttctacccgaatattgtgcagcgttcttacgatgatttctcgcagccgttggaattggtggctcgtgagttacgtttcgacgatccggtgacgggagagcctcgtacattcgtttcgaaagtgccgcttggctgattaacggtctgatcagcaggtattgctcgctgaatcaagatatataaaaactgtccatcgctgtactcatatttgctcgcatcgctatggcgtgttgaagttgcgcgtccctataatcggacattttacatttcgtgttatcgagcgtgattaggatgtgctcttgttgtgctggctggcaaaggcaagccggctggaaagaacgagagagaatatgaaccatatttcaaaagcgcttcgtggcgttgccgacaaatataacggcgtatcactgattatccgcattatcgtcggtcttatcgcgggtaccgcactggcattggttgttccgcatatgacgtggatcagcgaattcggcaccctgttcgtaagcgcattgaaggccgtcgctccgattctggtgtttgtgctggtggcaagcgctttggctcaaggcaattccaagcttgacggccgtttcggcacggtgcttttcctgtatctgttcaccacgttcctgtccgccgtcgtggcggtgttgacgtctcgcatgttcccgcagaccatatcgttgggcgatgccgctgacgctgatgtggtgccgcagggcttgagcgaggttgtgcagacgttgttgaccaatatcgtggccaatccgattcaggccatgatcgacggcaactacatctgcattctgatgtgggcttgcctgttcggtcttgccatgaagggtattgccaatgaaagctccaaggcgttccttgccaatgtggccgatggcgtgtctcaggtgattcgttgggtcatcaatctcgccccgtttggcattatgggcttggtgttcaccagcgtttccgaaaacggcttggcggccttcaccgagtacggtagcctcctgctcctgctcgtcggcaccatgctgctgatggtgctcgtgttcggtccgctggtcattttcctgtacctgcatcgcaacccgtatccgctggtgtaccgctgcttcaaggaatccggcctgaccgcattcttcactcgttcctccgcggcgaacattccggtcaacatgcagctgtgcgagaagcttggtcttgataaagacatgtattccgtgtccattccgttgggcgcaaccatcaacatgaacggtgccgccatcaccatcaccatcatggccatggccgccgctaatacgatgggcattcagatttcgttgccggccgccattctgctgtctgtggtgtcggcgctcggcgcatgcggcgcttccggtgtggccggtggctcgctgctgcttattccaatggcctgctcgctgttcggcatcagcaatgacatcgccatgcaggtggtgggcgttggcttcatcatcggcgtcatccaggattccgtggagacctgtctgaattccgcttccgacgtggagtttgcggcaaccgccgaatatcatgcttggctcaagcagggccgtcagcttccggcgttcatgtattccaagaaggaacgtcagcagctcggcatcgaagcctgatttcacccgatttcagcttttcgttcaatctagaaggcgtctctcccacgtggttcacccacgctggagaggcgcttttcgtattggctgatttgattgattgcgttgattaaagtcgcgagatattgcgattagtcgagttccgccacggatccgcggtcgatgaattcgggggtgataagtttcttgattccagaaggcacttttttgccattgcattgttgctcgatcatggaaaaagcctcttttcccacagttctgagcttgagccgtatggtggtcagttcaagacggggcacaacgccgcggagtgaatcgtccacaccgatgatgctgacatcttcgggaacgcgctttcctgctgtcctcagtccaagcatggcaccgtatgccatttgatcgttgcctgcgaaaattgcggtgcaatccttttcgtgagccaaggccaatccggcttggtagccgctatctgcttcccagtcgccgtaatacatgggtggtgtgggaatgccgacttgcgctaatgcgtcgcgccaccctctgatgcggctctgtgctgcgcgtgaaacggtggggcctgcgatgtggtacacagttttatgccccttcgacaggaaaaagtccacggctgcagtggcgcaaccatacgagtccgaatcgatggtggggcagtggtttgccggttcctcgcaaataagcactacaggtaggttgtcggatggcttgaactggttgaagtcggtgaaatcgcgttccataatcacgattgcaccatcgagggggaggccttccacaagtttcagtgcgccggcgagtgactgatcctgcaggttatccaaggggcgaatggtgatggaatagccgctattcgcggccgctgtagtgatgccttcgaggatacgtgagttcccgtaggccgacatatgcgaaagcagtacaccaacattgttgaaatgtccgcttttcaaagcacgtgccgcataattcggcctgtatccgagatgctccatggctgcctcgaccttaagtttcgtcgctgggcgtacggcatcgctcccattagccactcgggaaacggtctgcggtgaaacccctgcttccctggcgacgtcttgcagcgagactgagttgcgtgccatgtgtatctaccttccgaacgaaaatgcgtactgtgcttaattttacatgcttacttctgtattgttttcgtcaccatgcaatttgttcgatgaagtgaatatgtggtctagaatgtgcgaaaagtagacacttttggaatatggtgttattatgataacgcaaacatttggaaggagctgttttacgggggtgtaaattgccctgtgaaatggtattgcctcgaaggagaggaatgatgtcagcaacggaagttgttgccaatatgccactgcattcggcaaccgtgcgtgtcaataaacacaaggcggattggcgtggttggaagttcatgtggccgttcgcgttggtgttcgtgttcgtgttcgtgatcccgattctgtacgcgatctacatcagcttcttccagaagcagatgatcggcggcacgaagttcgtgggaatcagcaactacattcgtctgttccacgaccagcagttctggagctcggtcggcagggtcgcgctgttcacctgcgtgcaggtgccgatcatgctgttcctgtcggcggcgatggccctggcgttggattccatgaagctgcacggcgcgaagttcttccgcatctccacgttcctgccgtacgcggtgccggccgtggtgtcgactttggtgtggggcttcatgtacggcgcgaagtacggtctggtcggctccctgaacgactggctgggcacgaacctcgacgtgctgagcccaagcgtgctgctcgcttcgatcggcaacatcgtgacgtgggagttcaccggctacaacatgctgatcttctacagctcgctgtccacgatcccgcattcgctgtacgaggccgcctcgatcgacggcgcgggcgaatggcagatcgtcaagtccatcaagctgccggaactgaagggctcgctcgcgatcacggtgatcttctcgatcatcggctcgttccagctgttcaacgagccgagcatcctgcagaacatggtgccgggcaacgcgatcaccacgtactacacgccgaacatgtacgcgtacaacctgagcttcgcgggcaaccagtcgaactacgccgccgccctggcgatcacgatggccgtgatcacgatggcgatcgcgtacgcggtgcagctcaacagcatgaaggagcagatgaagtaacgcccggtggcgcgaaccatccgcatataggggaagaaacgctaaggagcatcgaaaatgagtgacgcaacaatcgccgcgggcacggagcagaggctcaccgctcaggagctcaaagcccaggagaaggccgcgaaaaagaccgagaaggaacgcctcaagagggtcgcgcgcgacgagaaggccgagcgcaagagggctgcgaagtccggcttcgcgaacgtggcgaacccgcgcaggagcacgctgctgaccatcgtgtgcgcgctgttcgcggtgtactgcctgttcccgttcgtgtacctgctgatcaacgccacgaagacgcaggcggacttcacgtccacgttcggtctgggcttcggccgcacgttcgctttgtgggacaacatcaagaccgtgttcacctaccaggacggcatcttcggacgctggttcctgaacacgatcctgtacgtggtcgtgggcgccggcggcgcgaccctgctcgccatcatgggcgggtacggcctggcgaagttccgtttcccgggacgcaaggccgtgttcgcggtgatcatcggcgccatctcggtgccgggcatcgccctggccgtgccgcagttcctgctgttcgccaagctgaacctgacgaacaccccgtgggccatgatcatcccgagcctggtgtcgacgttcggcctgtacctgatgtggatcttctccgaccaggccgtgccgaccgagctgctcgaagccgcccgcgtggacggcgccggcgagttccgcacgttcttccaggtatccctgccgctgctcgccccggggatcgtgacgacggccctgttcacgatcgtggcgacgtggaacaactacttcctgccgttgatcatgctgaaggattcgaactggtatccgctgacgatcggtctgaaccagtggaaggaccaggcgagcaccgctggcggccaggcgatccagaacctggtggtcacgggttcgttgatcacgatcgtcccgttggtcatcgcgttcctgtgcctgcagaagtactggcagtccggccttgccgcaggcgccgtcaaggaatgaatttgttaggatagttgacaaaaaaacaaaggagtggatatgactcaacgtagagcctatcgttggccgcagccgttggctggacagcaggaacgcatctggtacggaggtgactacaacccggaccagtggcccgaggaagtgtgggatgatgacgtccgtctgatgaagaaggcgggcgtgaacctcgtgtccgtcggcatcttctcgtgggcgaagatcgagacgagcgagggcgtgtacgatttcgactggctcgaccgcatcatcgacaagctgggcgaggccggtatcgcagtggacttggcgtccgccaccgcgtcgccgccgatgtggctcacccaggcgcatcccgaggtgctgtggaaagactaccgcggcgacgtgtgccagccgggcgcccgccagcattggaggcccacgagtccggtgttccgcgagtacgcgctgaagctgtgccgtgcgatggccgagcattacaagggcaacccgtacgtggtcgcatggcatgtgagcaacgagtacggctgccacaaccgtttcgactattccgaggacgccgaacatgcgttccagcagtggtgcgaggaacgctacggcaccatcgacgcggtgaacgacgcgtggggcacggcgttctgggcacagcgcatgaacgacttcagtgagatcgtgcctccgcgcttcatcggcgacggcaacttcatgaacccgggcaagctgctcgacttcaagcggttcagctcggacgcgttgaaggcgttctacatcgccgagcgcgacacgcttgccgagatcacgccggatctgcccctgaccacgaacttcatggtgtccgcgtccggttcggtgttggactacgacgattggggcgacgaggtcgatttcgtgtcgaacgaccattacttcattccgggcgaggcccacttggacgagctcgcgttctccgcgagcctggtcgacggcatcgcacgcaaggatccgtggttcctgatggagcattccaccagcgcggtcaactggcgtgagatcaactaccgcaaggagcccggccagctggtgcgcgactctttggctcatgtggccatgggtgcggacgcggtgtgctacttccagtggaggcagtccaaggcaggcgcggagaagttccattccgcgatggtgccccacgcgggcgaggattccgccgtgttccgcgacgtgtgcgagctgggcgccgatctgaacaaactgtccgacgagggcattctgggatcgaggctcgcgaagtcccgtgtggccgtggtattcgactacgagtccgaatgggccaccgaacacaccgccacgccgacccagcacgtgcatcacgtggacgagccattggcgtggttccgcgctttggccgatcagggtgtgaccgccgacgtggtgccggtgcgcggcgcctgggatgactatgagatggtcgtattgccgagcgtatacctgctttccgaggaaacgacccgcagggtgcgcgattacgtcgtgggcggcggtcgactggtcgtgacctactacacgggcatctcggacgagaaggaccacgtgtggctcggcgggtatccgggctcgatccgtgacgtggtcggcgtgcgcgtggaggaattcatgcccatgggcgacgatttcacgggcgtgccggatcgcctcgagttgtcgaacggcgcggtcgcgcacgatatcgccgacgtgatcggctcggtcgacgggacggccaccgtgctggaaacgttcaaggacgatccgtggaccggcatggacggcgctccggcgatcgtcgcgcacacgttcggcgaaggtcgcagcgtgtacgtgggcgcgcgcctcgggcgggacggcatcgcgttgagcctgccggaaattcttgattcgctcggcatggccgaagcgggcggaaacgacggccgagtgctgcacgtcgaacgtgagggcgcggacggttcgaggttcgtgttctcgttcaaccgcacgcatgagacggtccgggttccggtggaaggcgaagtcgtggtctcctcgttcgcggacgtggacggcgaaacggcctcgattaaaccgaacggcgtgatcgtcactaagcagtaagcggacagcaagcaaataatcgcaacattatgggtgtcggcaggttgatgattgtcaatctgccgacacccatttaatttatactattcgaataaaaactaggcgtggaattccactgcagcccaactgattgctggcaaagtgcagtgaactgatccattgtcgattgttgcatgaagctcttggggtgtcactgcggttgggtcgtctgcggaattacgctgatatggattgtcgtcatgcagaataatggccttgtctatatggaagtcggatatgtcgaaatacggcagttgagacagagaagccgtaaccttatgtgcgtcggatgcgtcgcgattcaccataagcagaagaccggaatgattcgtttcgtcccaagtgattactgaatcaagggcattgaccaagccgaaagattcagtctctacgttgggagagtcgatgactggactgtaggcaatgccatgggcgtgttgtgcggcttcggcaaacggatagaagacagtttgacgccatgcgggaccgttcttttcggccatgattggcgcaatcacattgaccaactgcgcgcgcgaggcagaacgcactcggtcgcagtgcttaagcagagtgatcatcagcgacccttctaccactgcatcggctgcattgtagatatcttcgagcagacgcggtgctttcggccatgactcatgatgaagatccttgcctgattgggctttccattcagcttcctgctgattccagacgtcggaataccagacgccccactcatcaaatgacagtgctatatcatgatcgcctgtgtgggcatttttggcttcgtctgcacatgccgccacggtggagatgaacgtttgcatgtcttgtgaacttgccagataatcttgcaacgattttgccccacgttcgtagtagtaggcatggcaggagacgaaatcgagattgtcgtacgctttggtaagcacgctgcgttcccaggatccaaacgttgacatatgggcgctggaggagccgcaggccacgagttccaagcctgattccgcgagtttcatggcgtgtgcgactcggtccacggctgcggcatactcgtcagggctcatatgtcccacctgccaagggccatccatttcattgccgatgcaccacattttgatgtccattggttcggtgattccgttacgtacgcggcgatcggcaagctcggtgccgggcgctccgttgacgtattccaactcttccagtgcggccttcaatcctcgggtgcccatattgacggcaagcatgatttcggtaccggtcttcttgctccatcggtagaaatcgtcgataccgacttcattggtttcggtgctgtgccatgcgagatctcgtcgtattgggcgttgcccccgtggccctgtgccatcctcccaattgtaggcagagacgaaattgccgccggggtaacgcacgcaggtcacaccaagttctttgactagattgatgacgtcttggcggaatccgttttcgtcggctgtggggtgacttggctcataaatgcctccgtagacacaacgtccaagatgttctacaaatgatccgaaaatgcggggtggtatatcggcaattgcgctgtttttttgcactgtgattgtgctggttccggaagtcatgccgttcctttcgatgagtggtctgatgaaatgtctgcgttgcgcgagcttcgacggatatgcatacgtctagtatgcaatcatatcgtgtttgcgtagctaaacaaaatatgctaggtaactaaagaaatactgtaaaatcaacgatttgcctatttgtttgcgtaaacataacttttgtgttatcctcatgactgtcggaagggtcaatgaatgattcatagccgataatgttggtcgatgtaggaggtcggccatatttaaaggaaggaagaacgatgaagttcactgcatccaagaaaacaatcgctctggttgctgctgctgcgatgctgactagtgtcgcagcctgcgggagttcctcgaattcgagttcttcgggggtgacagagggtggtaagactgaaattacggtatggtcttgggattccactttgccgcgtaccgtgaaggattttgaaaaggccaatccggacatcactgttaaggtgaccaatgccggcacgaacaagaccgaatacacggctttgaacaatgcgctttctgcaggtaaaggtgcgccagatttggtgcagattgagtattatgcacttcccgaatatcaggttcgtggagagattgaagacctgagtcagtttggtgcgggcaagttctcggatttctatacgccgggcacgtgggcttctgtgaaacttaatggcggtgtgtatgcactgccgatggattccggaccgatggcatggttctataacaaggatgtgtttgataaggccggggtcgatccgactcgggtgaggacgtgggatgagttctacgatgctgccaagaaggttcgcgcaacagggtcctacattacgtccgattctggtgatgctggcttcttcgattccatgacatggctggcgggcgcgacgccgttctccactggttccgatggacagtccgtcaccatcaacctcagcaatgattccaaggtcaagacttttgttgatttctggcagaagatgattgatgatgatcttatcgataccaagaccgcaggctggagtgatgattggaacaagagtttgaatgacggctctatcgcttcgctgctgaccggtgcttggatgccgtacaacttgctttccggtgctcctgacggtgaggggaagtggcgtgttgctcagatgccgactccggatggatctgaaaccaattccgagaacggtggttcttcgctggcgatggtcaagacggatgacaaggccaaggccgaagctgcatacaagttcgctgaatatgcgtgccacaatgccgaaggcatcaagactcgcgtcgctggcggcgcattccctgccgataacgacactctcgcttctgatgacttcctgaacatgacctctctgactgattccgatggcaatgcgcacgaatacttcggtggtcagaagttcaatgaggagctcgccaaggctgcggccaatgtttcgactggctacaagttcctgccgttcgaggtttatgcgcgtggcgtatatagcgatgatgccggtggtgcatataccgacaagtccgtcacccttgctgaaggtgttcaggcttgggaaaagaatatcaaggattatgcatctcagcagggctacaccgtgaagtagctgcatgattccatagtggaatcggtaaatatgagcgtctgtggattgagggattgtcaatcggcggacgcttttttgagctatcagtggattgcgtggctgaatcgaagagattggaggattgtacgctggctttcgggtgactgacgtacactcgaatgcgtatgtctgtacgtacgttttcgtgtgggaacatcaaacggaaggaatcggcttgaaactggtgaaacgactcatcgccatctgctgtgcggccattatggcagtcagtgcggccgcttgcggagccaacgtcgattcccgcaccgaaatcaccgtgtggtcgtgggagccgagcatgaaacaggtcattgccagcttcgaaaaggaaaaccccgacatccacgttatttggaagaacacaagcggttacgacaatctcaacaacgccattcaagacggttacggcattcccgacgtggtgcaattggaatactatgcgttgcgccagtacgcggtaagcggccagctggtggcgatcaccgggcgtacggaaggctacggcgatttctacacgcccggtacgtgggcttcggtgcagctgaacggccgcgtgtacggccttcccatggattccggtccaatggcgttcttctacaacgacagcgtgttcgagcaggtaggcatcgatgcctccaagattcgcacgtgggacgactattacgaggcggccaaaaagctgaaaagcatcggcgtgtacatcgcagccgattcgggtgacgccagcttctacgacacgatgatctggcttgccggaggccgtccgttctccacctccaacgacggcaaaaacgtgacgatcaacctcaccgacgatgagggtacgagaaccttcaccgaattctggcagaaaatgatcgacgaaggtttggtcgccaccaatctgaccacatggtccgatgggtggaaggaagccgtgggggaggggaagatcgcctccatgttctccggtgcttggctgccgtcgctgctcatgtcgaaccttcccggaactgcgggtttgtggcgtgtggcacagatgcccacgccggatggcagttataccacgtcggaaaacggcggttcggcgctggctgtgttgcagcgttcgcgcaagcccgaagcgtcatatcgtttcatcgaatacgcatgccataacgcggaaggcatcaaagcccgtgtggacggcggtgcgttccccgccgataacatcacgttgtctgatcgggaattcctgcgcaaaaccaccgtgaccgacgaacgtggcattgaaatcccgtatttcggcggtcaggaatacaatcgcgtgctttcccaagccgcggaaaacgtgtcgaccggttaccagtatctgccgtttgaagtgtatgcgcgaagcgacttccgcactaccgtaggcaaggcctacaaatggtcgagccggttgcgcaaagagcaggacaggctgaatatcatcgcggccggtggcaaagtgtccgacaaatccgccatcggcgacgcgttgaaggaaactgattccgctgatcgtctcaaattgaaaagcggtattgcgctgtggcagaaggatttgaaggaatacggagccaatcagggcttcactattcaataaatattaattattcatataagatgtcagactataacctgaccgcagacggctacggcatgacttctgccctaaatgccagaaccgcagccgacgccatccgccagcgggaatttgatttagcgctgctggacatcaacctgccggatggaaatggttttgagatgtgcaagctgataaagccccaacacccagacaccatcgtgattttcctaaccgccaacgatcaggagagtgaccagatacggggctatgaggcgggcgcggtggactacatcacaaagccctttgtaatcggggccttgcagcgaaaaatcaaagccatgttcaccatgctgaaacaccacagaccggccaaggatatttacgacgacgggcggctgtttctggacttcccggagcagacggcttccttaaacggcaagcccctgaccctatccccgatggagtacaaaatgctgaacctgttccgcaaaaatccccggcaagtgctgacccgcgggcagcttttggaaaaactgtgggatatagacgaaaggtttgtggacgaacacaccctgacaacctccatcagccggattcgcagcaagatcgaagccgacggcggcgcaccctacattaagaccgtttacggcatggggtatcgatggacgggaggcgaggcaaaatgaagtttcaaaacctctcagtaaagcggctgtttggccgggtggcaatagggttgtcctctccgtgtccgggatcaccatagccctgtttcttgtgacaaaacaggttgcggtgctgctgacgggcggggcgccgctgcttgtgcgcccttgtggggatttttgtactgacgcaggcgtttggaaagcggttgtcacagtttaccgctgacctgtgccagactttaaaccacatgatcgccgggaatgaagcgccccagcgcccagaggacagcgaaacccagcttgccagaatcggacaccggctggcaaggctttaccagatcatgcaggagaaccgccgccgggtggacgagaaacggcaggagttacaaacccttgtatcagatatttcccatcaggtaaaaacgcctgtaagcaatctgaaaatggcgacggacaccctgctggaaaagcccatgaccgaggtggagcgcaccgattttatccggggaatccgcagccagacggataagctggactttctctttcaagcccttgtgaaaacctcccggctggaaacggtcgtgatccagttggataagaaatcgggccgcctctttgataccgtggcgcaggccatgagtgggatcgtgtatgcagcggagaaaaaggaaatcgccgtgtctgtggactgcccggaggatttgaccgtttcccatgacagcaagtggacatccgaagccctctttaacctgcttgacaatgcagtgaagtacaccccggcaggcgggaagatctctgtgtcggtggtactgtgggaagtgtatgtggagatcaaagtgaccgacaccggcaagggcatttccgaaagcaatcaggccgccatcttccggcgcttctatcgtgaggaagaagtacacgagcagcagggcgtgggcattggcctgtatctggcccgcgaaatcgtaacgtggcagggcggctatatcaaggtgatttcggagccgggcaaaggttcgaaattttctattatgctccctacaaaatgaaagtaaatgagcgaggtgtttctattatgaatgaacgagaaaaaacgatccgactgtggtttgatatgtggctttatcagaaagatatgggtattgatgatatttttacagaagatgtcctctatacagaaagttggtgtccccagtatagcaatcgtaaaaccgtaaagcattggtttcaggaatggaatacccgtggaaaagtggtaatttgggaaatcaggcaattcttccataaagacaatcaaacgattgtagaatggtatttcaaaaatgaaatgaataatggggatatagaggaatttgacggcgtttctttggtcgaatggacagaggacaataaaataaaagcattaaaagagtttgggtgtaaccgtaatacttataatccctatcaagaaagcgacatccctcaatttagaaatcaaaaggcgaattggttttagaagtgtatgaagttctacgcaattcggagaggcttgtattttcttaaaatacaaaaataatgatggttgtcttgtattcgattgaaagcaagacaaccatcattattatgtactgagattgcacatatctaaaatataagattttctatcgtacgttacgctcgtaaatatgcagcatgcctttgaaaatcagatcagggtcataaatgtcgatcatgtcggtatcgtcggcgaacacgcggcttaatccgcccgtcgcaaccacgcggaaatcctcgtcgatttcacgatggaattgcgcgatcgtacgttcgatgccgccaaggaagttgtaatacaggccggcctgcatggctggcctggtgcttttcgccagaatcgacgaggggcgcgtgatctccacttccggcaactgggccgtggcatcccacaaggcggccgcgcctgtgcgaatgccggtggtgatgagcccgcaaatcaccgacgcatcggcggtcacatagttgaatgtggtggccgtgccgaaatccgccaccagaatcggcccgccatactcgtagtaggctcccgcacagtcggcaatgcagtccgcgcccatattctgcggattgtccatgcgaatattgatgccggttttgactcccggtccaacaatcatcggatcgatattgaggaatttcacaatgctggcacggaacgaatgcatgaccttcggcaccaccgacgtgatgatcacatcgtccacatcgcccggcgcatagccgctcagccgcaggaattgcgtgatcatcaggccatattcatccgacgtgtggttcgccttcgtggtgatgcgatacgtgccggcgatatgcccgtcatcgagaaagccgatcaccacattggtgttgccgatgtcgactgcgaccagaagcatgtcgaattctccttacgattgctgtattgacgctatttcctgtgatgttggttgatggttacgatgcttgcgattcagcggattcggtattgcgcaacgctgccaattcggtgaggatgcgttccgccaattcctgcttgctcatcttgttccaatgctcgatgatcggttcgtcggtggtttcgccgggtttcagcacggtcaccacattcgtatccaccgcgaatccggcgccgggagtgttgagattgttggccaccagcatggaacaatgcttggatgtgagttttttcgctgcgttcgattcaagatcctgcgtttccatggcgaaaccgcacaaggtttgaccggcggttttatgcgcgcctgcccatgcgagaatatcgggattcgaagtgagccgcagatcgatattgacgcgcccgttcttcttgattttctccgaagactgctcaatcgggcggaaatcgccgacggcagcggccataatcgtcaaatcggcctgcgtgaaatgctcttgcaccgcgttgaacatttgctgcgcggtggtgacgtgaaccgtatcaatgccgcggggagcgctcaatgtgacagggccggataccagcgtcacatccgcgcccatatcgcgtgcctgctcggcgatcgcatagcccatttttccagtggaatgattggtgaggtagcgcacgggatcaagcggctcctgtgtggggccggcggtgacgagcacatgcaatccgtgcaatggcaacgtttctgcgggctggtccgcacgcagcagatcagctacggcagcttcgatcgcagcaggctcctccatgcgccccttgccaacatcctggcaggcaagcataccggatcccggctccacaatggtccatccaagttcacggcaggcattgagattgcgttgcgtcacggcattctcatacatgtgcacgttcatggcagggcataggattttcggtccctcgctataggcaagcacggtacttgtcagctggtcgtcggcaatgccgcatgcgattttcgcaatgatatcggcgctcgcgggagcaatgacgagcatgtccgcccatttcgcatcatccacgtgattgatatgcagcggatcggatggcgtatgcgcaacatcgccgtcattgcgctgtgctgcgaacatggacgtgcgcgtctgcgtatgcgtgagcgagctgaacgtcaacggggtgacgaactcctgcgcggccgcggtcatggctacgcgaacctcatgtccctgcttgctccagtcggaggcgagatggcaggccttgaatgcggcgatgctgccggtcacgccgagaagaatatgcgccatagccgatattgtccttcccttgacgttggcaagacttacgaaaactgcgtcaagtatatatcgaaccggctgaggcatgcggcattgcggcattgccgtcagatgaatcctgcgggcatggcggattgtagaatcagactttggtgatcgacccgtacaggcggtcaaccagaacaaacacataatcaaacaggagcaatcatgtcgcaatcttcaggtgcgtacggcgaagccgacgcaaccgaacagaagaacgaacaacacaacaatcagcccgcaaactcggcaagcaccgacgcaactttgaacgcgcgtgccaaatcaccgaaatccaaggggcccaacaagtggatcatcgccatcattgcagtgatcgcagtggtcgccatcattgtgggcgtcgtcgtgttccgtaacaacaacgcatccagcgataccgcggaaaatggcgcctccaacaccgtgaccattggactgaaactcgcccccgtaagtctcgacattcgtcaccagtccggatcggcgatcgaacaggtgctgatcggcaatgtgtacgaagggctgctgtcgcgcgattccgacaacaaagtgcagccgggactggcgaaaagctgggatatttccaacgacggcacaacgtatacgttccatctcaacgagaacatgaacttctccaacggagacacgttggacgccgaagatgtggcctggtccattaaccagctcaaagaacagcagtattacaacgccaatcaggtcgaaagcctcgaaaaagccgaagcggtcgatagcgacaccgtgaagctcacgctcagcacccccgattccaacctgctgtggtacctgaccggacgccccggcctggtgttcgataaggacgccgaatacaacgcgaaaaccgaagccgtcggatcgggcccgtacacggtggaatccttcgattccgccagcaaaatggcgctcaaagccaacccgaagtattggggaagcgcacacaaggccgcaaccgaaaacgtgatcatcaaattcctcaccgacgataacgcagccgtcaacgcgctgaaaagcggcgaagtcgacgtgctttccccggtgaacgccacgctcgccaaatcgcttgacaccaacacgtatcaggtgtccgcggcggacggcagcgacaaatacgtgctcgccttcaactgcgcgaacagcaagcttgccgacaagcgcgtgcgtcaggcaatccgttacggcatcaaccatgaggaaatcatcgcttcgcgcggtaacgtcgactatgcgctcggcgggccgatcccatccgtggacccgggctatgaggacttgaccgacctgtacccgtacgatgtgaacaaagccaaggaattcatggctgaagccggctattccaccgataatccgctgaaactcaccctcacctacgccaacacgtacggcacggaactcggcgaccaactgcgtagccagctcgccaaaatcggcattgatctcagcatcaactacgtggaattctccacatggctgcaagacgtgcacgccaacggcgactatgaactttcgttggtggaccacgccgaaagccacgacttctacaagtggaccacgcccgactactacttccactacgacggcaagcaagcccaagaactgtatgccaaggcgctcgccgccaccgatgaggaatccagtgcaaactacctgaagcaggctgcgaaagcagtaagcgaggatgcccccgccgactggctgttcggctatcgtgtgacggtggcatacaacaagaacgtgcagggattccccagcaagctgagccagacggtgctgccattgtggcagatcaccaaggcgcggtgaatcgacgaaaaatcgatggaaaatcggcggaaaacaagtgatgaaaactgatgtgtggcggtgtttgcagcggcatcgttgcggcaccgccacacgttggcgcgatattgttgggtagggtaatgacggtgaataggtgcgtatcgctgcaaacgcacggatcgagcgatagaccaatggtggttcaactatgagatttgtagtcaaacggctgggactgttcgtcgtggccctgttcggtctgtcgcttctggtgttcgtgctgttgcgcatgctgccgggcgatgtggctgcggtgatcgcaggaacgaacgcagcccctgaacgtatcgcgtcgcttcgtaccgaacttggcttggacaaatcgtacgtggcgcaatacggcgattggatgctgggattgctgcatggcgatcttggtgtgtccaccatcggaggcaaagcggtgtcggcacaggttgcgtctcgtgcttcggtaacgtttccactgatcatcgtgagtttgctgatcgcattggcgatcggcctgccgcttggttgcgctgctgtgctgacccgtaatgcccgcttgcgtgggctttgtcacggtattgcgattgttgccggcgccattcccgcattatggggcggattgctgttgattctgctgttctcacgcggttcaggactgttgggattgctgcctgctcaaggttttcccgataatggctggggcgcgcccttgcaggcgttggcttctttgatacttccggcgctcgccaccggcgttaccgcaggcgcgtccattatgcgttacacgcgtgccgccgtgggggacaaggcctcgtctcaggcggtcgacatggccatggcatgcggcatgacccgcaaacaggcggtattgcgcgtcgctttgcgtcttgccacaccgcaattggtgtcggtgatcggtttgacgttcgcccagatggtcaccggtgtaatggtggttgagaatctgttcgcgcttccggggcttggcaccatgctggtcaccgatgttggcaatcgagatctgattgcagtgcagagcgaattgttcctgttggctacgttcttcctcttgcttggattagtggttgatgtggtgcatcgtgcgcttgatccgcgtctgaaagatgccggattggtgtcgggggaggtgcttgcatgatgaaacagtctgctgagaaaactacttcgaaaaacgctgtgaaaaccgtgattccctccatatggcgtaccgctggtggcaagtattcgctgatcatgcttgcgatatggctggttgtgtcggctatttcgctggtgtggacgccatattcgctgcttgatactgacggattcaacacgtgggcttcgccgtccggcgctcacatgttgggtactgatggtgttggcgctgatgtgttgagctggctgatggccggttcccgtacgaatcttgcgatcgcgctgcttaccgtggtggttgccgcggccatcggcctgctgctggtggcggccatggtgtctcgccatggcgcattggcttccacgtcggtggttgtggtggatgcgttgatttccattccaacagtgctgatcgccttgatgctttccgtgccgttcggcgcgtcggcagcggtgatcatcgccgcatgcggacttgcatacgggctgaatttggcgcgtattctacgccccgcggccatgctcgccgcacgttctgaccatgtggaatcggctttgtggtcgggtgcgagttcgttacgcgtgtttttcacgcatattgtgccgaatacggttccggtgttatgcgttcagctgtcgatgagtgcgggcacgtcgctcttggcggaggctggattgacgtatctgggtgttggcgtcggtgcgggagtgcccagttgggggcattcgcttgccacgtccgtgaaattcatcagcatttatccgatggctgtggtgtggccgggattggtggtcaccttgatggtgatagcgctgaatctgtttggcgatgcgttgcgtgacgccatcgatccgctgacgaatccggcattgcggcaaggtgaagccacccatgttgaatcggaggaacgcgcatgagcgtcagcatccgtaatctcaatatcgtcatcgatggaatgccgattgtgcatgatgtcgatatggacatcgccgacggtgaacgtgtcggtttgatcggttcgtccggttccggcaaatccatgatcgccaaatccatcatgggcttgctgccgctttccgcgcaggtttccggcagtattgacatgggtggtactgaaatcgtcggagcgtcggatcaagcgatcgccgatctgcgtggtcgttatgtgggcatggtgttccagaatccttccgccgcattgaatccggtgatgaccgtggcgcagcaggtcgcgctgccactgcgtttgcattacgatctgacccgtgacgaacggttggaccgtgtcaaagcaatgttcgccaaagtcaggctgccggaagatgtgctgaacaaatatccgcatgaactttccggcggacaacagcagcgcgtcggcatcgcggccgcattggtcacgtcgccgcgcctgattatcgccgacgagccaaccaccgcgctggattcgatcacgcaacggcagatcgtcgatctgctggcatcgttggtggacgattccggcgcatccatgctcttcatcacccacgatttcgcggtactcaatcatgcaaccacacgctgttatgtacttgctgatggacgtgttgccgaatcaggacaaaccgccgatatcctgcagtcgccgcacactaaagtcgcttcgcaattggcgacttcggcacgtgcgctgtcgttgcggatcgatgccgaaaccaaataaggagaacggttgtgacgggcgaaaacgaaaaaaccacaatgctgcaaggtcgcggcatcaacaaatactacggtgcgaaacaacagcgtcgtcaggtgctgcacgatgttgatatcgacgtacgttcgggggagtgccttgcggtgatcggcggatccggatccggcaaaaccacccttacacgagtattgctggggctcgaacacgctgaaacgggcgagattacgtatttcggcaagcctgtgcaaggcgaagtcgccggcgaactgcggcgtagctgcggattggtgttccaaagcccattcggctcgttggatccgcgttggagggtcggcagatccgttgccgaaccattgcggttgcatcaccctgattggtcgcaggaacggattgcggaacgcgtgtcggaagccttccgcatggtgagtctcgaccctgccgcatatgaaaatcggttccccgtggacctctctggcggtcaggcgcaacgcgtggccatcgcacgtgccattgcggatcatccgaaagtattgcttgccgacgagccgatgagcgccgtcgacgtggccgcacgaacgcagattctcgcatcgttcgctgcgattcgtagcggcgaacctgatatggcgctgatcatggtgtcacacgatttgggagtggtgcagcatatcgcagatcgcattatggtgttgcacgacggttgcgttgaggaatgcggacttacggaaaccgtgttgcaccatccgaccagcgattacaccaaacgattgctggacgcggcttcgctctgatttgtgacactgcgcaaaaagcctgcgatcatgttgaaatccgcatgattgcaggcttttttgccgctatatgaacaggtaagacacgccgatgtcgttacgtgtgctattgtgtgagccatgttcaatttctcttgttgttgctgtcgctgaccaaccgcccgaggggcgcgtggttcatcgaagcataacttgagacagggcattctttttcggcatacgcaacttgcgttgcatgccagagtatcgcagaaatcatcccataaccagtgccttacgcggttggtattacgcggcatatgtggatgaaccgcagcgaaaacaccatcacaggtcccgtttcaaatcattgcaagtgataaacgcgagcttctcgaaatcaaaacaacgaaatcattcatcggaagccaacggaaatcactcttcgcaaggaaacgacatgaccatccacaactccctttccgagctcatcggcaacactccgctcgtcaaactcaaccatgtgaccgacggcatcaaagccaccatcgcagtcaaagtcgaatatttcaatcctggcggctcctccaaagaccgcattgcggaacgcatcatcgacgcggccgaacgcagcggcgaactcaagccgggcggtgtgattgtggaaccgacctccggcaacaccggcgtaggacttgccctcgtggcccagcagcgcggataccgcaccatcttcaccctgccagacaaggtttccgaagccaagcgtgcggtactccgcgcatacggtgcagaagtggtggtaacccctaccgatgctggtccggatgatccgcgctcctactaccaggtggcggaacgcctcgccaaagcgattcccggcggataccgcccgaaccaatacgacaacccgaacggaccggaaagccactaccacaccaccggtccggaaatctgggaagccagcgaccatcaggtcacgcatttcgtggctggcatcggcactggcggcaccatttccggcaccggacgctacctgaaggaagcttccgacggcgcagtacaagtgatcggcgccgacccggaaggatccatctattccaatccgaacgacgtgcatcagtacagcatcgaaggcgtgggcgaggatttctatccgaaagcgttcgaccgtgaacttcccgacgaaatcgtgcaggtcaacgatgccgaagcattcgaaatgacccgccgtttggctgcggaagaaggtctgctggtcggaggctcgtccggcatggccgttacggcagcgcttaaatacgcacgcgagcacgatttggacgaagaccagctggtcgtggtgttgctgccggattccggtcgcagctatatggaaaagatcttcaacgacgattggatgcgtgccaacggattcgccgacgttgtggaacgcacgtccaagccaagtcttgcggagcggtatctgtagaccgccaattcatatctcaacatcatgcccatcattcgttcaacccaaaccattcgatattttcaaggagttcccatcatgaccatctcgaccaacaccgaagccctgaacgccactgcactcgccacccgcgccattcacgcaggtcaggaacccgatccgaccaccggagccgtggtcactcctatttatatgacatccacgttcaagcaggatggtgtcggcggcctgcgcaacggttatgattacagccgttccatcaatccgacccgcaactctttcgacgagcagctcgccgcggtcgaaggcgcgaactacgcgctgagcttcgcttccggactggccgccatcgacgtgctgttgcgtgccacgttgaagccgggcgacaatattctgctgggcaatgacgtatatggtggcacctaccgtttgctttccaaggtgttcgtgccgtggggcgtcggtcttgacgtggtggacatcaccgacacggcggccgtttccgcggcgctcagccagaagcagtaccagtacatttgggtggaaaccccgtcgaacccgctgctcaacatcaccgatatcgcagccacgtcagcggtcgctcacgcgcatgacaccaaagtggtggtagacaacaccttcgcatccccggtattgcagcatccgttgacggatggcgccgacgtggtcgtatattccaccaccaaatacatcggcggacattccgacgtggtcggcggagctgtggtgctcaacgacaaggaaatccgcgatgaagtggcgttcctgcagaacgcggccggagctgtgccatctccgttcgactcctggcttgacattcgtggcctcaaaacgttggatctgcgcgtcaagcagcacagccgtaacgccatgaaggtggcgcaatggctggaaacccgccctgaagtggaacgcgtatggtacccgggactggaatcccatccaggccacgagatcgcggcacgacagatgcatggcggcttcggaggcatgatctccgtacagatcgcagccggattcgaagcggccaagaagttcgccggtgctacggaagtgttcactttggctgagtcgttgggaggcgtggaatccctgattgagcatccgggcgccatgacccacgcttccgttgccggtaccacgctggaagtgcccgccaatctcgtgcgactttccgtcggtcttgaagatgctgacgatttgatcgcggacttggagcaggcatttcgtcgtgtttgagataagatcgcagcctcgttacggttttgtgtaatccgtcaaaaaggcaaaacgtgcataaatcctcgccatcggattcgccaaaagcgtatattatgctatttcgaatctgcttatggcgagggttttgccatataatactttcgacaacgttcgtgttcatctaccagcgcattctctgtggaatcgaacgcccatgattatcgagacgaggcggcatgctgcaaattcaaggcatctccaaacagtataaaaccggcgacttcgtgcagcgggcgctggataacgtcagccttaacctgcgtgacagtgaattcgtggccattctcggaccttccggctccggcaaaaccacactgctcaacatcatcggcggacttgaccactatgattccggcgatctggtgatcaacggcatttccaccaaacaatacaaaagccgcgattgggactcctatcgcaaccacaccatcggtttcgtgttccagagctacaatctcattccccatcagaccattctgtcgaatgtggaacttgccctaaccatttcgggcgtatcgcattcggagcgtcgagagcgtgcgcgcaaggcgcttgaacaagtgggtttgggcgagcatgtcaacaaaaagccgaaccagctttccggcggtcagatgcagcgcgtggccattgcgcgcgcgttagtgaacgatccggacatcgtgctcgccgacgagccgaccggtgcgcttgattccgatacttccgtgcagatcatggatctgctcaaagaggttgccaaagaccgcctcgtggtgatggtgacacataaccccgaactggcctaccagtatgccacgcgcattgtggagctcaaggacggtgtgatccgttccgactccgacccgttcgaaccagcccagaacgaaacggccaccgctcccgtgcacaagaccatgggccgcgcatccatgtcgttcggcacgtcgttggcattgagcttcaacaatttacgcaccaagaagggccgcacgttccttacggcattcgcaggatccatcggcattatcggcatcgcattgattatgtccgtttcggcaggcgtgaacacttatatcgacaatattcagcgcgagacgatgactgcttacccgatcagtatcgacgaacagaccttcgacctgaccagcatgatgacttccggtcagcagagtgcggacaatcaaggcaagaagcataagagcgacgcgatttatccggatgatgccgccatcaagggcaccgcttcgatgaccagcagcattaccgaaaacaatctgagcgcgttcaagaaataccttgataataaggacagtgacatcaatcggtatatcggttccgcgggaatccagtattcgtatgatacgaggttctccgtattctcacacgatccagacggcacgcttgtcaacgccgatggtgtgacggtgggcaaaaccggcaccaaatcgatggccgaccagatggcggatggttcgctgatgtctgccgactcgtccacctttacgtcgacgcgcgtgagcatgctcacgggtaaaaccgaccagaatgctgcaccgagctcgttccatgagatcatgccaagcgctgatggcaaaaagaacgtcggcaaggtcatttccgacaattatgaggtagtcgaaggatcctggccaaagaacaagaacgaggttgtgctcgtacttgacgagaacaattcattgtcgttaaccgctgtgtatgagctaggcctcaaatccgccagtgaataccacgatatgatgaaccagctcaattccggcgacgatgtgaaaaccgataccaagaagattgactattccgacgttatcgaccgcacgctgaagctgctgccggcctgcgaccagtatgtcaaaggcgataacggccattggacgtacgtgggcgacgatgtggaccagattaatgcgctgatcgactccgacaaggccatcgatctgaagatcgtgggcgtggttaagccggtagaggatgctgacgcaaccccgctttcctccggtgtgggctatacgcgtgctctgaccaatgagctgatcgaccgtgccgaatccagtgaaatcgtcaccgaacagcagtccgataaagaccacaatgtactcaacggcatgacgttctcgccatccgacgatgccaccaaggcccaggatgcccgcgattacgtcgcatccctcggcgtaagcagcaaggcgcagatggcgcagaacatgatggcggccgcagacgcatccggaggtgactcccagcaggccgcggccatggctcagatgggcgaacagcagctcgccgaccaattcgacgcctatatcgccaccgccgacgaggccacgctggtcgccatctacaaccagtacgtgtccaccggctcctacaacgataatctcgctgatttcggcgtggtcagccgtgacgcaccaagctccatcaacatttacgtcgacagcttcgaagacaagaattccatcaacgacgccatcgacgaatacaataagaccgccaaggaaaaagacaagatcacctacaccgactacgttggtctgatgatgaactcggtaaccaccatcatcaacgtcatcacctatgtgctgatcgctttcgtggctgtgtcattggtggtctcgtcgatcatgatcggcattatcacctatatttccgtactggaacgtaccaaggaaatcggtattctgcgcgccatgggcgcatccaaacgcaatgtgtcgaacgtattcaacgcggaaaccggcattatcggcctgctggccggtctgatcggcgttggtgccaccgtgctgctcaacttcccgatcaacatcgtgctgcaccacttcatgggtaccaccgaggtcagtgccgtgctgccggtcggtaatgccatcgctctggtgattctcagcgtagtgctcaccctgatcggcggcctcatcccaagtcgtggcgcctccaagcaggatcccgccaccgccctccgcaccgagtagaggcggtggatactagactgctgcgtatgacagagtttacgtcggcgcgtgacgccctacgcacctacttcggatatgacgccttccgtcctggtcaagaaggcatagtcaatgcgattatccaaggtcgtgatgcgctcggcgtcatgcccaccggtgcaggcaagtcaatctgctaccaaattcctgccacgcttcttccgggcatgaccgtcgtcatttccccgttgatctcgttgatgcgcgatcaggtcgacgcgctcaacgacgtgggcattccagccgcattcatcaataccacgcaaagtcccgacgaacaggatctggtgttcgtgcaggcgttgtcgggacggatcagactgctgtatgtggctccggaacgtttggaaaccgaacgtttccgcacgttcgccagtcgtgtgccgatttctctggtcgccgttgacgaggcgcattgcgtgtcgcaatggggccaggatttccgttcgtcatatcttggtatcggcgattttctgaaggcgttgccgacccgtccgacggttgccgcgttcactgcgaccgcgacggaacgggtgcgccgcgatattatcggaattctcggattgcgtgatccgtccgtcaccgtcaccggcttcgacagggccaacctgtatttcgacgtgatcaggatggaaaggaaacataaggcttcgtgggtggcttcgtatattgcggatcatcctgacgaatccggcatcgtgtattgcgcgacccgcaaggaagtggagtcacttgccgaatcgttgaatatcgccgtgcgcgagctgcgtgcggcgaaaggtgaggatgcgacgcgaatcggcacggtcgcggtcgcctatcatggcggtatgtcggccgaaacgagggatcgggcgcaacgtgatttcgtaaccgaccgtgtgcctgtggtggttgccacgaatgcgttcggcatgggaatcgacaagtcgaacgtgcgttatgtgatccaccataatatgccggaatcgatcgaagcgtactatcaggaggcaggtcgtgcggggcgtgacggcgagccgagccggtgcacgttgctgtggaatgaatctgatattgctacgaggcggaggctgcttgattcggattatgagaacgagcgtttgaccgctgaagagcaggaggttgtgcgtgcatcgaaacggcgtctgctcaacgctatgatcggttattgccgtactacggattgtctgcacgagtatatgaccaggtatttcggcgaggccgggggagcagccgtccgcgatgacggcgcatgcgtgggaggatgcgcgaactgcgggaatacgtttgaaaccgttgacgtcacggatatcgcgcgggccatcagccgctgcgtgcatgacgtgaaccagaaggtcggttcggggaagatcgtcaaagtgctgcgagggtcaaaagcgcaggatttaaactatcttcatcctgtcgatctgccgacgtacggcatgttgagcgcgacttcggaggtacagattcgtgacgtgctcagccagatggcgacggatggttttctttccatttcggaaggctccatgccgatcgttcgctttggtgaacgtgcggcggaaacggtagcgccgaattttcattatgaaatcaagaagatcgaacggaagcacgctacgaaacgtgcggaatcgccgtccgtaggctctcaggccatgggatcgtatgtgccgggcgacggagacgaggaattgttcgccaaactgcgcgcgttgcggcttgacatcgcccgcgaactcggtaaacccccgtatatcgtcttttccgataaaacgttgcgcgatatggtgcgtgtcaggccggtcaccggcgagcaattctcgcaagtcaatggcgttggtgcgctcaaattggaagcgtatggcgaacggttcatggaagtgatccgcgatttcgttgcatgaatcatgtgacgtgtcagcttgaggaataatcgtatcgattattgcaaaaccctgcgttttatatgatacgtaacacgttatcggcaacatgtatggcggtgaggttgacgtatgccggcaaaacggcgacagtagagacgaacagttgttgaagaaaggattgatgatggcagaagacaagccggttgtggaaagcttccagctcgaccacaccaaggtgaaggctccgtatgtgcgctatatcgacacgcagaccggtccgaatggcgatgtgatttccaattatgatttgcgtttggtgcagccgaatgagaatgcgattccgaccggtggcctgcacaccatcgaacatacgattgcggtgctgttacgtgaacgtatcgacggttatatcgattgttccccgttcggctgccgtaccggtttccacctgttgacgtggggtgagcattccacagaagaagtggctcgcgcgttgaaggaggcgttggaattcatcgcatacgaggccacatgggatgatgttcctgccaccaccatcgaaagctgcggcaattaccgcgaccatagcctgttcacggcgaaggaatggtgcaaggatattcttgccaagggcatcagctctgacgcgtttgagcgccgtctggtctgattcgcgcgtggttgcaagtctgcttttcgggcatattgcgaatactgtgccgtgggcatggtatttttaacgctcggaagaagacaaggcgatgcaaaggtgaacgagatgggtgaggagagcgtcattacttctgaacggcggttccgccgcgccactatggctgattggccgaccatgcagaagatttatgagcatgcccgcaagttgatggcctccaatggcaatcccacgcagtggggtgataagttcccgcgtgaggaagtggttcgtgacgatatcgaatcgcaacgcactgtgctgcttgttgatacggttgatggcgaggaacgtgtgctcgcccagttcgcattgtgtccgggcgtcgacccgacgtatgtgaatatcgatggtgcctggctggatgacgatccgtatgtgaccatccaccggattgcctcgtcgggtctcgccaagggtgcggcgaaggactgcatcaactggtgcatcgaacattacggcaatgtgcgtgcggatacgcatcccaacaacaaggccatgcagcatgtgctcgaatcgaatggttttgcgcgctgcggcttgattcagttgcttgacaggccgttcgataccactcgtatcgcctatcagcgtcatgaatggtgagatttgcggatttatatggattggtatcaatcaatataaattcatcgcaaacaatcgcaaacaatcttcgatattgagaaacaaaaatcccgttgaatatcgtatttcagatgttcaacgggatttttatatccgattgcgttgtttttgatatatcttacgaaagatatatcaaaaacaacagtattgccggtttttagaacagtcctggctcgttcaatgcggaatgcttgcggctgtacacgaaatacacaatcaaaccaagggcgaaccagattgcgaaacgcacccaagtctcccaattcaaaccgcaaatcagaatgaagcagaaaatgattgcgcagatcggcgtgaacggtacgcccggagcgcggaagccgcggtgtgcgtccggctgggtcttacgcatccacagaatgcctgcggacacgatgatgaatgccgacagcgtaccgatgttcaccaattcgaacagcacgttgatgttgatgaaaccgccggcgatggccgttagaataccgaagaaccatgtacctttgaacggggtgcggtacttcgggtgcacttcgccgaagaacttcgggaacaggccgtcgcggctcatggcatagcagatgcgggactggccgtacagctgcaccagcatcaccgtggtcatgccgatcagagcgccaagattgacaacgaacgccagccagttgagaccggtttcgagaatcacgccggccaccggagcatcaatgaagtttgcgaactccttgtatggcaccacaccggtcatgatcagcgtcatgacgatgtagagcacggtggacacggccagcgagatcagaatgccgcgcggcagtgtcttgttcggattgatggtctcctcggcggaagaggacaccgcgtcaaagccgatgaagctgaagaacacgatcgacgcggccggcacgatgccgtacggctgcgtcgagcccggctggaacgtgtaaatgccgtacggggagaacggcttccaattggcgggattgatgtaccagacggtgcacacgatgaacagcacgatgatggccagtttgatcatcaccataatatcgttggttttcttcgtctggttgatgccgatggacagcacccaagtgatgatgagcacgatcacgaaaccaggcagattgaagtatgtggtcacgcctggtgtggtgccgtatgccgcggtcagctcaactggcagatgcaagccgaaaccttccaacagtttgttgaaatatccggaccatccggcggacacggtggccgcctgcaatgcgtattccaaaatcaaatcccagccgatcacaaacgcgatcagctcgccgaacgccaaatacgcgtacgaatatgcggaaccggacactggtgccatcgcggcgaactccgcatagcacaatcccgcgaaaccgcagcagaccgcggccagaaggaaggagacgcacaatgccggacctgcggtgagggcacccttaccggtgagcacgaaaatgccggtgccgatgatggcgccgattcccagcatggtaaggtcaaacgttttcaatgtgcgtttcagcggagtcgactcggacacgagctggtccactgactttttgcgaaaaagatccatggtcttaattccctaaaaatggttttatatgggctggaccggacggatttccgggactctggcacgcctcaaacgccagaaatcaaagaagggctgaacgcctcatatacgggaggtgtacgcgccttatgtaaggagagtgtaaaaacctggcgcggacaaaaccgtgaaaaccccgtgaatcgtctcaccatgtgtgcgcgcctttccgaagccgtcacgtgggagcgcaacaatagagccatgactttcaacgctgcccgtgaatggcaattctcatccgaacaaggcaaggccaattatgaggccgcccaaaagcaatatccggcgcaggccatcgtcgatatggccgcattgcgaaacaacatgcgtcatctggtgagcgtggttggcggcccgaattccggcaccgccgtgatgggtgtggtcaaggccgacgcgtacgggcatggtcttattccggccgcgctcgcggcacttgcgggaggtgcgacctggctgggtacggcgcaatcacatgaggcgctgctgctgcgcaaggcgggcatcgggccggaccgctgccacattctgacatgggtatataacggcatggctgtgccttttgacgagctgatcgacaatgatatcgatatttccgtcggatcattgccgggcattgacggcgttgcggctgcggcgcgtcgtcttggaaaaaccgcacgtgtgcatgtgaaggtcgattccggtttcggccgcaacgggttcacgcccgccacgttcgacgcggcgctcgccaagctggtgccgctcgccaaggagggtgtgctgcatatcgtcggccagtggagccatttggcggtggcggacgctccggacgttcctgaattcgtggcatccaccgacaggcagatcgagaatttcaaggatttcacccgtcgtatggagcaggcgggcattgcgccggagattcgtcatctcgccaataccgctgccacgctttcacgttccgagattcattttgagctgacgcgcccgggtatcggcctgtatggttatgaggctgatccggccatgggcacgccaggtacatacggtttgacgccggccatgacgttgcaggcgcagcttggtacggtcaaggatgttgaagcgggccatggcatttcctatggccgcacgtacctgactccgtccgatacgtccaccgcgatcgtgcctgtcggctatgcggacggcattcaccgttccgcttccggttttgatatggaaggcgcgaagcatgtggtcaagccaggaggcccggtgcgtgtgatgaccacggaaggtccgcgcctctaccgtgtgtccggtcgcgtgtgcatggatcagtttatgcttgacctgcacggttccgcggaaaagcttggcgtgcatgagggcgacaccgtgcagctgttcggaccgggtcgcggagaggattatgccgagccgaccgccgacgattggggccgtgccgcaggaaccatcagctatgagatcttcacctgcctgtgcaaccgtatcccgcgcctgtacgagcatgcctctgacgtgctgtcggtcgaagatctcgccaaactcgatcccgcaaccctcctataaagaatcaggcgtgcgatgggaggcacgccgtgaaagtcaatatggtgggcgcggtacgttcggcggttggtcaacgtgccgcgcttgctgttaaggtggtgagctatgccaggaatgattctgaaggaagatatcgaaaaagttcgcgccaccgccgatctgtacgacattgtgtccgcaacggttacgctcaaaccttcaggaactggcacatacgtggggctgtgcccgtttcatgacgagaaaacgccaagcttttccgtacgtccggcgctcggtgtgtggcattgcttcggctgcggtcttggcggagacgtgttcggctatgtggagcatcaggagaacgtcgactttcgtgatgccgtcgagcttttggccgatcgataccatatcgaattgcgttatgaccagtcgaacgccaagaaggagcataccggttcgaaacgtgcccgcctgttggaagccaacgaggccgcgcaggagtttttcgtctcgcagctgatgaccaaagacgcgctcgccgcgcgcaaactgcttgatggccgtaatttcagccaggccgattgccaacgattcggttgcggatatgctccgcaaggctgggataatctggtgcggtacttggcaggcaagggcttcacacagcaggaaatgttggacgcaggtttggcccgtcaaggccagcatggggtgtatgactatttccgtggccgcgtaacatggccgattcgcgattcaaccggacgcacgcttggtttcggcgctcgcaagttgtatgaggatgattcgattagcgcgaaatacattaatactcccgacacgcagttgtatcggaaaaaccaggtgctgtatggcattgatatggcgaagtcggcgattgtgaagaaacgtcaggcggtgatcgtcgaagggtatacggatgtgatggccatgcatttggccggcattgataccgcgatcgcgacatgcggcaccgcgttcggtgccgagcatgccaagatcgtgcgtcgtctgatcgccgacgattcgttgggtgcggtacagctggttggtccgttgaaggttgaaggacaggcgttgagttcgcgtatcgtgttcaccttcgatggcgatgcggccggtcagaaggctgcgattcatgcgttcggcttggattccgctttttcgacgcaggcgttcgttgctgtggccgacgacaatctcgacccgtgcgatttgcgtatcaagcgaggtaatgaggcggttcgcgcgttgatcgatcatgccgaaccactgtatgatttcgtgatcaaaaccgcgatcgggcgtttcgacaccacttataccactgggcagatgggcgcagtcaaggcggtggcgccgttgatcgcacagattcgtgaccgttccctgttggatttgtattcacgcaaggcggtgcgccagatcggcgtcgacttggatatcatgcagcgtgaagtgcgtgacgcacgacgcaaactgcaggtgcgggacgaagatgcgtacgctccgaaacgtcgttttgcaggcaatgccggagctgcggtggaaccgcgtatggaacaaggcacgaatccgtatgcgaatccttccgcgcggaaggcgttggaacatcgtgatgcggcggagcaatcctactatcgcattgatgatgccgtgttcatttgcgaacagcagttcatggcaaccctgattcaagtgccgcttgccgttgatccgacactgttcgccagtcttacgctgtcgagcttcatgacccccgtattccgcacgttattccaagcggtcgcggcggccgggggactgccgtctgctgataccccgcaaggattgtggatgcacaatctcaccaaagcgggtggtccgatgttggaatccgtcatcaacgagcttgccgtcatgccattgccgcttcctccgagcgatactgacgcagaacgtgcgtcgcaacaatcgcaggaaggcaacgtgcaattgcgcaagccgaccgatgacgaacgcagatacgcgtctgaactcatcattcgactgcttgacacgggcatcatgcgcaaaatcggcgcggaccagcgtcgcatggcgcaactgccggacggtgccgagaaaatcgagctgcttggccagattaccaagctggaaacgttgcgcaaggatctgcagacgagggtgttcggcaataacgtcgcctgaatatttggtgtgccggagcgtcaacccccgaacgtctttgtcgttcacctgaatttgccacatgcctgagtgcggtatgaacagccggcgaacgtgtggtgaacgcaggaagaatacttaacgaattcttggctggtgcacggtatccttcggcgtgttttgcaattgcaaaacagttttgccggtttgcaaagtcagggaacagtaaggcgtagtggctgaaaaacgttggaatggtcggaaaaatagtatgccaagggtatgtggtacgcgatttttcgggtaaagtgaatacggcgtttcttgagtaaatcgcccggggctgcaaacggtttgcaaactggattcacggaggaatgaatgcgacgattggtcgtcaaaatcctgaaaaacgagaccattctcgtagttgcttccatacttgctcttatttcatgctttatcgtgcctcctgacaaggagtatgccggatatattcatgccagcaccatttcgcagctgatctgcctgatgctggtggtgtgcggtttccagcgcatcggtgtgttccgcatcatcggttcgcggttgctgcatcatgtgagcaccgcccgcggattggtgatcacgctgatttcgctcacctatttttccggcatgctgattaccaatgatgtggcgctggtcacgttcattccattcgcgatcgcggtgctcaccatggctcacatggaggagcatgcggtgctggtcggcacgttgatgaccgtcggtgcgaacgtgggcagtatgttgacgccgatcggcaatgcgcacaacctgtatttgaaagcgttgacgggcatgccgtccgctgaaatgatcggcattatggcaccgtattccgttgctgcggcggtattgctggtggtcatcgtctgtgtggtgttcggtaagaaacctgtttccgaattttcctctatcgacggcagcggcatcgaacagaatgtgctcgctccgaattccgatcagccgcagccggatgagattcgtgtgaccggctacggcgcaggttacggtggttggcgcacgatcgtatattgcgcgctgttcatcgtgtgtttgctggctgtgagcgatttcattccgctatgggccatgtgcgtgatcgtggtggtggcgttcctgttctgcgatcgccgcgtgttccgcaatatcgactggggattgccgctcacgttctgcatgttcttcattttcatcggcaatatgaaacgcgtgccggaattctacgagctggccgcctccttggtgggggcgcatccgctggaagtgtccgtggtgtccagccagttcatctccaacgtgccgaccacgttgctgctgtcgggcttctgcgatcaatggcgtgcgctgatcatcggcaccaaccttggtggcatgggtacgctgatcgcatccatggcgtcgctgatcggctacaagaacgtcacgcgcctacccggacaagaaaggctgttatctggccgtctacaccgcggtgaacgtgctgttcgtcatcgtgctcgtcggcctgagctggattatcgagtagcgtttggccgtcgaccggtttccctgaccgctaatctcaaggtcgccggttcgcaccttttgctgggattgcatgaaaacccttggaatcattggatttcaagggtttattgttacgtcggctgatggtctggtgctgtgataatctgtgccgggaagcgtgtgccgagaaacgtaggaaggctgaacatgctgcaaggattgctgggaattttctccggactgatcacgccggtgcagaccgcggtgaacacgcggctcggccgttccatcggctcgccgttgcgcgcctcgctggtgtcgttcagcgtcggcctcattgcgatgctgactttgacgctgctgcttggcccgtatccgctgattcccgccaccgcggcgaacggcccatggtggatgtggttcgcgggcgtgttcggtgtcactttcctgaccggcaatgtgctgctgctgccgaaactgggcagtctcaaaaccgtgatcatgccagtcaccgggcagatcgtcatgggcctgctgatcgacgctttcggctggttcggcactaccgcgcagccgatttccccgctgcgtatcgcaggcgcggcgatcacgctggtcggcttcctgcttgccgtcgccggaccgaatctgcgattgaggcctgccatcgatcgcccggctggcggttcggaaaattccggcgattccgaaaaatccgaaactgacggaaaagccgtacatgtgccaggttccgcgactgtgctgtggagttgcgcaggcatcgcgttcggcatgtgttcggccgtgcagacggcgttgttgggcaagctgggcgtcgcgttgggatcgccggtgaaggcatcgctcgcctcgttcgtggtcggtctgatctcgcttgcgatcgtcgtcgcattcgtcgaccgcacctacagcctcggcgacgcgctgaagaaaggcaatccgtggtggatgtgggtaggcggattgctgggtgcgatgctggtgatgtgcaacgcgtacctgtccgcgcatatcggcaccggcatgacggtgatgctggtattgctcggtcaggtcggcggaggattgctggtcgaccgtttcggcctgcttggcgtgccacgcaagcccgtggccggcatccaatacgtcggcgtgctcgtagccatcgtcggcattgtgctcaaggcgatgtgattgccgtgtcgagttggcaaccgtgtgcgaactgactatactgtgtttagtttggccctgtagctcagctggatagagcatgtgacttctaatctcaaggtcgccggttcgagcccggccggggtcaccatcaagccctcgcgtcgtttcatgcggtgcgggggctttcctgtccattgaacggcaagccattggcttgcgaagataggggagaccatgaagcgaatcgtcgcgggcattctggcgcatgtggacgcgggcaagaccacgttgtcggaggcgctgctgtacgctaccggccaagtacgcaaactcggccgcgtcgaccacggcgacgccttcctcgacacggacgccatggaacggcagcgcggcatcaccatcttcaccgagccggccgtcatcgccacgcccgacctcaccatcaccctgctcgacactcctggacacgtcgacttctccgccgaaacggaacgtacgctcgccgtgctcgactacgccatcctcgtcatctccggcgcggacggcatccaaggccataccgaaacgctgtggcgactgctcaatcgctatcaggtgcccacattcgtcttcgtcaacaaaatggactcgcccggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgttatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaagcggcaccgcgcacgccggcgacgcggatgtggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgccggcagtccggtcctccagccggtgctcacgtacacgctggaaccgggggagtgcgacattcacaaatgtctcgtcgccctacgcgaactggaggacgaggatccgctgctgcacgtcgtctggcagtctcgcctagaggaagtgcacctgcagttgatgggcgcggtgcagctggagatcatccagcagatcatgcacgaccgtttcggcctggacgtcacgttcggaccgggcagcatcctgtacaaggagacgatcgccgcgccggtcgaaggcatcggccatttcgagccgttgcgtcactacgccgaaacgcatgtgctgctcgaaccgctgccgcagggctcgggcatggcatacgccaccgtgtgcagcgaggacgtgctcgaccgcaactggcagcgcctcatcatgcagcatttccaggaacgcgagcatctgggcgtgctcaccggctcgccgatcaccgatatgagaatcacgctgctgacgggccgtgcgcatctgaagcacacggaaggcggcgatttccgccaagccacctaccgcgcgatacgccagggcctgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtccccgaattcatgcacctcgactacgcctggcacggcgaagaggcgtaaaacatgtagataggctgccgacgccggactgtgcaaagttccgcgtgtcggcagtttttttttatataaaaaacgcgagtggagtagatgtgtgagaaaaagaaaaccccacacgaggtggggcttggtggagcggacaacgggactcgaacccgcggtctcaaccttggcaaggttgcgctttaccaactaagctatgtccgcaaagaacttccgccgtgagaagcggaaattcagtgggtgatataggaatcgaacctatgaccccttccgtgtgaaggaagtgcgctagccgctgcgccaatcacccgtgggataattccaccggtttcccggcttcgttacccgcttcgcgtgggcgatacaagattcgaacttgtgaccccttccgtgtcagggaagtgcgctacctctgcgccaaccgcccgaagcgagtgctaacttacgtggattctcggcggaatgcaaatcgtcggcgtgtcgcgatggtgttgcgaggggtgactcgccgtcaattagcgatcgaaaccattggaatttccatggtttttgcgtctggatcggacttgacgaacgattcttcagaaggggattgcgtcaacggcaagcgcatctgatgccatgccacattgccgtgcgtcgaagcagacatgccttcgtccacgaatcccaggcgggcgtaaaatccgacaagacgttccttacaagtcagcacaatgcctttgcgtccggcaatcgtcgaatcaaggatcacacgacgcagcagatagctggcgcaaccgcgatgctggtagacgggagccacgtccacgccgaaaatcatctgccaatcaccctgctcgtcatgcatggaaacatcctcatacatgacgtcggccaagtccttttcgttggtcgtcataccgttgacgaaaccaaccaatgtgccgtcttccacagaagctgggaagcaggcatcgtcatcggcatcagtgttgatcaaaagccagaaatgttccggatatgtggcgacgcgtgcagtcaggctctcgttcgttgcggcctccgcaggtgggaaacaggcagcctccacagcctcaatcgcgtccaaatcctccatcgttgcatgtcgaatgagcatgtgcatactctctcgcaaggtatacccaatcttcacatttcaatatgggcgaacagtggaaacgccagcgtgcaatactgtgaaaggatcaccggacgtattgtcggaagctgataaacgcttatatgaaaaaccgataacgacgtggcctgttccgcgattgttgcgcggtacgatggggcgcatccacggcgaaagcctggaaaagcctgaaaaggttccgagggatccgtagagcattcgaaaacctaaagagaaagatgggaggcgcgtgtgttcgattggacatttgtgacgcactacgcgccgttcttcgtcagcggcgcggagatgacgctgttcatctccgtgttcggcatcgtgctttcgatcgtggtcggacttatctgcgcaagcattgaaatcgcgcgcattccagtgctgaagcagatcgtgcgcgtctacatcgaactcagccgtaacacgccgttgttggtgcaactgtatttcctgtatttcggtctgccgaaacttggcgtcgtctggtccgcggaacaatgcgcgatcgtgggactcggattccttggcggttcgtatatggccgaagcgatgcgcggcggcctcgaaaccattccgaccgtgcagcgcgaatccgcgtatgtgctgggcctaagccaatggcagacgttgagccgcgtggtgataccgcaggccatcagcacgtccattccgggcattgtggccaacgtgatcttcctgatcaaggaatcgtccgttgtgtcggccatcgcgctcgccgacgtgatgtacatggccaaggatctgatcggcatgtattacaacacgtatgaatcgttgttgatgctggttgtcgcatatctggtgattctgctgccgatctcattgttcggcacttggctggaacggaggttcgactatgagcggcgctgagattctgctcgagccgggcgtgtttccgcgcctgttacagggcctgtgggttacggtgtggatcgccggtgtgtcggtgggtctttccgtgccggttggattggttgtcggctggctgatgacgatgaaaaatcctgtcattcgtgtgttgaccaggatttatttggatttcattcgcatcatgccgcaattggcgttgctgttcatcgcgttttacggtttcgcccgtgcgtggaattggaatttggatgcgaccggcgcatgcgtgttcgtgttcgtgctgtggggcggcgcggaattgggcgatttggtgcgtggcgcgcttgagtcgattccgaaagcccagtatgagtccgcgtatgtgcttgggttgagtggctggcagacgttcgtcacagtgattctgccgcaagcgttgcgtaggcttctgccggcttcggtgaatctggcgacacgaatcgtgaaaacgacgtcgttggccgtgcttctcggcgtggtcgaggtcatcaaagtgggtcaacagatcatcgacgcgaaccgtttccaatacccgaccggaaccttgtggatctacggggtgattttcttcatgtacttcatcgtgtgctggccgctgtccatcgtggcccgccgactggaaaagaggtggtcgcatgactgatgcagcgggcaagcagactcaggcaggccaggcaagtcttgggattgcgcatttggtcaagcagtacgccaatgccgacaggccagtgctgaacgatatttcgttcgacgtgccgcatggcaaggtgtttgtgattgttgggccttccggttccggcaaatcgacgttgttgcgcaccatcgcaggccttgagccgattcagggcggcaccatttcgctcaacggcgaagtgatcgaaacgggcaagccgggcactgagtccgctggacgcagcaagcgcagcagcgaactacgcacccgcgttggcatggtgttccaaagctacgacctgtttcccaacaaaaccgtgcttggcaacatcacactggcgccgaccttggtgcagaagcgagataagggcgaagtcgagcaggaggcgatcaggcttctggaacgcgtcggccttgccgaccgcaaggattcctggccgcacgagctttccggcggccagcgtcaacgcgtggccatctgccgtgcgctgatcctgcatccggaagtgctgctgttcgacgaagtcaccgccgcgctcgatccggaaatggtgcgcgaagtgctcgacgtgatgctcgaactcgccgattccggccagaccatgctcatcgtgacgcacgaaatgcaattcgcgcgagccatcgccgaccaggtgatcctgcttgaagatggcggcattgtggaacggtccgacgatgccgaacgattcttcaccaatccgaccaccgaacgtgccaagcagttcctgcatacgtttgaattcgatcggcatcgtaaatcagccgagcaatccgaacggtccgagcagtagcgcgaaatagcgcgaatcggcgaaacccaagattttgatagcagttatctttgcaagagaggagaaaccatgaccgcatcaatcatcaacaaaacattcaagagcatcgtggccgcatcggccgcgttgatcatggcagcctccgtggctgcttgcggtccgtccgcggccactccgagcgacgaaggctccacgggtagcgattccagttccagcagcagcgccaccgcccgcactctggatgagatcaagaagtccggcaagctcaaggtcgccgtgttctccgacaaggctccgttcggctacgtcgacaaggacggcaactatgccggctacgacgtctacttcgccgagcgcttgggcaaggatcttggcgtagacgttgaatacacctccgttgacgccgccgcccgagtcgacgtgctcacctccaacaaggtcgacatcacgctggccaacttcaccgtcaccgacgagcgcaaggagaaggtcgacttcgccaagccgtacatgaaggtggcgttgggcgtcgtttccccggaaaacgccgaaatcaccgacgttgaccagctcaagggcaagaccctgatcgtgaccaagggcaccaccgccgaaaccttcttcgagaaaaactaccccgacatcaagctgcagaagtacgaccagtacgccgatgcctacaacgcgctgctcgacggccgtggcgacgccttctccaccgacaacaccgaggtgctcgcatgggccaagtccaacaagggcttcaaggtcggtattaccgaactgggcgataaggacaccatcgctgccgcagtgcagaagggcaataaggaattgcttgactggatcaacgacgaaatcgacaagcttggcgatgaaaacttcttccacaaggattatgaggagacactgaagccggtgtatggcgacgaagtcgatcctgatgaaatcgtggtcgaaaaaggtgtggtcgactgataactagttaatcaaactaaatattttgaaccttccgtcgcttcaggcggaaggtttttctatattcacataatcatatttacatacaaatatatgattgctgataacgctatataaaaaacaattattacgattcgcgccttccataaaaagcgtatatagccacgccgatgttgccatgttgtttttccgatatcttgtgattgtcggcttgaaaaacaagcgagatgttttacgagagaggagcgcggaacatgaagtacgcagtgatcggtgccggcggaatgggcatccagtacggtgtgctgctgcaggaattcgcgcacaaagacgtcgacttcgtcgatacatggaagccgaacgtcgagaagatccgcgagcagggcggtgcctacgtgtcgcaagacggtgaagaccgccatctcgtgccgatcaacgtgtactatccggaggaatacgccggccagccggacgtgtggatcgtgttcctcaagcagatgcagcttgacggcgtgctcaagcgctgcgcccatctgttcaatgagaagcagatcgtgttctccgccatgaacggctatggacacttcgaaaagctcaacgaatacttctccacagaccgcatttacggcggtaccgcactgatcggtgcctacgtgtacggccccggcgatttcaacttcaccggcggagtacatgccaaggccatgaacctgtgtgcctacgcggatgatgtgactgacgaggtgcgcaaacacgagcaggcgctgtacgaggatttcgtaacggccacgctcaacccgaccatcgtggacaacttcatcggcatgtgcatggcgaaaatcgtattcaactcggtactgaacacgctgtgtaccatgtaccagattcgtttcggcgaattccatgcgcatcccgacgcacgctggctcaccgaacagctggtcgatgaagcctacagtgcggccgaagcagccggataccaactgttgggcacgcgcgaaacggaagtcgaaaccattctgcacaccgcgggcgtggcacatccgctgcactatccgtccatgtatcaagacctgaccaagggacgtccaacggaagtcgactacatcaacggctatatcgccaaagtcggacgcgagcatggctacgaatgcaagctgcacgaattcctaacccgcgaagtgcatctcgccgaacaagccttcgccatccacaatccagacatcgtcgcacaggccaaagccgacgtcgaagccagtaagccggtaacggaataatcgtattttttcaaaacaagtaggagagggaaaacaaccatgaccatcgctattttcaagaagccgaacggcatcaaacgaatcgttgcagcagtacttgccgctgcaacacttatttccgttgcggcatgcggttccggcaacggcgcatccgcatccaaggaaagcctgaacaccacgaagggcaaaaccaccacaatcaccgtcggcgtgtgcgcaggaccatacggcgacatggtcgacaaggtcatcgcgccactgctgaaagatgacggtttcaaactgaaaaccaagctgttcaacgattatgtgcagcccaatcaggcacttgcatctggttccattcaggcgaatcttttccagcatggcaattatctgaagaagttcaccgccgacaacaatctcgacctgaccgcccttggacagaccccaacccttggcctgggcatctattccaacaagtacaagtccatcgatgacatcgaagacggagctacggtcgcaatcgcgaacgatggctctaacctggcacgttctctcggcgtgctccagcagcagggtctggtgacgctcaagggcgaagtcgatgccaccaaggccacggtcaacgatatcgcatccaatccgaagaacctcaaaatcaaaacgatcgatgctgcacagctggcccgttccttggacaccgttgatgtggctctggtgccgggcaactactcttgggctgctgatctgaagcctgccgacgcgctcgccatggaaaagcaggatgatggcgtgatcgaagtgttcgtggtccgtacccaggacgtcgattccgacttcggcaaggccgtcaagaaactgctcgtcagtcagaaattcaaggacgccatcgccaagagcgagttcaaggatttcggcaagccgaccacttggtgaccgctgcagcgcggcgataggtaatatgcaaagacccgtatgaattgggaaactcatacgggctttatgcaaacgagattcatcgaacgaaacgtatcgaacgaaacgtatcgaacgaacgtaaacacgtacttgaacggaatgaggaacgaaccatgagcgttattgaactcaacgacgtgtccgtgacctttcatgaaggcggacgaaccgtcgaagcggtcaaacatgtgaacatcagcgtggaaaaaggcgaaatcttcggcatcgtgggcttctccggagcaggcaaatccacgttggtgcgcaccatcaacctgctggaacgaccgacgggcggtcatgtggtgatcgacggcagcgacatcaccgcactcaaaggcggtcagctgcgcgacctgcgcaagaaaatcggctttattttccaaggattcaacctgatcaccaatgtcacggtcggcaagaacatcgaattcgcgctgaaagccggcggatatccgaaagcgcaatggtcggcacgcatccgcgaactgctggcactggtcggtttggaaaacaaaatcgacagctacccgtcaagcctgtcgggcgggcaaaaacagcgtgtatccatcgcacgtgcgctcgccaacaagccggaaatcctgctgtgcgatgaagctaccagcgcacttgacctggaaaccacggaaggcattctggcgcttctgcaacgcatcaaccgcgaactgggcattaccatcgtgttcatcacgcatcagcttgacgtggcgaagcagattttcgaccgagtggccgttatggaaaacggtgtggtagtggagcaaggcaacaccttcgacgtgttcagcacgccgaagcatccgaccaccaaagcgttggtggaatgctatctgggcattgcggtgccgccgcagctggtgccgtcgctgccggccggcaccatcgtggaactgcgatacaagggggatgcggcactcgaaccgctcatcagccgggtcgcgcaggattacggcgtgagcatcgacgtgctgcatgcgaatgtggagtatttcggttcgcaggccatcggcattctgattgtgctcgtttctggcgcgggggagccgctggtgcaggcgttgaatacgttgagaacgcatgtgttcagctatcgggaacttgatcgtgggcagctggttgtggccgccgaagctgcggataatcaggaggcgtgagaacaatggaagaaactctggaaatccttcaagacaatctcggtcaggcgttgatcgacacggcatacatggttgtggtgtcggcgattatcggcgtggtgttgggcacgttggtggcgttgctgctgtatttgaccgaaaatcgtttgttcacgccgaatcatgcgttgaacgttattgtcggtttcatcgtcaacgcgattcgttcgctgccgttcctgattctcatggtggtgcttattccggttgcgcaattgattctgggtgatccttacacgccgacaggtggcgcaatttccctgtcgatcgccgcggtgccgttctttgcgcgaatcgcggaaagcgcgttttccgaagttgatccgggcttgcttgaagctgccatctccactggtgccaccacacgccaaatcattgtggatgcggtattccctcaggccttgccgtcgttcattcgtggtgtggtgctcaccattatttcactgattggctattccgcaatggtcggaacgatcggcgctggcggcatcggcgatatggccattcaatacggctataaccgttacgaaaccggcgtgctcgtcgtgattgttattattctgatcgtcattgtgcagatcattcaatggatcggcgattggttcgcacgcaaggtgacgcactgatggttgcgtatatgcgtgaatgtgcgcatatacagtcgcacgatgatagagagggttgatgaatgacttcgtatgtttctcctgttgcgttcactacggtggcgcagtcgattccgccgaatgtgttcgccgatatggatcgcaaagtggctgccgcggttgcggacggggccgacgtgatcgacctggccaaaggcaatccggatgcgttccccgctgacttcattcgagaagtggccaaaaaggcggttgacgatccggccaatgcccgttattcgccgttcgatggcaagccgagttttctgcaggctgccgaacagtggtatcgcaacacgtatggtgttgaggttgattggaaaacacagctttttgccgtggagggcgcggttgatggtctcgcggcgctgttcgccgtgcttgtttcgccgggcgatgctgtggcatatgcggatccgtattacccctcgtatcattgcatgacggtgatgagccgtgccgaggaggttctgctgccgtcactgccagagcgcggcttcctgccggacttggatgcggtgcctgcgcaagtgtggaatcgtgtgaaagtgctggtgctcaactatccgaacaatccgacgggtgcgcaggctccgcgtgggtttctgcaacgtgccatcgatttggctcatgaatatcatttcgcgatcgtgcaggatttcgcttatgcgggattgggggtcgatgcgcagcaaatcagcatactgtcgctgccgggtgccttcgatattgcggtggaagtatgctcgctgtcgaaaatgtatgcgatggccggctggcgtgccggtttcatcgcgggcaacgacgacattgtgtctcatgtgaagcagtaccactatcaaatgggttccatggttacgtccagcattcaagacgcgggcactgtggcactgctgtcggatcagagctgtgtggccgaacttgcggaacggtatgcgtctcgtcgcgaaatcgtggcaggcggattgcgtgaagccggacttgatgttttcgattcagacggtggcatctacgcttgggtgcacgctcctgaagatcagacgggtgaacaatttgccgacacgctgctggaacgtgcggccgtcgccgcgctgccgggcacgtgtttcggcaaagtaggcaaggattacgtacgattcagcctgcttaaatccgaggaccagttgcgtgaggctgtgcgccgggtgactgctgtgctagcgtaatttttcctacgtagcctttttgcatggatgagcgattgcgtgcttgcgcaatcgcttttcctattttcctccgattgtttgcgatcgtctttcgatcggttgtggacgtcccatcctccaattgccatcgaaacgtctttcccttaggaaaccgacacacgctccttatgcaggcgacgtttttgcgattgcggtgcggtgtcttgcatctccgccgtttgatagctgcttacaggaaaatgttatggcgattcgcgcgttctatagccaacgttgataaggcgcggcgcgcgttgaaacgcaggatgcggtttagtgggtaccagcgaccgcgtgaatggcacgcggcaatgaaccacaacccaagggggtgcacatcatgaccagattcaacactcagtttgtccacggactgccggtcaacgataacaacaccggagccgtgaacccgccgactacgaagcgcttgatgccgctgtttccgggcactccgccaagggacccgcgcatggttgtccggcgaaggccgtgtatttcgaagttcttaccaatccgttgctgcaggtcaacaatgtgacgaagattgctgaaatcgctcatcgctatggtgcgatttccattgtcgacaacacattcgttaccccgtatctgcagctgccgctcgaccaaggtgccgacatcgtcatccattccgctaccaagtatctggccggccattccgaagtcaacgccggtcttgtggtggtcaaggacgacgggttgggcaaacgtgtctacttcgcgcagaatcgtttgggtggcgtgcttgcgccgaacgaatgcgattcggtgcgtcgtggtattcagacgctcgccctgcgcatggaccgccagcaggagaacgcgcgtgcgatctccagctatctgttgctgcatccgctggtaaaatccgtgcattatccgggattgtcggggcatgagtatgagatttggacattgttcaggaagttgcggatgaggtgacggtaatgaaagacggccatcttgtcgaatatggagctgtcggttccgtgttacgacaccctaaagatgcgtatacgaagatgttgcttgaggcatcgcctaaatttgatgagattaatgcctcgtaaggagtgattttatgattgacaatgcggcaattgatttctatggagccgactggtgcggcgactgccatcgagccaaggcagcactagaccgtttcggggtcgcctacagccttcatgatatcgagcatgaggatggtgctgcagagaaggccattgcgatcagcggacaacagcacattcccgtgattcggttcgccgatggctcatggctggtggagccttcggccacgcagttgcaagccaaatgcaaggaactcggcctgatctgattcaacattgcgtatgccatctcacgagtcggacaaggagaattgtctcctgttcggctcgtagacgtatgtgggtcggcttccggacggtcgatgtccggcttccgaatggactttgcccaactcgcggacattgtctgcacgtgattgcattctttggtaagtttttgcttgggttcggcaatggttgcagaacctacggaaagccgtcaatcaacaggctttcgagagaaaaccaaagaagggagtaatgtcatgccgttccttattacgctccttgtcattgcacttatcgtcgcgttcctgttcctgtccacgttgtttatcgtgccgcagcagcaggcctatattattgagcgtttcggcaaattcaacaaggtgcagttcgccggcattcatattcgaatcccgttcgtggaccgtatcgccatgaaaaccaacatgcgcgtcaatcagcttaatgtgcagttggagaccaagacgcttgacaatgtgttcgtcacggtggtggcgtccactcagttccgtgttgacccgagcaatgtggccaccgcatactatgagctgcgtgatccggctggtcagctgcgttcctacatggaggatgcgctgcgttccgccattcctgcattgtctttggacgatgccttctcccgtaaggacgatgtggcttttgacgtacagaagaccgtcggcaacgaaatgtcccgcttcggtttcactgtggtcaagacgctgatcactgccatcgatccgagtccgcaggtcaagaacgccatggattccatcaacgctgcccagcgcgagaaggaggccacccgtcagcgcgccgaagcccagcgtattcagatcgagacccaggcggcagccgaggctgagaagacccgtcttcagggtgaaggccaggccaactatcgtcgtgagatcgccaatggtatcgtcgaccagatcaagagtctgcaggcagtcggcatgaacgtgaacgacgtgaacaatgtggtgttgttcaaccagtatctcgacaccatgcgtaatctcgcctcgtcgcagaatgcgaagacggtggtgttgccggcttcgacgcctggcggtttcaacgagatgcgcgaccagatcacccaggccatgatgtccgcggacgaagctgcgaaatagtcgcaaaatagccgtgccgatgctctgcatcgatgacaagatgaccttcgtattcgtgttgtgcgaattcttgcgccaaagtgctttttccaacacgtcgtgctccctcaataagcatggcgcgcttgccattcgactggcttttccaagccatgagtgtttgatatgtcttgcgcctgaagagcatggtgtactccttgaaaattaaggcatttacacgaaatgcagagtaaggacagcgcgttttatacacgaaatgcagagtgtcgatacggggcgaggatgtttcgctgacgttccagaggcatgaagaatccctcctttcgagacggccgcttatatgtgacggagagcgcggcggtgaaaggagggattattgtttggcgcgttgccgtaccgcaacgcacgtctatgtgattggcctgtcggcaatgaccgtgttttgcgcacgcatgtcatacgtttcggcgtatgtcacgccatgctgacaagaccttccttggagtttgaattcggcagtgagcagttcatcgcatgtgattcaagcaggtgaagctgtttctgcaggtccatgactttcttttccagccatttgatggtcatggcttgggtgatcaccagcagatcgcgctgcccggaatcggatttgtttgccaacgtctgtgcttcaagcatgattttcggatcggctttccaacgggcgatcgcgcgttcgatgcgcttgcctcccatgattttcggatcaagacctgcgctggcgaaaatactggtaggaccgttgccgcgcagatattgcgccatgcaacgcacctgaaattccttcgagtacgtgatgcggtccatggaagctcgctctaccgcgggcagggtgttcaggtaatacacctcggtttgagtaaaacgacgacgcatgatggttccccttgtgtgatatgcggatgacgcttccgacaacgtcatccgaatgtctgcctcgttgttttcattctatttttgcgagattcggggattttgccgtctggcacgaaacgaagtgtttttggcacgaaacgagaaaaccaccctagttagggttgctttaggaggatgtgagacggggtctgtgcttctcggggtgttcccctaagggatgcagggaactggaaaacggtataaactcggttgtgggacagacgtattgacgccgtgtgggggagggcaacgaagactatgacagatcatgaagggcaagagtcgatggcggggacgcgcaggcccatcatcgaagtcaagaatctgcgtaaggaatatccggtgctcgacgaaaccgtcgtggcgctggaacgcatcaatctcaccattccgcaagggcagatctgctgtatctacggcgaatccggttctggcaaatccactctgctgaaccagctagcaggtatggaaaaaccgaccaaaggcggcgtgcgcatcgggggagtgcccatttctcggttgaatgaacggcaattggcggaatttcggcaaaaacatcttggtttcgtattccagtcatacaacctgcttcccaatctgactgccgtggaaaacgtggcaatgccgctgatgttccaaggcatgccgaaaaacaagcgtgaggcaatcgccaagaaaatgctgaaacgagtagggctcggcaaacgcatgaaccactacccgacgcaaatgtcgggcggacagcaacagcgtgtcggcatcgcgcgagcgttcgcagccagaccgcaagtcgtattcgccgacgaaccgaccggcaacctcgactccaaaaccaaaaccgacgtgatgaacatgatctgcgcgttcgctcgcgacctcgaccaaaccatcgtgctcgtcacccacgatgacaatatggcgcaatatgccgaccgtatcgtaacgctacttgacggacgcatcatcgatgaccgtctgatgaacaacgcgtgacggcagagaagagaaggaaattccatgagtaacagcaaccattccgcaaaattcatcaacatgctcatcgcattgatggcgtccatcgccatcgcgctgacctgcattgtgccgacggcgctcgccgaagacggtgatggcactgacgacaacaacggcggctccaccgtgcagccggccggtccggtgccgaacatcatcatcaccaacttcacctatggcgacggttccgtggcggtcggcacgaatttcgatcttggcttcaccttccagaatatgggcaaggtcgcggtcggcaatatggtcgtgaccgttgatggcggcgagaatttcgccatttccggcggtacgaacacgttctactacgattcgctgtgggcgggctattccctgacccagaccgtgcccatgcaggtgctgtcgagtgcgaagaacggcgcgcagggcatcgatatcaacttcaaatacgagtatgtcgatggcggcacccgcaattccaacacttcggatatcaagatttccgtacctgtttcgcagcccgaccgtttcgaactgggcgatcccgtgcttccagacgccatcaatgcgggcgaggaatccaccatttccatggaatacgtgaacaagggcaagggggatgtatccaatgtcgaagcgtccatcgagggtgacggcatcaccgccacgcaagccacgcagtatatcggcaatgtggcgtccggcgcttctggttccatcggattcgctttcactgcggatgcggccggcgaatatgatgccaagctgaaggtgacgtacgaggatgccgacggccagcagcagaccaaggaatcgccggtgaagattacggtgtctgaggctccggctcccgccgatcccggtatggatgttgacccgcaggaaaatcaaggcattccgacttgggtgtggattgtcgttgccgtggctgtcgttgccgtgatcgccattgtggttgtggtggttgtgcgtcgccgcaagaaggcgaagaaggctgccgaggatgacgattgggattgggatccctccgattcgcatgcaggtgctgatgatggtgcggctaatacggctggtgccattgacgcgccgacccaggtgattgattccgtgccctccgccaaggagtgagcatgcgattttcggatattgcacgttcatgcacgcagaatctgctgcgtcgcaaatcgcgtacgattcttacggtacttggcgtgatcgtcggctgctgttcgatcgtgctcatgatttccattggccaaggcatcaacgaacagaacgagcagatgctcaaaaacatgggcaacctgaacgacatcaccgtatatgcggacggcggaggttcacattccacggcaacgtcatccagcgtgagcggtgccgacggcgaacaggcgaaactcgacgatgacgccgtgcagaatttccgcagcattgccggtgtggccggagtgcttcctcagaaaacgatgtcatacagtgtggatgccgcgcaaggagctggctcccggtacgtgtcgcaatatgtcaacgtggtgggagtcgacgccacgcaattggaagaatccggctataaattggccagcggacgtcttccgatgcgtgccggcgaagtgttggcgggcaaatccttcgtgtattcgttctacgacaagtatgcgtcagatccgagcaatcatcgtatagaagcgggcggttattactgcgatgagcacggttgcgcccaatccgaaggcgaagacccgttcttcgatatgctgaactccaaaatcacgttgattaccggagccaactatcaaagtcccgacgactaccacaaggtgggcggcggatccgtggcgccatccgattccggcagtggtgagagtcccaccattaccatgccatacacggtggtgggtgtcattgattcctccgccaacaactatgatgcgttcacttccggcattgtgatgagcatcgacgatatgaaaacgttgaacgccaaaatatcgggggacaccaaggccaacacgtcgagcaaggtcgtttacgatcaggtactggtgcacacccaagacatcaaagacgttgccgacgttgaagtgcaaatcaagggcgccggttatcagacttcctcgtttgagcaaacgcgtaaggagatcgaaaagcagtcgcggggcatccagttggctttgggcggcatcggcgcggtgtcgttcttcgttgccgcgattggtattgccaacaccatgattatgtcggtgtcggaacgtacgcgcgaaatcggcattatgaaggctcttggctgctatgtgcgcgatattcgcatgatgttcctgtgcgaggctggtgcgatcggccttgtcggcggtgtgatcgcttgcttgatttccgcgattggttcgataggcatcaatatggcgtctttgggtggattcagcattgagaatatcggcaaagcgattatgggcggcgacgatgtgactcgcatttcggtgattccgtggtggctttttgtggtggccatgctgttttcgatcgccgttggtgtggtagcaggtttcggcccggccaataaggctgtgaagattcccgctttggatgccatcaagaatgatcagtgattgctgattacagatcgctgatttatagattggcggggaatggtccacagatataccgatcattcccgccaattcgcttatgtatcgattattcgctgagaataccgcggattcgagagacgatggtttctgaagtcaatccgtaacgttcgttaagctcgccaagaggcactcggtcggtgaactctttggctgcgccgaaattcagcacacgaacgtgagaagccttggtattactggaattggcataaaatgcggtgactttctcaccccatccgccttctagctggccatcttccaacgtaacaaccaaacgatgcccatcggcaagcatcgccagtaattcggcatccatcgtggaatattgcaatgcgtcaacaagcgttgcggtaatcgcagcatgttcttcatcattttcggccagtgccgacgtaatttcggcagccaacggcatggtattgccgagtccaagaatcgccacatccctgccgggctgaacgatctgatagcgggcgaacgggcatgctccggcaatattgacggctggatcatgctcttcggcacgctgcaacgggtcgaacgccatatcggcggcacgttcaagtgcgagaatctgctcgccgggcatacgaatcgccactacgccatgtccggacgggccggtagcccaagccaacatgtcaagcatctgttcgccgctcgcgggagccaaacaggtcacgtcgggaacattggcgaacatcgtcatatcgaatgtgcccgaatgcgtattgtccgcgccggaaattcccgcgccgaaaatcagcagcgtggcgggaacatgattcaatgccaactcttgctgcagctggtcgaacgtgcgttggaagaacgtggcggaagtcgcaagcaccgggcgtccgccagccctggcgatacccgcggcgaatgcggcggcatgttcttccgtgataccggtatcgacgtagtgggcgccggcacgttcacgaaaatctcgggtgatgccattcgatccgggggttgcgggggagatgaccaccaatcccggctcattgtcgaaacgacgttccagcgatgccatggccatttcgccataatatttgcgtgcgtcgagcggtttgccgagcgaggcctccggatcctgccaatggttggcctcgcattggcccgcatgaggttgaggattggtctgattgcagccatccgaaccattgtcggcttccgtttcgtcattgaagcccaagcctttggtggtgtggatatgcactacgatcgggtggtcaatgtctttgacctcgttcagtacttccaccagcgcgtcaacgtcattaccctgctccacatagcggtagtccaagccgaatgccttgaacagattcagttcggccatgccattcgacgtacgcaacttggcaagctgcccgtacataccgccgaaatcctcagcgatcgacatttcgttgtcgttgacgatgatgatgagattaccgccctgttcggccgcattgttcagcccctcgaacgcaatggccgaactcagggatccatcgccgataatggcgataacattgccgatagtgctttcgccggcggcgccgcgctgcatatcgcgggttttggcaagaccgcaggccagagaaatcgaagtgccggtatggccgagcacaaaggaatcatgttcgctttccagcggattcgtgaaaccggtcacttcatcaaaacgagattggtccaagtatgcttcggcgcggccggtaagcattttgtgcacgtagctttggtgcgacacgtcgaaaatgaaacggtcgcggggcgagtcgaacacgcggtgcaatgccacagtgagctccaccacgccaagattcgagccgatatgcccgccatgttttttgccgtagtcgagcagcgtggcgcggatttcgaggcatagatcgcgtaattgctgggctgaaagggcatgtacgtccgccggagtgtgaatcgaactcaaaatgccagcggtcatcgtgcgcaatcacccttccctacgatcagtgcaaccaagtgcgaaatcatatcccactgtatgccccgacgagggtgtttgcgggcaaaggagcgcaaagtcttctcaacttgaggcacaatagaggtgtttgcaatcgtgaaaagccgttattcgcaaaggagcgcgaacatgaaagccgtatatgccaccggaacgaattatgatgatccgctgtccgtgcttgaagtgggcactatgcctgagcctgaaaccaagccattctggtccaccattcgtgtgaactcggcgagcgtgaaccatcatgacgtgtggagtctgcaaggtgtggggctttccgacgagcagacgccgatgatcctcggcacggacgcggctggcgtgttggaagaagacattcccgtacgaaagggacttaaggccggttccgaagtggtcttgtataccttcgttggtaccgatggcgccggtgtgatgccgggggagagacgctcgatcctgtccgaacggtatgcgggaaccatggccgaatacacacaggtgcccagcgccaacgtgttcgccaagcccgcgaatctgaatcttgatgaggctgccgcattgggtaccagctggcttaccgcatattccctgctgttcgcatcggcgaatgtgaagccgggagacacggtgcttattcaaggcgccggaggcggcgtgtcgaccgcggcgattcagcttgctcacgcggccggattggaagtgttcgtcacgtcacgaagcgaagacaagcgtgcgcgagtgttgcagctcggtgccgatgcggcttttgaaacgggtgcgcgactgccacgcaaggcggatgccgtcattgaatccgtcggcgcggccacatggagtcattccgtcaaatccgtacgtccgggaggaactatcgccatttgcggcgcgactactggcgaccagccgggtgcagagcttacgagaatcttcttccaggatattcgagtgcagggcaataccatgggctcccgtgaggatttcgcacgtttgctgaaattcgtggaacatgccgatctgcatccggtcatcgattccgcatatgcgatcgacgacgcgcatcttgcgttctccaagatcgtgaatggcgacgttttcggaaaaatcgtgctgcacatctagccgattgcgtaaagtaaacggtgttcaagaacatgttcttttggattctttcggaggtccttgatggcagacaacaagcctgaagtcgcagtgattatggggtcggcgagcgattgggaaaccatgaagcatgcctgcgagatgcttgaccagttcgaagtgccgtacatgaagcaggtgatttccgcgcaccgcaccccggaattgatgggcgagttcgcgcatagtgcccgtgccaacggtctgaaggtcatcatcgccggagccggcggcgcggcacatctgccgggcatggtcgcggcccagaccaccctgccggtcatcggcgtgccggtgcgttcccatgcgctgtccggttgggattcgctgctgtccatcgtgcagatgccaggcggcatcccggtcgccaccaccgcagtcggcaactccggtgccacaaacgcaggtcttttggctgtgagcattctgagcaccaccgatgagcgtttggccaatgctttgcaggaatatcgtgactctctgaaggaaaaggtggctgaatccaatgcccagcttgtctgaggaaaccaatggccgtgttgaacgtctgatgccaggggccaccatcggcattatcggtggcggtcagcttggccgcatgatggcgttgtccgcccgctacatgggcttccgcatcggcgtgctcgacccgactccggattgcccgaccgcacaggtggccgacttccaagtcactgccgaatacgacgacatcaccgcgatccgagaactggctgaaaagtccgacgtgctcacgtacgagttcgaaaacgtgaacgccgacgccatcgacgaagtgcgttccttgtctgcagccccgcaaggcaccgatttgctgcgtgtcacgcaggatcgcgtcaacgagaagcagttcatcaatgatcatggcacgccgaccgcaccatggaaggccgtcaacagcgttgaggagcttgatgcggcgctcggtgaaatccattacccggccgtgctgaaaacccgttccggcgggtacgacggccacggccagaccgtgctgaaatccgatgccgatctcgaaaaggtacgagcccgtgccgatcgcggtggcggattcccgccgagcattctcgaaggattcgtcgatttcgcattcgaagcgagcattctcgttgccggtaacggcaaggattatgtgaccttcccgatcgtgcgcaacgagcatcgtaacaatattctgcacatgaccatcgctccggccgaagtcagcgaagacgtggcgaaggaagcgcacgaactcgctttgcgtttggcgcaaggcttcgaactggccggcatcctcgctatcgaactcttcgttaccaaggatgagcgggttatcgtcaacgagcttgccccgcgcccgcataactccggtcattacaccatcgaagcgtgctcgttcgaccagttcgacgcgcatattcgaggcatcgccgggtggccgctcgaacagcccgaactgctcaagccggctgttatggtcaatgtgctcgggcagcatgtggccccgacccgcgcgctgatcgccgagcatcccgaatggaatatgcacgactattgcaaggctgaagtgcgtcatgatcgcaagatggggcatatcaccgtgctgaccgacgacaccaggcaaactgtggcggatcttgaacggaccggctgctgggatgatttgaaataaaaccgatgacggcatgtttcgcgcgtcagcctttccctgaggggaggacggcgcgcgaagccatcaagaacggacatagattgacggacggacgcgtggagcgcaacaccaaacaaaaagaactgattcatgatgcgttgaaggcaaacgatgaattcatttccgcacaggatttgcatcgcaagctggaagacgaaggcgtgaaggtcggccttgccactgtatatcgtcaattgaatgccttggctgaggcaggcgaggctgataccgtgcgtttggaaggccaacagctgttccgtctgtgtggtgatgacgggcatcaccatcatctcgtatgcacgaattgcggcaaaaccgtggaaatcgaatcgccatccgaaacttggctgcgtggcatcagcgagaaatacggattcaccatcgaacggcatacgcttgaggtgttcggactatgccccgactgccggaatgaggcacgacggtaattccgtcgatctcaacaatttcgccgatttcagcaacaacggttatgcggacggcggaatccttgacgacaactagatactgccatccgaactgtctataccccctcatcgttcttttgcgatttcatcgacatatgcgtaagaaaatcagaagaaactgtggatgaaatcgatcattacagctttttgtcagatatggtcgcgagaatagtgccttggcgtcgccgtaaggcgggaaacgaagcgaactgacacgttacgagtggagataaacacttgacgaacgaatccgtgaatacagagacgattgaggaactgaagatctcgacgattgatccaaacgcacccgccaaggaacgtaaggaattcccagggtggttgtacggcatactgtttgtggtgttcgacgccatcggtgtggcagcgctacagattggcgtcagtcaatccgctacacgcgtcaagctttcgaacaacatgtggctgaccggttggggcttcgtcaccaaaatgttcaccaacctcaactttgtggcggtgctcaacctgattttgtggggcgtgctgtatgtgatactgctcatgctcatcaaccgcttctggatcgccacgccaatatttctggcggtgacattcattatcgcggtgatcgaacatttcaaagtatccatccgatatgaggcgattcttcccagcgatctgaacttcctcaaagccgatgcgggcaatcttatgagcttcatgccggcaggcgcacagtggaccattctgctcgccgtcgtcatattcgttgctttcattgcgcttttcgtattcctgaatcatcgtgacggccgtcacggcaagcttttccgtggcgacgacaagcagtcgcgctcgctgaatgccatcgtgcgactactgctgatcatcgtgccgggaacgttcttcacgctgtattccatgcaggtgagcactgtcggatcttgggcgaaaaccttctcttcggcaatgggggacatgccgtccatgtgggattccgtctacgatgcgcagcgcaacggaccgatggtcgccttcaccaggcagctgaatccgaaagtcatggtgaagcctgacgactattccgaagaaaccatgaaggaagtcgcggcacgatacgaaaaagaagcgaagaagatcaacgcatctcgtaccgagaacatgaccgacagtacggtgatctatgtgctgtccgaatccttctccgacccgtctcgcgtgccggggcttaagatcaacaaggattccatgcccaacattcgttccatcaaagagaatacgacctccggtttgatgctttcttccggatatggcggtggtaccgcaaacctcgaatacatgggattgacgggtttgagcatgtcgaatttcgattcgtcgctcaccagcccgtatcagcagcttgtgccgagcgagcattggacgccgaccatcaaccagctgtggggggcgtcgaagaattccatcggactgcacccgtacgaatcgtctatgtactcgcgtgcgaccaactataagaagttcggattctcgcatttctacacgttgaccggtccggacgtcatctcgcatcaagacaagatcgacgattcgccgtacgtgtctgacgaagcgacgtacgagagcaccatcgaagaagtcaagaaaaccgatggcaaccagttcctgcaggtcatcaccatgcagaaccacatgccataccacgattggtataagaacaacgatttcaaggccgaatccactacggacactcctttggaggacgatgagaaggagtccatcgaaacctatcagaagggtgcggctctgaccgacgaggcgaccgccgacttccttgacaagctcgacgccatcgacaagccgatcaccgtggtgttctacggcgatcatctgccgggcatttattcgtccgcttccgaagacgacaacaattcgcttgccttgcatctgacggattatttcatctggtccaacaaggcgtccagctcgcaaggcaacgagatcgacaacgccgactattcgtcgccgaacttcttcgtggcgcaggccgccgagcatatgaacgccaaggtgtccccgtatctggcgttcctcacgcaaatgcatgagaaaatctccgccatggagccacctgtcgtcaacaatatccagggatgggaccgtatccctgaaggtcagaacatctatctcgacgctgacggcaatcccatggccgaaagcgacttcgacgcggaaacccagcagttgcttgccgactaccagctgattcagtacgatatcaccacagggaagaactacctgaaagacaccgatttcatggatcttccctagaggcaaggggggaagagatggccgcaaccgatcgcgaacagcagattttggcgtggattaagcagaatcctttgatcagccaaaacgagcttgcggaactgtgcggcatcacccgttcaggggtggccgcgcacatctccaacctgatgaaaaaagggtacatccaaggcaaagggtatatcgtcactccgcccagctatgtggctgttgttggcgccatcaatatagaccattacggtgtcgccatgcaggatgtggttggggaaagttccaacatggggcgcattgtgtcatccgtgggcggcattggttacaatatcgcctacaatctgaaccggcttggcgtgccgaattatttgatttccgtctatggtgatgatgagaacggcgaacgcgtcaagcaggacgcgtatgccaacggcattgacatcacgcatgccaagcagatttcccatatgcctacttccaccttcttgtcggttgtttccgcgcaggggcgtcagattgtgggtcttgatgatatgcagatcagtgcggaaatcaccccggaatttctagcgcaacgagagcagaccatcgtcaatgcggaaatggtggcgattgattcgagcttgccgtctgatgccatagcatgggtttgcgaaaaaacaagtcgaccgattttcgtgcgcgtggtttccgttaataaagcggcgcgaatcacgccggtgctcgatcgcatcgacactatggtgcttaattccgccgaagccaaattcgtgtcggggattgaggtgcatgacgaggccagtgccagagattgcgccgaacatttgctgcggtccggtgtgcgtaatgtgtttctttttgtggatgattcggacatgctgtactgctgcgaacatgaaagctttttctggtctttgccgggaagggcggaggaacgtcgatataccaatggtggtgcgtcggcggcgttgagtgcgctggtgtgggcgcgtcgtgagcataaaacacagcgggaatgcgctagatatgcgtctgcggcggctgcgatgaatatgtctcaggtgcagtcgatttgcgctgatttttctgaagaagctgtgcggcgcaaagctgatttgctgcagtaacgcaggtatggcggtcttacatttgtttctttcgtaatcgcgagacacgcgatttttccatatgttacatcgatgaaatataagcaaaagttgactggcttaaacttttgttgtattctaaattgaagataaaacgtttcatcaagggtgtatcaaggcagatatatccccgaaaatgtaggaggcaatatccatggcggatatgacttcaggaaatactgttcctgaccgttacgttgtggtcatcggtggcatgaacatggacatctgtggtagaccgacgagcaccgtagtggaccgagactcgaatccgggcgtcgtcagcatgtccgcaggtggtgtcgggcagaacatcgcacagaacatggctcatctgggcatgccgacatacctgatcaccgtctacggcgacgatgaaaacggcaagaccctggaacgttcgtgcgcggccaacaacatcaatcttgactatgccgcacagctggaaggacgccgttcttccacctacatgttcatcaccgatgatacgggcgatctgctggtggccgtcaacgacatggaaatctgcaaggaaatcaatccggcattcctcgaatctcgcctcgacttcatcaacggtgccgccatctgcctgcttgacgccaatcttgaaccggaaaccatggcatggattggcgaacacgtcaccgcgccactgttcggagacaccgtttccacagtcaaagcgcaccgtttcgacacgatcctcaacaagatgaccgtgctcaagccgaatgatttggaagcatccgtactcaccggcatcggtatcgccgaccagtattcggcaggtgccgcagcgaagaccttgctcgacaggggcgtgaagaacgtattcatttcattgggtgccaacggaatcctgtgcgcgagacacgaaaacgacgaatacagcttcaagcatgtgccgccataccgtaccgaaatcgccacggcaaatggggccggagatgccggcatggcagccatcacctggagcttcttcgataaccccgatcgagatcttgaagaagtcggcaaaattgcgcaggcagcatccagcatcgcgctcgaatgcacaaaagcagtgcccgatatcaccgtggaacgcatacgtaagaagatgtccggcgagatcgagccgttgctcgacgaagtgcgtactgcctgaattttgctacatcacacgtccatcaacccatacaaacacaaggagaaccgacaatggtagtcaagcagatctattctctgatcgaatacgatgaggccgtcaaaaccatggaggctggtgccgacaacattggactggtgccgatgcagaatggtggcgttccggcacatcgcgtgccaatcgaacgcgtgcaccgcattttcgacgaatgcaagcgtcgtggcgtcacctccgtggccatcatgctgaccaacgatcccgacgagatgatcgagcttgccagagaggtgcggcctgacattctgcatatcgcaggcgatgggtacgccgcagatgaagcattcgcggcccgacttaaggaagccgctccgaacaccaaactcatgcaggccgtgctcgttgacgatgaatccgccgtcgaccgtgccaagaagtacgcacaatactgcgatctcatcctcacggactccggtctggcccccgacaccggcattggtgccagcggtctgacccacgactggagcattgacgcccgtattgtggccgaatgcggcaaaccggtcatcatggctggcggtcttggaccagacaatgttgccgaagccatcgaacagtgcaagccgtatggcgtggactccctgacgaagaccagcatcaaatacgacggcggctacatggagaaagacatcgacaaggttcgtcaattctgcatcaatgccgacgctgcggccgcaaagatcggacagtgaccgatggctatggaagtcaaactgctgcaacccgtcaaagtggtctgcactgacgatttaggggagactctggtcgatatcatgcagaccgcgggctattctcgtccgctgatggtcacggattccttcgtcggaagcatgccgctggtcgttgccgcacgtaccaagcttgaacaggtcggtgtcgatgtggcggtattcgaccaggtcaagcccgacccgctttgcgaaaccgtggaatccggcgtcgaagcattcgaagcgcataaggctgacagcatcatcgccatcggcggtggcagttccatggatgttgcccgaggcatcaacatcgtgcgtgtcaacggcggatccatcatcgaatacaccgatccagccaagccgatcgcaccatgcaacggtatgatcgcagttccgaccaccgccggcaccggcagcgaaatgtccaacgcgctggtggtcaccgaaggatccaccggtcgtaaactcgcggtgcttgccgatccggcagtcagcgaatatgccgtgctgaacgcggatctcatgctgacactgcccgcaaaaatgaccatcgcttgcggacttgacgcattctgccacgccgcggaaggatacctttcccgaatggcaagtccggtcacggatgccatttgcgaaaaagcgatgttcctgctgtacaactatctgccgcgtgctgtggcaaacggtcaggatcgtgaagccagggaacgtgtgatggtcgcgtcgacgcttgcaggatggatgctgaacaatgcgggaaccattgcggggcattccatcgcacacgtgctcggagcgaaataccacatcgtgcacggtgaagccgttggctacgcgttgccggcggttatggagttcgttgctcccgtacgtgcgcataaggttcgtgagatcggtcagattctaggtgcggtctacccggaaaatgcgccggacgagcaggttgcgattatcgcaagcagagcgttcaaggatttccgcgaccgcatgctcggtctgcatcctgttgaggattacggcatcagcgttgaagaactcgtttccaatgcgcaggccgtagttgacgagcgttttgcaggaaacacacctcgtgacatcgatcttcaggcagccgaacaactgctcgaaggtttcggaagtcgctgatatcaaaggccattgccggccttgcaacaagttgtgtgaccgatgagccggagtcagtcaatcgtcgaccacctcattatcggttcaaagttggagcacataaggaggaaccataatgtccaagaaaatcatccttgattgcgatccgggacatgatgacgccgtcgccatcctgcttgccgtgggcaatcccaatatcgatctgctgggcgtcaccacggtaggcggcaatcagagccttgacaaggtgacctacaacgcccgtgcagtgctggaaaaggcgcatgccaccgacgtgccggtgcatgccggatgtgaccgtccgctggtgcgcaagcaggaagtggcagcttccattcacggcgaaaccggtcttgacggcgttgaactgcctgaacccagccgtccgctggaagccggacatgccgtcaactggattatcgacaccattatgagcaacgagccaggcaccatcactctggtgccgaccggaccgctgaccaacattgccatggctgcccgcatggagccgcgcattgttgaacgtgtcaaggaagtcgtgcttatgggcggcggataccatgtgggcaactggagtgccgtggccgagttcaacatcaaggtcgatccggaagccgctcacatcgtgttcaatgaagcctggccgatcaccatggtcggattggatctgacgcatcaggcattgtgcacgcccgaagtgcagcagcgtatcgaaggcgttggcactgatctcgccaagttcgtgtctggtctgatggacttcttccgcaagacctatcaagacaatcaagatttcatcgatcctccggtccatgatccgtgcacggtggcatacctcattgatccgagcgtcatgactacccgtcgttgcccggttgatgtcgaaatccatggagatctcacacttggcatgaccgtcgccgacctgcgaggtccagagccgagcgccgaagaatgccacacccaggttgcagtcaagcttgatttcaacaaattctgggatttggtaaccgacgcaatcaagaccatcggctgaaagaagagaaagataagtaaaggggtgctctaatgacagagaccaaaaacagcaaaatgctcgacgaaggcggcaagtccgtcgtcgcattgatggcagcattgatggcagccatcttcgcgttccagctcaacgcgtccatgctttcgcctgcattgacgaccatgcgtgttgaactcaacaccaccgatgcgcagattggcttgacccagacggtgttcttcacctcgtgcgcagtgttctcgctgttcctgccgcgactcggcgatttgatcggtcgcaagaaagtgctgcttggcattcttgtgcttaccgctttgggctgcgtggtttccgcgctcgcggtcaacgtgccgatgctgatgatcggtcgtgtgattcagggtgttgccggtccgattgtgccgatgacgctgatcatgctgcacgccaaggttactgaagataagaagtacgccaagctcatggctattctgacttccgttaatggtggcatcggcggtgtcgacgctattcttggcggctggcttgctggcacgttcggtttccgttccgtgttctgggtcatggttggcgttgcggtgcttgccattgtgcttgtgttcgtgtatgcggaagaatccaccgcttccgagactccgaagatggattgggctggcgtggtttcccttgccgccgcattcttggccgcatatctggccatcaacgagattcagaagctgggctccgccaattgggcgctggtcgctgtcgaaatcgttattgcagccgtgctgttcgtggtgttctggaatgttgagaagcgtcagaaggctccgatggtcaccacgcattacctcaagcagcgtcgtacttggggtctgctgctgaccaccctgcttaccatgaccggcgtgttcgccatcatgaacggtatcgtgcctgctctcgctcaggataccgaagtcggcgccggcatgagcgccagcgtggtatcgttcgccaccctgactccgtatgcgttgatcggtctcgcattcggtccggtcgcaggcgtgctcgcttcgaagttcggctaccgtgcggtgctgcgtactggcttgattgtctctgttgtgggcgtgctgttcggcatcttcgtgtgcaacgttccgagcatctgggcacttgtggtcatgtctttggctttgggtgtttcctacgcaggtactgccaacatcatgctgaacggtctgggcatcgtgctctctccggaagacaatccgggctacctgcctggtctgaactccggtgcattcaacctgggtgccggtctgagttatgcagtgctgtacgctgctcagaacgcgttcaccgcatccggcggtgcgaccagcggctacatcgcagccatggttggcggtgtgattctgctcggcctcgcgttctgcgcatccctgctcattccgaagccgggagagcagaagtaatcaatataagcttgcctgtgttgtgtgattaaaaaacggcggttttgcagtcggactcctctctgtccgaccacaaaaccgccgtcctttttatatatatgattgcgattgtatggttacagacatttctgatggtatgcaatcgctgggtgcattcagatgttcagtgccttggcgccgatgtcgtgacggtagaacatgcccttggtatcgagctggtcgataatcgcatacaccttgtcttgagcggccttgatgtcggctgcggaggtttccaccaacagcacgcggccggaattggcgaccagaccttcttcgctacgagccacgccagcgtaatagacgtgggaatcctcatcgactggaatctcaggaatcgcagcgcccttgatcacatcgacagggtagccgtcggcggcgagcaccacaccaagcgtggcgttgtcattatcccaagtgaactccggagtctcgccattgagcagagcgctgatgccggcgccgagatcagacgtgagcttcggcagcacgacttccgtttccggatcgccgaaacgagcattgaactcgataaccttcggaccatccgcggtggcgatcaagccagcgtacagaatgcccgtgaacggcgtaccctcatcggacatagcctgcacggtcggcttcacaatggtttcgatagcggtgtcaaccacatcctgaccgatctgcggaacgggactgtacgcacccatgccaccggtgttcggacccttatcgccatcataagcgcgcttatgatcctgagaaatcggcatcggccagaaatcggtgccattcacaaaactcatcagcgagaactcctgaccctccaagaagtcctcgataacgaccttcgcgccggcgttgccgaaacgatggtcgacgaaaatatcttcaagagcggcgatggcggtttcctcatccatggcaacggtcacgcccttgccggcggccaagccgtcagccttgatcacaatcggagcgccatgctcacgaacataagtcgtggaacgctccaaatcgctgaacgtttgataccttgcggtcggaatgctgtgacgttccatcagctgcttggcgaaatccttggacccctcgatctgtgcggcggccttgctcggaccgaacgccttgatgccagcctgagcgaaatcgtcaacgatgccctcgataagcggcacttccggaccgacgaacacccagtcatagccgttgttctttacgaaatcaatcagcgcggcatgattggacgggctgatttgcgtgatgcggatgccgtcaagctccatacctggattgcccggagccactgtgacctcgctgacgctgctgccacgcataagcgcatgagcgatggcatgctcgcgtgcgccggaaccaatgaccagaaccttcatgtttcctcctgttatgtcccttttgggaaaatcctatgttcaggaaagtcttcggaaataaaagggggtggccgttatggctcacccccatatatgtatttactgcagttcgacgtcgctattggtcttcttgacgatattgccgagcacataaccggcttcgccattggacttgagcaattccatggtcttatcagcatcttcggcgttgactgccagcaccatgccaatacccatattgaagatgttgaacatttccatatgatcgatttcgccggccttctcgagcacatcgaaaatcggcagcaccggccaagagccgagattgatgtgcgcagccaagccgtccggaatcatacgcggaatgttttcgatgaagccgccgccggtgatatgggcgacgcccttgaccacgccggccttgaatagcggggaaagggccttcacatagatcttcgtcggggtaaggagtacgtcgccgagcttttcgccatcaagttcgtcaagtacggtgtcgaccgtgtagccggccttctcgaacagggccttgcgtaccagagagaagccgttggaatgcacgccggtggacggcaagccaatgagtacatcgccttcagcgatggtggagccgtccacgattgcggacttctcggcaacgccgaccgcgaaaccggccagatcgtactcgtcttcgtcatacatgcccggcatttcagcggtttcgccaccgatcagaccggaaccagcctgtacgcagccgtcggcaacgccagccacaacctgctcgagcagtgctggatcgttcttgccacaggcgatgtaatccaggaagaacaacggttccgcaccttgagcggcaatatcgttaacgcacatggctacacagtcaatgccgatggtgttgtgcttgttggccattttggcaacgaccagcttggtaccgacgccatcggtgccggaaatcagtaccggctccttgtatccgagggaagccagatcgaacaggccgccgaagccgccaataccgccgactacgcccggacggttggtgcgagccacatgggacttgatgcgcttgacgacttcgtaaccggcctcaacgctcacgccggcttcttcatatgcttttggcatatcaaacctttctagggttcagtgttcttcttggggtgaagtggtggtgtattcgttgccttcgtacttgctcttatacagggcgaattcaggcagacgcacgcgatcttctggggtgagggacttcaaaaaatcactttcataatcgtcgagtgcggtcgggtagtcgccattgaagtaggccacgcacaaaccgccatacggggcgtccgcgcctaatccaatggactcgaccaaaccgtcaagcgaaaggaacgccaacgagtcggcgccgatgaaatcgcgaatttcctcaacggacttctttgcggcgatcagttccttggtggtggaaatgtcgatgccgtagaagcacgggtacttcagcggcggcgagctgatacgcatgtgcacttcggcggcgccagcttccttcagcagctgtacgatgcgcttggacgtggtaccgcgcacgatggaatcgtcgataacgatcacgcgcttgcctttgaccacgccgcgcacggcggacagcttcatgcgcacgccctgctcgcgcagttcctgcgtcggctggatgaaggttcgagccacatactggttcttgatcaggcccatctcgtttggcagaccagcttcttccgcatagccggaggccgcggacagcgaggaattcggcacgccaatgaccatatcggcatcgaccggcgattcttgggccagacgcgcacccatacgcttgcgggcggaatgcacgtttacgccgtaaatgtcggaatcggggcgtgcgaagtagatgaattccatcgagcagatggccaactgggtctgattggtgtactgcacgatcttgtagccgtgatcgtcgataaccacgatttcgcccgggcgaatattgcgcaccaattcggcgccgacaacgtcaagcgcgcaggtttcggaagcgagcacataagcgccgtttttcatcttgccgagggaaagcgggcggaaaccgttcggatcaagcgcgccgatcatggcgtcttcggtcatgatcaggtaggcgaaaccgccatgcacggtgttgagcgcttccttgagcttgtccatgaacgtacgctgtgtggagcggcgcaacaggtgcatcaacacttcggtgtcggaattggagtggaagattgcgccttcgtcttccaactgacgcctcagagtcgggcagttcgtcagattgccattgtggcacaaggccatatcgccgtcatggaagcggaagatgaatggctggatgttgtcggtgccgcctgaaccggcagtggcgtaacgcacatggccgatcgccttgtctcccttcaggcgttcgatttcgcgttcgtcgccgaacacttgggtcaacagacccgttccgcgatgaccgatgagatgaccgttatcgttcgagacaatgccggcgccttcctgaccacgatgctgcagcgcgtgcaggccgaagtaggtgagtcgggcggcgtccgggtgaccccaaacgccaaaaataccgcattcctcgtggatgtcttcgagttcagctgacaagccaaagctccttccaaaaccatggagacaaggggttcgctaccgttcaaccctaccaaccggaggctacaattggcggttttcgtggagtccttaggggcacttggcatgtcgggtgtgtcgaacaattgttcgaactctctgatatgctgaatgcaggaaaatacagtgcggtgcatcggcgatgctttgtcggtgctttgcgaggcgaagtgctcgttgacgtttcaagatggagccaaatcatggaaggagtctgaagatggccgaacgtacctatatcgctatcgatctgaaatccttctatgcgtcttcggaatgtgcggaactcggattcgaccctctatccacgcatctggtagtggccgaccaatcgcgcaccgacaaaaccatctgtcttgccgtgtcgccatcgctcaaagcatatggactgccggggcgggcgagactgttcgaagtcaaagcgaagcttaaagaagtcaatgctgcacggcgggcagcggcaccgggcggtgtgctgagaggtgaatcgtatgatgcgaaagcgctcgcagctaatccgaatctggctgccggcgtgtatatagccaagcctcgaatgtcgcattatctcaacatcagtgcgaaaatctacagcatatatttaaggtacgtatccgaagctgacattcatgtctattcgatagatgaagtattcatggatgttaccgggtatttgcgggcttacggcaaaagcgcgcatgatatggcccgtgaaatgatccagcagattcttcgggagacgggcatcaccgcaacggccggtatcggtacgaatatgtatttggcgaaagtggctatggacgtggtcgccaagcatattcccgcggataaggatggcgtgcgtatcgcgcaattggatgagatgtcgtatcgtcggctgttatgggcgcacaggccgttgactgatttctggcgtgtgggacgagggtatgcgaagaagctcgaagcccaaggtctaatgacaatgggcgatatagcccgatgttccataggccgtgccgacgagtattacaacgagggcctgctgtacaagatgttcggtgtgaacgccgagctgcttatcgaccatgcgtggggttgggaaccttgcacgatcgccgacatcaaagcgtataagccagctggtcatagtatgagttcggggcaggtgcttacgggcgcggtcggttttgactcggcgcggctgattgtgagagaaatggcggacgccttgtctttggacttggttgccaaaggtgtgaaggccggccatatggggttgatggtcggttacgataccgccagtcttgatccaaagcggctaggggagtgtggcactccggaattgaaggcgatggctgagcgagccattgccgaatatagcggtcccgtaactcttgataggtatggtcggcgtgtgcccaagccggctacagggtcgattggtctggacgaccatacgtcatccaccacgcgcatatgcgatgcggttgacgaattgttctgcagaatcgtcgatcatcggctgttggtacgtcgattgaatgtggttgcttctgatttgcaaacggtcgaacagctggctgagcggaatgctgcggcgaattacgttcagcccgatctgttttcggatatgcaggaagtctcaaatggaagcgatagcaacgattgcagtgataacgtcgataacaacgtgcggtcttcctacgctgacgatatgcgggttgtcgatgagatttccgaacagcatgtgcagcagacgattcttgacatcaaacgcaagttcggcaaaaacgccgtcattaaagggatggacatgttcgctgatgccacaggtcaacagcgcaaccggcagattggaggtcatgcagcatgagtttgcagcaaaccgaccgttacgatgacatcatcaacttgcctcatcatcgctcgtgcacgcgcccgcacatgagcatgcacaaccgtgccgcgcaattcatgcctttcgccgctctcaccggctacgacgacatcatcaaacaaaccgccacccattccaacgaagcagtggaacgcgccaacacccccgtcaatctcgccgaaggctacctctccgcctaacatgcgtcggagaccaaaaaagaggctgtttggtttgactagggaggaatcccgatcaaaccaaacagcctctgtatgttcgaatctacgtcagaacgcttttatggatgcggtcgcggatcaggcggcgaagtactccacgccggctgcgaacagcggctgatccttctcgccgggcacgttcttgaacgtaccgttgctgtaacgctcggagtggcccatcttgccgaacacgcggccgtccgggctggtgatgccttcgatggccagcagtgaaccgttcgggttcacgctcaggtccatgcccggcacgccggcctcgtccacgtactgcgtggcgatctggccattggccttgagctgggcgagcatatcgtcggaagccacgaaacggccttcgccgtgggagatggcgatggtgtgcatgtcgcccacctcggtctttgccagccacggggagagattcgacgccacgcgggtgcgcaccagacggctctggtggcggccgatggtgttgaacgtcagcgtcgggcattcggcggtcatcggcacgatgtcgccgtacggcaccaggccgagtttgatcagcgcctggaaaccattgcagataccgagcatcagaccatcacggttgttcaacaggtcacgcaccgcttcggtaacggcaggagcacggaagaacgcggtgatgaacttggcggaaccatccggctcgtcgccgccggagaagccgccaggaatcatgatgatctggctcttcttgatttcctcaaccaaagctgcggtggactcagccacagcagcaggggtgaggttgttcacgatgagtgtgctcacgtcggcacccgcgcgctcgaaggcggctgcggaatcgtattcgcagttgttgccggggaacacggggatgatcacatgcggcttggcggcgccggcgccggtgtatacggtcttcttcggcgcattgaaggacacggtctcaacggtcttgcccttttcatcgcccttggatcggtacgggaacacggattcgataccgccctcccaagcgtcctgcagttcggccagatccagcgtctcaccggctgccacgaactggtaggcctcggtggtctcgccgacctcactgacctcaaccaggttggatacggccggaaccttcgcggtgtcggcaagttcgatgatgaaggaaccataggccggggcgaacaggtcgtccacgctgatgccatcggccagcttcacgccgatctggttgccgaccgtcatcttgaagatagcctcggcggtggcaccgtagccaggcgtggacacggccagcgcatcgccgaaatcggtgaactcctcgactgcggagaacacctccagcagcgaatccttgtccggtgtgaggccgtcggcctggtaacgcggcgcgatgcggatcacacggtgaccagcgcccttgaactctggggaagtggcacgcttcatgttgcccacagccacggcgaaggagatcagggtcggcggaacgtccagctgttcgaacgtgccggacatggagtccttaccgccgattgcgccagcgcctagatcgacctgcgccatcagagcgcccagtacggcggccatcggcttgccccaacgctccggctcgtcgcgtagcttctcgaagtattcctggaagctcagatacgctttctcatgttcgaaaccggcggccaccagcttcgagagcgactcgaccacagacagataagcgcctgtgaactggttctgctccatgatgtacgggttgaagccccaagccatcgcggaggcggtggtggtctcgccgaacaccggcagcttggcgaccatggccatgttcggggtcagctgcttcctgccgccgaacggcatgagcacggtgcctgcgccgatggtggagtcgaaacgctcggaaagacccttgttggaagccacgttcagatcggtgagcatggtgtgcatgcgttcggcgagcgtgccggtcttccacggggtggcgtagccgtgctgcgcttcgacatgcaccacctgatgcttcggagcgccgttggaggcgaggaactcgcgggacagatccacgatcgtgtcgccgttccataccatcgtcatgcgcggctcttcggtcactgtcgcgatgacttcggcctcgagattctcttctttggcgtagcccaggaactcgtccacatcctcggcggccacgtccacggccatacgctcctgggattcggaaatcgcaagttcggtgccgtccaggccctcgtacttcttcgaaaccttgttgagatcaacatacaggccgtcagccagctcgccgaccgccacggatacgccgccggcgccgaaatcgttgcagcgcttgatcagacggcatgcgtcaccgcggcggaacagacgctgcagcttacgttcgacgggagcattgcccttctgcacctcggcgccgtcaagctccaaggattcgacgttatgcgccttggacgcgccggtggcgccgccgatgccgtcacggccggtacgcccgccgagcaggatgaccttgtcgcccggagccggggtttcgcggcgtacatgatcggccggagtcgcggccacaaccgcaccgacctccatgcgcttggccacatatccggggtggtagatttcgtccacctgaccggtggccaggccgatctggttgccgtaggaggaataaccggcggcggcggtggtgacgagcttgcgctgagggagcttgccttcaagcgtctcggacaccggcacggtcggatcggcggcaccggtcacgcgcatggcctgatatacgtaggaacggccggaaagcgggtcgcggatgcagccgccgatgcaggttgccgcaccaccgaacggttcgatttccgtcgggtggttgtgggtttcgttcttgaacaggaacagccaatcctcatcatggccattcacatcaaccttcaccttgacggtgcaggcgttgatttcttcggattcgtcaagattcttcagaataccgttcttcttgagccacttcgcgccgatggtgcccatgtccataaggcatacgggcttttcgtcgcggccaagctcgtgacgcatctcaagatacttatcgaacgcggcctgcacggtcgcgtcgtcaatctgcacatcatcaagttgcgtgccgaacgtggtgtgacggcaatgatcggaccaatacgtgtcgatcaccttgatttccgtgattgtcggatcacgctgttcctcggtgaagtgagcacggcagaactgcagatcagccaaatccatggccaggccacggtcggcgatgaactgctcaagatcggcgtcgctcatggtgcggaaaccttcgatgacctccaccttgcccggtaccggcacctgcgtcttcaacgtggtcttggtatccagcgaagcttcgcgagcctcgaccgggttgatcacataatgcttgatggcggcgatgtcggcgtcgctcagctcgccttcaagtgcatacaccttggcggaacgaacagtcgggcgctcgccctgggagatcagctgaatgcattcgctggcggaatccgcacgctggtcgaactggccgggcagatactccacagcaatcacattatcagaaccgaaatcaggcaaatcggcggaaacattatcgacctgcggctcactgaacacggtaggggtggcctgtgcgaacagttcctcgctaatgccttccacgtcataacgattgacgagacgcacattcttcagcgatgcgatgccaagaatggtcttcagctcgttggcgagctgcttggcctcgacatcaaaaccctgcttcttttccacgtacacgcgaaaaaccatggttgactccttgaaagaggggcttggtgagattgataaaaataagatttttaaaaacgatgaagcccgcatccgagtttgtactgcagatgcgggctatcgcaagtattattcggctacttcaatgccttcggacttggcgagttcagccaagcggctttcgacctcttcgtaagccggaatgatgtcgcccagatcgcggcggaacagatccttgtcgagatgctcgaccttgccggagccgtcacgctgatcccacagacggcaggaatcaggcgtaatctcatcggccagcagcagcgtgccatcggaagtgcgacccatttcgattttgaaatcaacaagcttgatgccgatcttggcgaagatctcgatcagggcttcgttgatgcggcgtgcgagaggtgcgatctcagccagatcctcacgggtgcagacgcccaacgcaaccagatcgtcgtcgttcacgaacggatcgtgcagatcatcgttcttcaggaagtactccagcaccggctccttgagctcgatgccctcttccacgcccaagcgagagcagaagtggccggcggcggtgttacgcagcacgatctcgagcgggaacatggtgaccttcttgaccagctgggaggtttcgcccacgcgggctaccagatggctgtcgataccacgcttcttgagcagatcgaagatcagcgtggtgatgaggttgttcagcctgcccttgccggcgaagtcttccttcttctcgccgtcacctgcggtagcggagttcttgtattcgacccagagcacctccggatcgtcagttgcgtacagttgcttggctttgccctcgtagagcttttccaacttctccattactcgcctttcctggtgtttgggaggtagatagtttggtgaacttgacggttaacaagataccaacgggaggctacaatcgaatggtttttgggcgcgttccggcagtcttccgtcagtatccggcaatagtgcgtcaggcgatgtcgatttcgagcgattcggccacattctcggctttagcacgcgcgtcggcctcatctgttccgatggccagcgcgaccgccatacgacgatggccgtgcacttccggcttcgcgaaaatacgcagatcggtgcccggctgagacaaagcgttggcgacgttgcggaattcggcttcaccatcgccctgaatgacgatcgcatggcttgccgcgacggcaccgtccgggatcgacaaggcgacatgttcctgcgtaatcggcaaaccgagaatcgcacgcgcatgcaacgcgaattcgcttaaccgttgcgacgccatcgtgaccatgccagtgtcatgcggacgtggggagacttcattgaacaacacggaaccgtcggtcagcacgaacaattccacgccgaacacaccccaacccttctcgtcggaagccttggccttcgccaccagaccttccactgcggtgcacgctatgcgttgcgcctgcgcaagcacatcctgtgtgaaggaggccggttgccaggattcgcgatagtcgccgctttcctgacgctgtccgatcggagcgcaggtcacgatgccggcgctggagctgacggtcaacaccgtcagctcgtaatcaagcggagccaacgcttctacaatcactcgggaaacgtctccctcgtcgtgcgcgcgacgaccttcctgtgcctcaacccaagccgcatcaatcgcatcggcggaacgcaccacggactggccgtgaccggaagaactcataatcggcttgaccacgcacgggtagccaaccgtttttgccccagcgcgaagctcttccagcgagcctgcgaagcggtacggcgtggtcggcaatcccaattcctcatgcgcaagtacgcgcaaacgttcgcgatccatgcaaatggatgcgatttcggcacttggcaccacctgtgcgccacgctcggccgcggcagccaattcgctggtggcgatcgcttcgacttccggaacaatgatgtccggctgaatttcgtcaaacaatacgcgcaactgttcggcattggccatgtcgagcacacggtattcgtgcgccacctgttgtgccggagcgccctcataggaatcggccgcgcatacccatgcgccaagcctcatcagttcgagagcgacttccttgcccagctcgccggagccaagaaacagaacacgagtcggatgcttaccaagcggagtgcccaaggcacgattctcttcagtcatgccttccattgtgccatcggcgtaggatggagtgcatgtctgagacggaacaggaagaaacacagcgacccctgaccatcgccatggtggtcgacacgtcgggaaaccgaggtaacggcacgtcgaattcggcgttgcagtgggcggaggaattgaagcggcaaggccatacggtcaggcttgtgggcattggtgcgcctgaatacccggcacgagtcaaccatgtgcctctggtcagttgggtggcgaaaaagcagcagatgcagttcgccgaaccgagcgacacgctgttcagaaccgcgttccgaggcgtggacgtggtgcacatctacacgccgttccgttttggccagcatgcgtgcaaagtcgccaaacagatgggaatcgcggttactgcgggctatcatgtgcagccggagaacatcacgtattcggcaggtccgctgaaatatattccgggcatcgacaagttcatctactggctgttcaatttgtggctgtaccgcaaaatcgaccatgtgcatgtgccgaccgagcttggcgcaagtttgctgcgttctcacgggtacaaatcgaaactgcatgtgatttccaacggatatgaatcacgattcactgcgaaaacgcagcgcgatgcggggaagtctgctccggttccgttccacattgtcgcttccggacgattgacgaacgaaaagaatcatgtcgcattaattcatgcgatcgcccgttgcaggcatgcgcaagatattgaactgacgattgccggcaccggtcctttgaaaaagaaattgcagcgactcgccgcacgtttgctttcccgaccggcatcgatcggatttcataagaacaccgaaatgcccgcgttgctgcgttccggcgatttgctggtgcatccttcgattgccgatctcgaatcggtgagcgtcattgaaggtatggccgccggtttggtgccggtcatcgcatcgtctccgttgagcgccgcaggccagttcgcgttacgtgacgaatcgctattccctgtcgacgatgtggaagcgttggcaaggcgcatcgattggtgggtcgatcaccccgatgaactgtcgaaatggggcgaaatctatgccgaacacactaaagagcattattcggtggctgcttccgtgcgtaaattcgtggctatggaacgcgaggcgatcgccgataatgccaataagcaaatcaatgcgtaacaatcagcataaatggaaccacatgcgtgataaatgatcgtaacgtaagcaaaaaggcgcgggatgtaattcctgcgcctttttgttgtttgtcgtaatgattatttttccgattgacagcgacgatgcgcgctacagcaatgcgatcagctgctccacctgctcatcggtggtggcccagctggtgcagatgcgcatcaccgtgtgcgtgtcgtcggccttttccatgaagccgaggcgcacattgcgctgcaaacgctcggatgtcgcgttgtcgagcgtgatgaagatctgattggtcggcgcgtcgaaggtgagcgtatagccacgttccaccagcacttcgcgaatacggtcggccgcatcgttggcgtggcgggcgatcctgcaatacagatcgtcggtgaacagcgtgtcgaactgcacgcccagcagccatcccttggcgagcagcgcgccatgttgcttgacgagcgtcacgaagtttttcggcatattgccgtgcgtgaacaccacggcctcaccgaacatggctccgaccttggtgccgccgatatagaatacgtccgcgatacgcgcgatgtcttcaagcgtcacgtcgttgccggttgcggtcagcgcgtagccaagtcgtgcgccgtcgatgaacaacggcatgtcgtacttcgtgcagaccttgcggatcgcctcaagttcggcgagcgtgtagagcgtgccgtattcggtggcctgcgaaatgtagacgcatccggggaacaccatgtgcgtgtagttgccgtccgcgtagaacgtggcgcagtactcgtcgagttcggtcgcatcgattttgccgtcatggtgggggagcgtcagcaccttgtgtccggtgaattcgatggcgcccgcctcatgcacgttcacatggcctgtgcttgccgcgattacgccggcatactgcggtgtgatggagtcgatgatggtctggttggtctgcgtgccacctaccaggaagaaaatctgtgcgtcagggcaggcgcatgcttcgcggattttggctttcgcgctttcgcagatgctgtcgttgccgtaacccggatattggttttgtgcgatttcgctgatgcgttcgatgatttccggtgttgccgtgcaggaatagtcgttttcaaaagacagcatgatgcgctccttgtatctgacctatgctgatgacttgcgaccggctgtttgctgtattcaagccgtccggatagcaaaagacctcggaatttcttccgaggtctctaccggggtggctaacgcggctcgaacgcgcgaccttctgaaccacaatcagatgctctaccaactgagctatagccaccatgttttcgcttcatgcagaagcgcaacagatgaaaactatacacgattttccagctatgtctacatcggcgtgttgcgcgtgcctgtcgtcggcttgcgctgtggattgttcattatgtgaacggcatattacacaaatccgaaactcacgcgtaccttgtagtcgctgcatgcgtaagggtgtgctgtaatggcggtgtgggccgtctcggagtgtttacggcgtatgcggatcatcggccgaaaagctgtgaaatgtgaaggaagagagattcatgcagaaggtcaaagcgtttggtgattggctcaccaagtggttcaccgcgattgtgattgtgtgggccgtgttcaactatttcgtgccgcaggcaagcttgtggggcaaatcctataccggttatttcctaggtatcgtgctgttcggcatgggtcttaccttgacccttgacgatttcaggcgcattctcacccagcctctgatggtcatcgtcggtaccgtggcccacttcgtcatcatgccgttggtagctgtgctgctgtgctggattttccgtcttgatggtgcgctcgccgtcggtgtgattctggtcggctgctgcccgtccggaacctcgtccaacgtgatgagctatctgagtcgtggcgatgtggcgctggacgtgtccatcggcattttgtccacgttgtgcgcgccgttcatgattccgctgttgatgcagtggctggcttcccagtatgtgtcggtcccggtggaatccctgttcctcaatgcggtcaaggtggtgctgttcccgatcgctcttggcgtgatctgccatgctattttcggcgagaagatcgagaagattacggtcgctctgccgatcgtgtcccaggtggccatcctgcttatcatcggcgtggtcgtcgcagccaacggtccgaagctgttcgtggcttcctcgctgcttgccatcccggtggtcattctgcacaacctgtgcggatacgcgttgggcttcggtttctccaaacttatgtacaaggtatatccgaagggcttccgttatgcacagcagaaagccatcaccttcgaggtcggcatgcaggattccgctttgggagcgactttggcgctgacgtcgttcgcttccaatccgttggccgcggtgccgtccacgttcttcagcgtttggcacaacatttccggttccgtgctgtccagctggtggcgtgagcatgatgacaggcatcagatccatcctgattccgacaatggcgagaagggctcggctgcgaaggcccgcgaagacgctgccgaaacagctaacagctgacattcgtcagtagattccgtcgtcatattgcgcattccctgaatctttcaaaacgattcagggaatgttttgttttgagtggtgcaaacgtgtcattgtgatgttttgttgctttgcgctgatgtaggcaaaatgattgaaattattgggatttaagggtgtcttcacccgtgttttttgttcgttttggggtatactgtaactgaaggccggagttgtggatcagtcgagaattcgtcaggtcgcaacgaagcgccgatggccgtgaggttcatgcgcaacgcctttaagatataactgaacaatagcgattcgaaacagcggcaatggggtagtacggcgcaggcgccgggccgcaaatgcaaaacagacaacgagactgaagagtgcgcgtaaggtagcgcgtagcaaagaagtgggaacctccttcccgagtggatggccccggattcgaaaggatccggggccattccttttgcgatttgcgacacggcatgttggaatgtcttgggaatccgtatactgataattcgtgtgtgccaacggcatgccttatgtgacaggcgtgcgggttgggatatcccggaactcgattgcatcacgcgcagcaatgcgacggtgagagagggatgggccatcgggccggtggactgtggctatcttcacgattcagatgcgtggagtgtgggtgcagtgcggcggtcacacaaaagcaagagaaaccactgaatcggagaattcaagttgcctactattgaacagctcgtccgtaagggacgtcaggcaaagccgaagaagtccaagactttggcactgaagggaagcccgctgcgccgcggcgtgtgcacccgtgtttacaccaccaccccgaagaagccgaactcggcactgcgtaaggtcgctcgtgtgcgcctgagctccggtgtggaagtcaccgcttacatcccgggcgaaggccacaacctgcaggagcactccattgtgctcgtgcgcggcggccgtgtcaaggatctgccgggtgttcgttaccacatcgttcgtggcgccctcgatacccagggtgtgaaggatcgcaagcagggtcgttccctgtacggagcaaagaaggcgaagtaagagatatgtcacgtaaaggaccttccaagaagcatcagctgctgccggatccgatttacggttccactgttgtggcacagctcatcaacaagattctgctcgacggcaagaagtcgatcgccgaagacatcgtctactccgctctcgatatggtcaaggaaaagactgatcaggagccggtggcagtgcttaagcgcgctcttgacaacatccgtccatccctcgaggttcgctcccgccgcgtcggtggcgctacctaccaggttccggtcgaagtgaagccggctcgtgcgaacactctgtccctgcgctggctgaccgacttctcccgcgcccgtcgtgagaagaccatggctgagcgtctggccaacgaaatcctcgatgcctccaatggccttggtgcttctgtcaagcgtcgcgaggatactcataagatggcagaggccaacaaggccttcgctcattaccgctggtaattagtcgagaacgagagttaaggaacactcatggcactagacgtgctcaatgatctcaaccagatccgtaacatcggcatcatggctcacatcgatgccggtaagaccactaccaccgaacgtatcctgtactacaccggcaagaactacaagatcggcgagacccatgacggtgcctcgacgatggatttcatggctcaggagcaggaacgcggcatcaccatccagtccgctgcaaccacttgcttctggaaccgtcagacccatgacgagaagcagaagttccagatcaacatcatcgataccccaggccacgtggacttcacggccgaggtggagcgctccctgcgcgtgctcgatggtgccgttgccgtgttcgacggcaaggaaggtgtggagccgcagtccgagaccgtgtggcgtcaggctgacaagtacggcgttccgcgtatctgcttcatcaacaagatggataagctcggcgctgacttctactactccgtcgacaccatcaaaaccaagctgggcgcgaccccgcttgtcgtacagctgccgatcggcgctgagaacgacttcgctggcgttgtcgatctgattcgtatgaaggcttacgtctggaacgacgtttccggcgacatgggcgctcactacgacactaccgacatcccggccgatctgcaggacaaggccgagcagtatcgtgcagagttgctcgaccaggtcgcagaatccgacgaagagctgcttgagaagtatctcgagtccggcgaactgactgaggacgagatccgtagcggcatccgtaagctcaccattaaccgtgaagcctacccggtgctctgcggctccgccttcaaggacaagggtgttcagccgatgctggacgccgtcgtcgactacctgccgagcccggaggacgttccgtccatcgtcggtttcgatcctaaggacgaatccatcgagatcgatcgcaagccgaccaccgatgatccgttctctgccctggtcttcaagatctctacccacccgttctatggcaagctcgtgttcgtgcgcgtctactccggcgccgtcaccccgggcgacaccgtgcttgactccaccaagggcaagaaggaacgcgtcggcaagatcttccagatgcacgccgacaaggagaacccggtcgatgccgccgaagccggcaacatctacaccttcgtgggcctgaagaacatcaccaccggtgacaccctgtgcgacgaaaaggcgcctatctccctcgaatccatgaccttcccggatccggtgatcgaggtggccgtggagccgaagaccaaggccgatcaggagaagatgagcatcgctctggcgaagctgtccgacgaagatccgaccttccaggtgaagaccgacgaagagtccggccagaccctgatctccggcatgggcgagctgcagctcgacatcatcgtcgaccgtatgcgtcgtgaattcaaggtggagtgcaacgtgggtaacccgcaggttgcataccgtgagacgatccgcaaggccgtcatgaaccaggaatacacgcacaagaagcagaccggtggttccggccagttcgcaaaggtcttgatgaacttcgagccgctcaacaccgaagagggcgagacctacgagttcgtcaacgaggtcaccggtggccacatcaccaaggaattcattccttccatcgatgctggtgtgcaggaagccatggaatccggcgtgctcgccggcttcccggtggttggcgtcaaggctaccgtcactgacggccaggtccacgacgtcgattcctccgaaatggccttcaagatcgcaggttccatgtgcttcaaggaagctgctccgaaggccaagccggtcatcctcgagccgatcatggccgtggaagtgcgtactccggaagagtacatgggcgacgtgatgggcgatatcaacgcccgtcgtggttccatccagtccatgaccgactccaccggtgtcaaggtcatcgacgccaaggttccgctgtccgaaatgttcggctacatcggcgaccttcgctccaagacccagggccgcgcaatgttcaccatgcagatggactcctacgctgaggttccgaagaacgtctccgaggagatcatcaaggcccagcgcggcgagtgacacgcgctgccgcttaagtggaaactgtctccagtcagcgctagtattttgtagcgctgactgggttcgggctccaaagtggcacaaacccgtcaaacccagtaaaatgtagcgagtgccttgaagtgagttcaaggcttactacgagacgtccaggaggacaaaacacatggcaaaggaaaagtacgagcgtactaagccgcacgttaacattggtaccatcggccacgtcgatcacggtaagactaccctgaccgcagccatctccaaggtcctgcacgaagagtacccggacatcaacccggcttacgacttcaaccagatcgacgccgctccggaagagcagcagcgtggtatcaccatcaacatcgcccacatcgagtaccagaccgctgagcgtcactacgctcacgtcgactgcccgggccacgccgacttcgtgaagaacatgatcactggcgctgcccagatggatggcgctatcctcgttgtggccgccaccgacggcccgatggctcagacccgcgagcacgtgctgctcgctcgtcaggtgggcgtgccgcgtatcctcgtcgctctgaacaagtgcgatatggtcgacgacgaagagctcatcgagcttgttgaggaagaggtccgtgacctcctcgacgaaaacggcttcgatcgcgattgcccggtcatccacacctccgcttacggcgcgctgcacgacgacgctccggatcacgagaagtgggttgagtccgtcaaggaactcatgaaggctgtcgacgagtacatcccgaccccgactcacgatctggacaagccgttcctgatgccgatcgaagatgtcttcaccatctccggccgtggcaccgtggttaccggccgtgtcgagcgtggtaagctcccggtcaactccaacgtcgagatcgttggtatccgtccgacccagaccaccaccgtcacctccatcgagaccttccacaagcagatggatgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgttatcaccctgccggaaggcgttgagatggtgcagccgggcgatcacgctaccttcggcgttgagctgatccagccgatcgctatggaggagggcctgaccttcgcagtgcgcgaaggcggccacaccgtcggctcgggccgtgtcaccaagatcatcgagtagtttctgcttgatatcaaggcacgcttgaactagcgttttttaggaaaacctcccgaggcatgttcgccgagggaggttttcctatatatggaaggcttaccgacaaagtatgcacaccgtggcataatgagcaaggctcttttaagctttccctgttagacgaagaaataggtgagttaatttggcacagactaccaatgacatcaagaacggttccgtcctgaacctcgatggccagctgtgggccgtcatcaagttccagcacgtcaagccgggcaagggccccgctttcgtgcgcaccaccatcaagaacgtcctctcgggcaagatcgttgacaagaccttcaatgccggcatgaagatggaattcgaaaccgtcgacaaccgcaacctccagtactcctacgaggacggcgacaacttcgtgttcatggatatgaccacctacgatcagatctacattccgaagactctcgtcggcgatcaggccaagttcctgctggaaggaaccgactgcgtcgtgtccttccacgacggcaccccgctgtccgtcgaactgccggcttccgtgatcctgaccgttacccataccgaaccgggtctgcagggcaaccgttccaacgccggtaccaagccggccaccgttgagaccggtgccgagattcaggttccgctgttcatcggcgaaggtgagaaggtcaaggtgaacaccaccgacggctcctacctcggccgcgagaactgagagtaaggacgaaagaagtttcatggcacgttccaccgctcgtaagagggctctgaatacgttgtatgaagcggatgagaagggacaggacatcctgtcccttcttgctgagcgcattgagcagcccggcgcccagactccgctgcctgaatacgccatcgaaatcgttcgtggcgttgcggaacatatcgcagccatcgattccacgcttgacgagcattccaccggttggaaggtcaagcgtatgggcgttgtcgatcgcaatattctgcgtatcgccgcatgggagatcatgttcaatgatgatgttcccaatatggtggccatcgacgaggcgcttggccttgccaagacgttgtgtgatgacgaatcaccggcattcatccacggtctgctcagcgcggtaagcgctgatgcggatgccgctcaagtggatgagcaaccgaccgaaccttcagctgaataaagctgaaagttaagcgattcggccgggtcgcgagtcctaaccggccgctatccttggtacgaataccttgactataagggggttttggtgaaccagtatgattccgaagccgtgatgtttgaccctcaagatgccgttctcgttctcgaagacgggcaggtgtatgtgggtgaaccttacggcgcgatcggcacgaccagcggggagatcgttttcgcaaccggtatgaccggatatcaggaaacgcttacggaccccagctacgatcgtcagatcgtggtgcagacgttcccacacattggggacacgggaatcaatggggaggatccagaatcctcacgaatctgggttgccggttatgttgtgcgcgatcccagcccgaatgtgagcaattggcgtgccaccggcagcctcgatgacgatttggaatccaatcacatcgttggcatcagccgaatcgacactcgcaagcttgtacgccacctgcgttccgcaggcgtgatgcgtgcaggtattttctccggtgatgctctgcttgacgccaatggcaagctgcgtaccatcgagtccatgcttgacgaggtcaagtccactccgcagatgaaggggatgagcctctacgacgaagtcagcaccaaagaagcctataccatcgagccgtgtggtgaattcgaaggcaaggaaccgctgttcaccgtcgccgcggtcgatctcggcatcaaggccatgactccgcatcgtatggccgagcgtggctgccgtgtacatgtggtgccatccaccatcacgttcgatgagcttgaagccctcaatcctgacggtgtcttcttctccaacggtccgggagatccggaacaggctgatcctgaagtgaacctgcttcgccaggtacttgacgcaggtcatccgttcttcggcatctgcttcggtaaccagctgctcggccgtgcgctcggcttcggcacatataagctgaagttcggtcaccgcggcatcaatcagccggtcaaagacatgaccaccggcaaaatcgaaatcaccgcgcacaaccacggctttgctgttgacgcgccgatcggcgaaaccgttgacgcgccgtttgaaaacggcaagtacggcaaggtgttcgtcagccacatcgatctgaatgacaacgtggttgaaggcctgcagtgcgttgatattccggcattctccgtgcaataccatccggaggccgcagccggcccgcacgatgccgcatacctgttcgatcgtttcgtggatctcatgcgttccgccaaggagggaacccacaatgcctaagcgcacagacatcaagtccgtgatggtcatcggctccggtccgattgtgatcggccaggccgcagaattcgattactcgggcactcaggcctgccgcgtgttgcgtgaggaaggcatccgagtcattctcgtcaactccaacccggccaccatcatgaccgatccggaaatggcggatgccacctacatcgagccgatttccacgccgattctcgagcagatcatcgccaaggaacgtcctgacgcgctgctgccgaccttgggtggccagaccgcgctgaacgcggccatggcgttgggtgaggccggtgtgctcaagaagtacaacgtcgagctgatcggtgcttctctggaagccatcgatcgcggcgaggatcgtgagctcttcaaaaaggtcgttgaggaagctggtgcagaatccgcacgttccgacatcgcacactccattgaagaagtcgacaagatcgccgaaaagttcggttatccgctggtcgtgcgcccaagcttcaccatgggtggccttggttccggcatcgcgcacgacgaagaggaactgcaccgcatcgcaggcgcaggcatccattattctccgaccgacgaggtgctgatcgaagaaggcatcgaaggctggaaggaatacgaactcgagctgatgcgcgacaagaaagacaatgtcgtggtcgtctgcccgattgagaacgtggatcctgtcggcgtgcacaccggcgattccattaccgtggcgcctgtgttcactctgaccgatcgcgagtatcagaagcttcgtgacatcggcatcgccatcattcgtggcgtgggcgtcgataccggcggctgcaacatccagttcgccatcaacccgaacaccggacgcatcatcgtcatcgaaatgaacccgcgtgtgtcccgttcctccgctctggcatccaaggcgaccggcttcccgattgcgaagatcgccaccaagctggctcttggctacacgctcgacgaaatccagaacgatatcacgcagtccactccggccagcttcgagccgaccatcgactacgtggtcaccaaggtcccgcgtttcgccttcgaaaagttcccgggtgccgatccgacgctgaccacttccatgaagtccgtgggcgaggccatggctctggcaggcaacttccaggaatccctcggcaaggccatgcgttccatcgacaagcgtcatatgggcttcaactgggacggcgacaagcctgacgtacaggaagtcgagcagctgttggaagccatcaaggtgccgaccgagcatcgttatctgcagatccagcgcgccctgtggggaggcgccaccgaacagcagatcttcgatgccaccaagatcgacccgtggttcatccgccagtttgtactcatcaacgagaccgcccttgaaatcaaggaagcgagcaagctgagccgcaagctgctaaagaaggcgaagctggcaggtctttccgaccttcagatcgcacacctgcgccacttgggcgacgaaggcgaaaacacgatccgcgaactgcgttggtcgtatgatcttcgtccggttttcaagacggtcgatacctgcgctgccgaattcgacgcggtcacgccgtactattactcctgctatgcggacgaaagtgaactgcgtccgcgtgagcgtgaagccgtgatcattctcggctccggtccgaaccgtatcggccagggcatcgagttcgactacacctgcgtacatgccgtgcaggagctgggcaaggactatgacaccatcatggtcaactgcaacccggaaaccgtgtccaccgattacgacatgtccgatcgtttgtacttcgagccgcttaccttcgaagacgtactcgaaatctacgaggccgaaaagaagatgggtccggtcaagggcgttatcgttcagctcggtggccagaccccgctgtctctggcggctcgtctgaaggctgccggtgttccgattctcggtaccacgcctgaatccatcgatctggctgaaaaccgtgagctcttcggcgaagtgctgaagaaggccgagatgaacgcgcctcgctatggcaccgctctgagccttgacgaagcccgtgaggcggctcataacatcggttatccggtgctggtgcgcccgagctacgtgcttggcggtcgcggcatggaaatcgtgtacgatgacgcccagctgtgcaagtatgtggatcgcgcattgaaggaagctcaggccgataccgtggtttctggccgtctgccttctccgttgctgatcgacaagttcctgcaggatgccgtggaaatcgacgtcgacgccttgttcgatggcgaagagctgtatatcggcggcattatggaacatgttgaggaagctggcgttcattccggtgacgccgcatgcactctgcctccgagcaccctttccgatgaccagatccgccgtctgcgcgaaggcacctatgccatcgccaagggctgtggcgtgcaaggcctgatcaacgtgcagtacgccttcatggccaacaccctgtacgttatcgaggcgaacccgcgtgcctcccgtaccgtgccgttcgcatccaaggcgaccggtgtggcactggccaaggccgcggcccgcattatggccggcgaaaccatccagcagcagcgcgataacggcttgctgctgcctcatggagacggtggtgacattcgccgcggccagcaggttgccgtcaaggaatccgtgcttccgttcaagcgcttccgtacgccgctcggcaagaccgtagacgtgctgctcggaccggaaatgcgttccaccggcgaagtcatgggcttcgaccgtgacttcccgcatgcgttcgccaagagccagctggccgcctacgatggcggtctgccgaccagcggcaacgtgttcatttccgtgaacgataccgacaagcgtcagctgccgttgttcgctgcgcgactggtggagcttggattcaacatctgggccaccgaaggcaccgcatccgtgcttcgtcgttacggcatcgagtccaagatcgtcgacaagatcagcgtgcgtatggattccaatccggacgatccgatcaccacctaccatgcggagggcagcgtcggcaagaacgtcgttcagctgatcgaagagggtgccattgatctgattctcaacacgccgaattctcgtggctcccgttccgacggttacgccatccgttcggccgctattgccgcggatttgcctcagttcaccaccatgacggaattctccgccgtattgatggccatcgaggccgtgcgtaataatgattatcagatcatgagcattcaggatcattcccagcagctattcgagttggaaagccgtgagtaatgatgagcagcctcagcagtgaagaaatgagtgcccagcgttcggacttcggtctgcgactgagcaattccatggcccaatatggtccgctatgcgtgggaatcgatccacacaggcagcttcttactgactggggctacaacgtagacgcattgggtgccgaactatactccatgcgtatgctgcaggcagccaatgggcgagcggcagctgtcaaattccagttctccatgttcgagcgctacggttcgaaaggtatcgcagcgctcgagcgggtactgtacgcagcccgtcaaatgggtatcatcaccatcgttgactgcctgcatggaggcttgccgactacggtgtccgcattcgccgatgtctatttcaagccgaggtctccgttgcttgccgacgccatcactttgctgccatattatggcgcacgctcgttgggcggtgtcattaacgatgccctgaacaacggtcgaggtgtattcattgcatcgctgacctcgaaccaagagggcgccagcctgcagaccgccattcgtcaggcaggcgagtacaagggcagaacagtggcgtacggcattgccagcacggctcagaagttcaataagggcaatgacggtatgggttccgtaggcttgatcatcggtgccaccatcggtcagtggatcaatgattccggtgtcgatccagccaagttcactggtcctattctgtctccgggctacggatggcagggtgctgaaacccgcgacctcaagacggtgttcaaaggcaccaagggcaatgtgctcgtcaccgtgtctcgcttcatcgccacgcatggtccggatatttccagtttggccgcggctacggaatccgtggcgctcgatattcgtcaagcgctcatcgaggcccagaacgaagtcgatgatgagattttggatgatgaagaagacgagtaaatcatcatcgatttgtcaacaataattccttcttgtaaatatcttcagcaactaatacagagtgaggaagcaatgaccgactcccagcatggccgtttgatcgtcctttgcggaccggcaggtgtaggcaaaggcactgttctcgggcgcgtgcgcgagcagcatccggaaatctggctgtcggtatccgcaaccacacgacagcctcgtccaggtgaagtggatggcgtgaactatttcttcatgcccgaacaggagtttctcgacaaggaagctgccggtgagttcttggaaaccgccgacgtgtttggtctcgcacattacggcactcccgtgaaacctgtcgtggaacatcttgagcgaaatattccagtcattctggaaatcgatattcaaggtgctcgcagtgtcaagcagcgtgcgggggagttgggtatcgaggtaatgaccgtgttcatcgcgccgccgtcatttgaagaactggaacgacgcttgatcgggcgcggcactgaaactccggaacagcaggcgaaacgattggaaaccgcaaaaatcgagcttgccgcggaatcggaattcgacaaagtcatcgtcaataatgttgtggatgaggcagcagatgaactgtggaaccttatcgcaacggaattcgatttgtaatcataataattacaaggattgcaatatgcgctcgaacatatcgggcgcatatttttatataaaagaagccaagtatgaaataaaaatgaggattgcgcagcatattaactgcacaatcctcattatgttatttaatattcgctaggatcaggcgagaccggaaagcttgttgatcagctccggatcgcgcgtggcacccttgtctgcggaacgggcgaacgccgcgtaggccttcagcgcctgggagaccttgcggtcgcggtgcgccacatagccgtcgccggcttcgagttcggtgcggcgctgggccagctcttcgtcggaaagctcgacgttcaccgtacggttcgggatatcaatgttaatgatgtcgccgttcttgatcagggcaatcgggcccttgtttgccgcctcgggagcgatatggccgatggccagaccggaggagccgccggaatagcggccgtcggtcagcatggcgacctgcttgccgatacccttgcccttgacgaacgacgttgggtacagcatctcctgcatgccagggccgcccttcgggccctcgtaacggatgaccagcgccataccgggcttcagagtgtcgttgaggatgacctcgatggcctgttcctgggattcgacgaccagtgccggtccacggaaggtccaaatctccttcggcacaccggcggtcttcaccacgcagccgtcaggggcgaggttgccacgcagcacggccagaccgccttcggtgacggccggatgatcgatgtcgtgaatcgcgccgttcacacggtcgcggtcgagggagtcgaacagcgtggtatgcgtccacggatcaggggacacgatgtgacccggggccgccagatacatctgcttggcttcctcggtgcaggtatcacgcatgatgtcccagtcgttgagtttgtcctcaagcgtcttgtaatcgatggaatgcacgtcgcggtgcagcttgccggcacggtcgagctcgccgagaatgccagtgatgccaccggcgcgatgcacgtcggagatctcccattcgccggacggcgaagccttgcagatgcagggcacggtgtgggagatgcgctcgatgtcgtcaagcgtgaagtccacgtcggcggactgcgccatggcgaggatatgcagcactgtattggtggagccacccatggccacatccatggtcatggcgttctcgaacgcttccttggtggcgatggaacgcgggagcacagtctcgtcatcatcgtcgtaatactgcttggcgatcttgacgatctgctcggcggcgcgcttgaacaaatccttgcggtaggagtgcgaagccagaatggtgccattgcctggcagggccaggccgatggcctcggtcaagcagttcatcgaattcgcggtgaacatgccggcgcaggaaccacaggtcgggcagacggtcttctcataggcgagcagatcctcttcgttcagattgtcgtcggcggaggcatacatcacgtcgatcagatcggtgttcttcttcacggttccgtcgggaagtaccgtggtgccggcctccatcggaccgccggagacgaagacggtcgggatgttcagacgcagagcggccatcagcatgcccggcacgaccttgtcacagttcgggatgcagatcagggcgtcggcacagtgcgcgttcacctgatattccacggtgtcggcgatgatgtcacggctcggcagggagtacagcatgccggtgtgtcccatggcgatgccgtcgtcaacggccatcgtgttgaactcacgcggaatgccgccagcttccttgatggcctcggagatcagtcgaccaaccttgttcaggtgcacgtggccgggcaggaactcatcgaaggaattggcaatggcgatgatcggcttgccgaaatccttaccgtccacgccagcggcacggtagagggcgcgtgcgcccgcgaatactcgtccattcatcagttttgcagatcgcatttccatgttctctattgtggtggttaagcgggacacggttttgtcaagagtcactatgtggaattcccagaagcgttatattcgcgagcattgccgaagatgcttgcgcttgccgaaaacatgagagaaagggcttgaatcaggtccagtggcggccctatacttaagactttggaaaagaagcttttggcttatctgatgattgggagataatcaatatggcattcggcactcagccaaccccgaccggtcttgcggaaccgccgatcgatgacttgatggagcatgcggactccaagtacgctcttgctattttcgcagccaagcgtgctcgccagatcaattcctatttcacccagctcaacgagggcctgctgcagaacgtcggtccgctggtggagtatcagaatcaggaaaagccgctatccatcgctttccgtgagatcaatgatggtctgcttgaagagaccctcggcgaagacgatctgaccgaaggcaactgatgtaacggttcttgcgataagaaccggattccaagttttcattcgccccgatatctgagcggtgcgctttgaatagtccatagtgaagctattgattgcgtatgcgaaggacggggcgttttttcgtagcaatcagaagggcgaacgtgtggggcgttcgtgaaaggagcagccagatggctgaattgaagttgatttccgctgagtcagtgacggaggggcatccggacaaggtctgcgatcagatttccgacgcgattcttgacgatatgcttgctcaggatccgcagtcccacgtggccgtggagacatgcgccacggttggccagttcttcgtgttcggcgaagtgacgagtgaaggctattccgatattcagagcattgtgcgttctgtggtgcgcaatatcggctataccagttctcgcgttggtcttgatgcggattcatgcggcgtgaccgtttcgttgaccgagcagagctctgagattaatcagggtgtggctcgtttgagtggcgaagcggagtcgaaggcatctcgcgagcagcgttatgaggctcagggcgccggcgatcagggcgtgatgttcggctatgcgtgtgacgagaccgatgtgctgatgccattgccgatttatttggctcatcgcttggcttaccgtcttactgaggttcgtaagaatggcgaagtgcctcatctgcgtcccgatggcaaaacccaggtgaccattgaatatgatgagcatgatgctcccgttcgtcttgacacggtgttggtgtccacgcagcatgatcctcaagtcgatcaggcgtggcttaaggagcagttgacggaacatgtgattcgtcctgtgcttgatgatgtgcttgccgatcgtgtggcgcatgatgaatatcgcgtgcttgtcaatccgaccggttcgtttgtgttgggcggtccggctgccgatgccggtctgaccggtcgcaagatcatcgtcgacacgtatggcggtgcggctcatcatggcggtggcgcgttctccggcaaggatccgagcaaggtggatcgttccgctgcctatgcggcgcgttgggtggccaagaacattgtggcggcaggtctggcccacaaggttgaggtgcaggtggcgtatgccatcggcgtggccgatccggtgtccatcaatgtggaaacgtacggcactgaaaatggtgtgactcgcgagcagatccagcaggctgtgcgtaaggtgttcgaccttcgaccggccgccattatcgacgagcttgatctgaagcgtccgatctattccaagaccgctgcttacggtcatttcggacgcaacgatgctgattttacctgggagaccaccaataaggtcgatgagctgaaagccgccatcgaaggctgagttacccttgaatcatgagtactgaggatgccgagcagctggcgcttgacgggctcgccccgcgcaagcggcgcaagcgtgcgcccgcggttaaaacgccggctgcggagcatcccatagcccaagtggtgctggatattcaggccatccatttggggcaaaccttcgactattacgttgaggagaagtattccgaagccgcccagcccggcgtaatggtgcgtgtccgcttcggcgggcaacgggtcaacggcatcatttggaaacggaccgataccagcgaaacccctgaatcgtcattgcggttcatcgaacgggtggtcatcgatcgtgtgcttgtgtcggaatccatgcgtaacgatgccacacttatcgcggacgcattcggcggaacgcgagccaatatcctgcgtttggcggtgcctccgcgcgtggctcgcgtcgaacaggaacaacgtatcggcaatcgaacgggtattgaaaaaaacggacgtatcgaatcgcttgccaagatcgagcgggaatcgtacgagcagctgcagcggcaatacggtaatatcgacctgcttcgtacggcattggaagggcaacgtttccaagcgttcgtgctcgacccattgccgggatcccatcattggaggcagtgcgtggcctggatggtggccgcggccttattgcagggcaaaccggcggtactggtgttgccgaccatgcgtgagattgaggacatggccgaaacgttgcagtcgatcggcttgcgctgtttcgcgccaacccaatcatccaacggtgcgtacggcggcgatttcgccattctgaacgcgcagatggcgcctgctgaacggtatcgtgcgtatctggccatcagtggagggcaggtgcggtgcgtgatcggcacacgggcggcgatgtatgcgccggtggatggcaatgcgttgttcctcattctcgatgacgtgtgctatcaggatgccgatggcatgatgccttacgccaacgcccgcggagtgttgcggttacgtgcaaaagcgcataatggcgtgttcgtcgcgatggccaatgcgcgcagtgtgcaaagccagtgggaaaccgatgcggcgcatgtcggtgccacccaggtcagcggtttcagtacgccgattcacgcattccctgccgtaaccaaggaagcgagtccttggattcgttggctgaaccgtgacgaattggcaagacttgcggattcgaccatcggagcgcgtgtgccgcacactgcggtgcgagtgctgtcgaaggcgttggaaagcggtccggtgctgttgagcattccgcaggatggcatcggtgaagcattgagctgcgcgaaatgccaccgtcaggctcgctgctcgtactgcacgggtccattggaacggttacgggatgggtcggtgcgttgtcgttggtgcggtgtcgccactgtgcaatgggcttgcccggcatgccataacgaacgtatgcgcgtggttcgtgtgggtgccgccggaactgcgcaggagctgagccgactgtttcgtggcgtgcccattgtgctttcaacgccgagccagccacgcggcattgttcccgatatcgggtttgcgccgcagttggtcatcgccactcccggcgcagaaccccgtgtacgtgggaggaacccctcggaatgcgaataccgggccgtggccattctcgacgcatggaccagcttgtacgccttcggcattgacgcgggcgtagacacgttgacgtcgtggatgcgcgcggtttcgctgtgcgcgccgcgaatcaggggaggtcaggccctgttgatcggcgaaaccgatcccacgctcgctcaatcgttgatgctttggaattcaacgttgctggcgcaaaccgaattgcgggaacgtgaacaaaccgcattgccgcctgtgtttgccgccgcatgcgtatggggacgtcgtgacgcggtgaaggtcacgctggaacgtatcggcgcgttgggtgggggtgacctgtccgccatcgaaaccaccgaaggcatgctgccgtccgtattggggccggtacctattccgcagcctcggaccattgattcgcgcgaattggaaggcactgcggatcgtgtcaaggcggtggtgcgtgtgccgcaaagtcgccgaggtgagttggcgttgcgtttgcgttccgccagtgcccgccatgtggccgcgcgcgaaccgggagaactgcgttttcagcttgatccgaaggagcgaatctgacgcacgtcccctcgccgtgaaaaactagacaggttggcagttcggcatgaggccgcacagcagtgaatggaggatcatatgaagggttggcctggagagcctgatatggagtacgacgtgctcatggctgacggcgaagctgcggtgaatgcgggcaagccgatcaccgatgtgattttcgatttcggcaacgtgctcgtctactgggatccggtggccgtgatgacgccccgctatagcgacgagcttgttgaacagttccttgacaacgatatttccggcttctacgacatcaacgatgaactggactgcggcatgtcgaatgatgacggcgtcgccctgatgcgtgaacgttatggagacaaatgggccgacatgctgcagtactatctcgacaatttcgtcgactcgttgaccggcgtggtgccgggcgcccgcgtgctcatcaacgatttgaaagcggccggcgtgcgtgtgtggggattgagcaactggcagaaggatctgttcccgatcgcgctcgacaatttcgatattctgcgcagcctcgacgatcgtgtggtttccggatatgtctccctgcgtaagccgaataaggatatttacgagttcgcgttgcaacagttcggcattgacgcttccggcgcggtgttcgtggacgataaggccatgaatatcgtaggtgcgaacaatgcgggcattcgtggcgttcgattcaaggattcacgtgcgttgcgtgcgctgctgattgatgcgggtgtgaagattcccgcggtgcatcaggcatagtgtgttgcgttccgctgccttacatgctgttgatgcggacggaatgattcccacgatgataacgatgtgatgaggatttgataaggaggacttttcgtgctgaaagtgctgtttgccggtactccggatgttgcggtgccgtcgttgaaaatgctggctgaagataccgagcgtttcgaagtggtcgcagtgctcacccgaccggatgctcctaccgggcgtggacgcaaactggtaccgaatcccgtgaagcaggccgctcttgatcttggtttgccggtgattgaatccgatccgagcgaggaaacgttcatttccgaacttgctgcgaccggtgcccaggccgcggcagtggtggcgtatggcaaaatcctgaagcaggatgtgctcgacgcgctgccgatgggatggtacaacctgcacttctcgctgcttccgcagtggcgtggcgcggctcccgtgcagcgttccatttgggcgggcgagaaggtgaccggagccacggtgttccgcatcgtgcgagccatggatgccggtccgattctggcgcagtccactgtggaaatcggagcgcatgaaacggcgggtgagctgctgaaccgtcttgccgaggatggttcccgtttgcttgccgcctcgctgcaggccatggccgacgatcagatcgcgcctgtggaacagcctgccggcgcatatgaggtggctcagaagatcacggttgaagacgcgcatattcgtttcgacattcctgtattcgcggtggatcgtcagattcgagcctgcacgcccaatccgggcgcatggtgcgaactgcacgccaatgccgaagcagaaccggccacgttgcatgtgttgcgtgcgcagggcgccgatatgagcaatcccaacacacccgtttcgctagaaccagggcggatcgtggccggaaaaaagaacgtgtgggtgggtacttcctcagatcctttggaattgctggaagtcaaagcccaaggcaaaaaagccatgcgtgccgccgattgggcgcgtggcgcgcatctcgacggagcctactgcaagtagtgtcgaataaacggatcataacgatattgccgtgtgaacatcatcatttcacacggcaatatcgttatcctgcaatatcggattttgctatatcgcgactcggatctatcgggattcgcatcatcgaagaatgcgaatcaacgaagaaaatcaagaatccgggtcaaatcacgttcgttcacacgatgcggagcatccgcctgaaccgcaggcttggcgcagaacgccacgccaagtccggcggcatgaatcatcggcagatcattggctccatcgccaaccgcaacagtctgacccatgctgatgcccatgcgcgaagcccaatcacgcagtgactgcaatttcacatctttcgtaacgatatcgccaagcacatggccggttaaacaaccatcagcggcttccaaacgattcgcaatccaaaaatcaagatgcgcgtcggcggcaagacggtccacgacttcatggaaaccgccggaaaccacgccgaccttccaaccatgcgcatgcaaagcgtcaatcaaatcaagcgccccctgtgtgaaatgcacgcgacgatacacatcatcgaacaccgaagtcggcagatccttaagcagcgcaacacgagcctgcaacgcctcgcgaaaatcaagttcgccattcatcgcacgtgcggtaatcgacgcgatctgttcgccaattccagcggcggcgcccagctcgtcgatgacttcctcatcgatcagcgtggaatccacatccatcaccagcagtccaggctgggaaagggtgggagtgggcgcaatgttcggcgattcttgttcaagcatggttttgattgtcggaaatcatgaggacaatgggtattcttaagggttgagcatgttgaatgcgaatgcgccatgacatgacgaaatgacggaacggctcgaaacgcattcggtggaaagcgaggctgatgcaatggatcaacgtgatgagacgttggcgtcgttgggtgaggccaacgaccagttgatggccaagaatcatgcgttggccaaggcgttgagccgtgccacccaggagctcaccaaggccaaggcccagctgaaccagttggcgggaccgcccatgaccttcgccaccatggttcgcgtgcattcctctcgcacggacgaacagggggtacagcatgccagcgccgaggtgatttccggaagccgtcgcatgatcgtgccggttgcggcgaatgtgcaggcatccaggcttgaggctgggcgcacggtgctgctcaacgagaacatggtggtggtttcgcaagccggcaccgatgctgtgggcgcagtgcgcacggtgaagcaggtcattgatgatgggcgattgctggtcgcggatggcggtggaaacgttgcgttggtccgccgttcgggagcgctgtcgaaaacttcgatcaatgtgtccgaccgtgttacggtcgattcgtccatgagattcgcgcttgcgttggttcccgcgcaggatgatgccgacttggtgcttgaggaagtgccggatgtcacgttcgctgatatcggcggtttggatgagcagatcgaacgtattcgcgatgccgtgcaaatgccgttcctgcatcgcgaactgttcgaacgttatgatttgaagccgccgaaaggcgtgctgctgtatgggcctccaggcaatggaaagacgctgatcgccaaggctgtggccaatgcgctcgccgaaggcgctgccggcggtcgtggcgtgttcctgtcggtgaaggggccggaactgctcaacaagttcgtgggcgagtcggaacgcctgatccgcatgattttcaagcgtgcgcgtgagcgtgcggcggatggcaaaccggtgatcgtgttcattgacgagatggactcgctgctgcgcactcgtggatccggcgtgtcgtcggatgtggaaaccactattgtgccgcagtttttggctgaacttgatggcgtggaaacgcttggcaatgttatggtcatcggcgcttcgaaccgtatcgacatgattgatccggcggtgttgcgtcctggtcgtttggatgtgaagattcgtgtggagcgtccgaaagcggctcaggcggcgcagatcatccgccattatctgaccgacgatttgccgttggtgccaggggtggatgcgaaggctttgattggggtgctggtcagcgatatctattcgacggacgagcaccggtatctgtgcgacgtgtgcgatgagcatgggcaatggcatccgatctatctggcggatgtggtgtcgggtgcggtgctgaaaaacattgtggatcgtgccaaaacccgtgctgtgaaaatctccatcgaaagcggacagccggcggcgattggcgtcgatctgttggcgaaggccgtcgacgaggagtttcttgaaacccgcgatgcggtgttggacgccaatccggaacagtggagccgtatcaatggtttggaagcagggcgcatcacccgtatacgaccagtcgaataatgctggcaggcaacgcgaaatcagacgaagggaagtcgtatcaatgagcgttcgtcgaatcatgggcacggaaacggaatacgcggtttccgctctcggaatggagcattacaatccggtgaagctatcgttcgatgtggtcggtgccgcggcgaacgaacaaaccaagcatattcgctgggactatcggcaggaggatccggtcaacgacgcccgcggcaccaggctggaacgtgcatccgcgcatcctgatctgttgacggacgcgccgcagctcaacatcaccaatgtgattgcagtcaatggcggccgtgtgtatgtggatcatgcgcatcctgaatattccgcgcccgaaaccgatgatcccttcgatgccgtgctctacgaccatgccggcgatctcatcatgcgtgagtgcgcgcgcaaagccagcgaacagaccggtatcgcaatcgcgctgcaccgtaataatgtcgacggcaaaggtgcaagctggggcacccacgaaaattatatgatgctgcgttcggtgccgtttgaccaagttgcgaaactcatgacggcacattttgtagcgagacagatttttaccggatcaggtcgcgtcggtatcggcgaacgaagcgaaaccgccggataccagctcagccagcgcgccgactattttcatatgaaagtcggtttgcagaccacattcgacaggccgatcatcaatactcgagacgaatcgcacagcacggatgcataccgtcgattgcatgtgattgtcggggacgccaatcgtatggatgtgccgcaggcgctgaaactcggcaccaccagcatgctgctgtggctgcttgagcatgccgaagaggcgggattgaacatagacgaagcgttggggccaatcatgctcgccgatccggtgagcgccatgcacgaggtgtctcatgatttgacattaggtgccatgttgccgctggaatatggcggcgagacctcggcatggcagattgaggtcaccctgcgtggcttggtgtatgctgccgctgccgtgatctatggaaccgacacgtccggtgaaccggcatggtctgaccgttcgacccgtaacatcatggcgatgtgggggcaggcgctcgccgatgtggctgccatcaggcatgccgatgatgatgcgcgtttgacgatgcgcgagcaagctggccgcattgaatggctattgaaatggcagttgttggagaagctgcgtcgtaaaattggctccggttgggatgatgcgcgtattgcggccgtcgatttaaagtgggctgcgattgatcccgctgactcgattttcgatcggttgcgtgcccaaacggaacgcctggtcacggacgagcagttggaacaggcttcggtggaagcgccttccgatacccgtgcttggttgcgtgccgaaatgattcgtcgttttccagaacaggttgtggccgcatcgtggtcgcatcttacggtgcgccatcgaacgattggtgataataccgtggagaatccgatggtctcattggatatgtcagaccctctgaaatatagcaaatctcaatgttcccgctattgtgagcgtgtccaagatgcggcgtcgattttggaaatgttacggtgaaatgcaatctgtgcgggtaacattgccatcaattggtcgcgaagaacgaccattgacaacaggtaacatcatcccggtattttgaggagaggacgtgccgggactgtacagaggaaacgaaaaggcatatctatggaactgaggcaaatcgccctcgaagtcgcacgcatcctgcaggacgcaggcaagcatgcgttgaacgaccagatgaatccgcacgacatgagaaaactggaagtgtccgaagactgcttccacttcacttcagacaccgacaagcgcctgcagcagttcatcagcaaccgcctgacctatgtcaacgtgttcgacggcttctggcagcttcgccctgaacagtgctatcccggccagcgatactggtgtgtgggtggcatcgacggcgtgatcaatttcgcgcgaagcatgccggaatgggccatcaccgtgacattgttcgaattcaacgaccagtgctccgcacagccgatcctttcgattgtgcacgctccggcgctgggattgacgtatcttgcggtgcgtggatccggcgcgattcgtattcgcaagactccgttgggagacaaacgcgagaaaatcattccttccaccacgtcgtccctcgatggttcggtggtgagtttcggcatgtctccggtatcgtccgaatcgcagcgtgcgctcgatgtggtggcgaagattgccggacgtcctgccgatattaaacgtgtcggcccggcgtcccttgatttgtgcaaggtggccgacggtacgtacgatgcgtatttcgaaccgcacttgcatgagtgggacgtacctgccgtgtctgctggtgctgtggtgatttgggaggcgcaaggccatctgacccagtggaacggcgaaagcgttcactggcgccaggagaacgatgtgatggccaccaatggtctgatcaccaatgatctgagccagtatttggcatagtgttgcatgctgcgccacacctgatataaggtgtggcgcagcgtttttttgcaggtttgcaaccggaagttacagggaggaatgtcatgcctcaggaatttgaacaggctcaatccgcatccgcaggccaagaggtgggtgacattgtcgaatccgccggcgtacaagtcgacggaaccgctgatgcgttggatgccgtgcttgacgatatcgaatcggtgctcgagtccaatgctgaggaatatgtcggtagtttcgtgcaaaaaggcggcgagtgatgccgcagctgcgagacagcggcaatcattcctcgtcaccgcttgatgcgggaacgttgcgtgaggttcattctttcgctcgtattttcggcattgaaacggaatacggcgtcagtgtgaccggtgcggatgtgccatgcgacgccagccagacggcaatgatgatgttccagccgatcgttgcctccgcgcgatcgaccaatacgtatattgaaaacgggtcgcgactgtatcttgatgtcggatcgcatcctgaatatgccacgtccgaggcctgcgatcccatggatgcccttgccgtggatgcggccggcgaactggtgatgcgcgatcttgcgttggacgcccagcaaaggcttcgagccacgcatgggccacgtgccacagtgcatgtgttcaaaaacaatgtggattccgcagggcattccttcggctgccatgaaaactatctggtacgtcgttttgtgccgttggacgtcatcgaacacgaattgctgccgttcctgattaccaggcagctgttcactggcgcaggcagggtgacggaatcaggtttccagatcacgcagcgtgccgattttctggatgaggctgtctcatcggcgaccacaagatcgcgtccaatggtcaacacgagggatgagccgcatgccgatcccgacgccttccgaaggctgcatgtgatcatcggcgattcaaaccgttctcaatgggccacgatgatgaagctggccaccacgcatctggtgctgtgcgttatcgaacaggctgggcgtgaaggacgtgagtcgggattctcgcggttcgcgttcgcggacgccggtgccgcaaaccgtgcggtcagtcgcgatatgagcggcgtgaatgcttcgtttgccatggccgatggatcgacgttgcagggtggtgccgtagccatgcaggaacgttatctacaggctgtggaacagttcgtggatgagcatccggaagtggcttcgtcgttgcctcgcaccgatgtgcacgatgtgcttcgccagtggcgcaatacgttggaagcgttccgttccggcaatgcaaatgctttgggagacagagtggactgggtgtgcaagtaccgcctgtttgaagcgttacgtgcccgttccagtgcggatcttccgctgagcaagctggaacagttggatctggactatcatgacgtggccaatggcgcgttgtatgcgtcgttgcttcgccgtggtgccttgcgttcgctgattgacggtcgtgaggcgcaaaaggcgcgtaccatgccgccggcggatactcgtgccgcattgcgcggcagattcgtcagtgcggccaaatcgcatggcgcgcagtattcctgcgattggaccagactatcgttgcatgcgccgcggaagatggatatggtgctgctggatccgttccaatgcagggagaatgaggatttccaagccatgattggcgctttggagtaagcgatggtggcaatgggaaacgtcgatgggagtggggtgtggccgacaggcttcggtcacaccccactcccatatcggtatgttctcctgaattgttttgcgattgcgctgcggtcgctttcgtttttgattggcttgaatcaggcttcgccgcgatatttcgccatcatctgcgattgcagctgttgcgcgcttggcggcgtccatgtgatggcatccgcgcccgcttcgatggtggcgaggatgcgatcttcggatccgcctcccgatgccaggatcggtatttccggatgatgcgcacgtatgcttgccacgacttgcgcggtgcgtgctccggctgcgacgttgatgatggccgcaccggcgagaatcttgcattcggtgatttcgtcgtcttccgtgactgttgcgataacgggaatgtcgaccatggacatggtggtttcgatggtttccgctggtgccggcgcgttgatgacgacgcctgccgcaccttgcatttcagccaccatggccagctcggtcacacgcggaccggtggtggtgcctcctccgacgcctacgaaaagtggcatttgtgccacagtgagcaacgcctgtgtgatcaccggttctccagtgaacgggtagacggcgagaatggcgttggcattggtattacggatgatcgcagcgtcggtggtataggcgaacgatttgagcgtatggcctttgactgtgatgccgccgcaatgttgcgatatgactgcgggtactctcgcattgggggaggagaggcgaccttcgatgcgtgcggttccataacgggttcgtgacacatgtggtgttgtggaatgctgttccacggccacggcttcactgggagtgaacagggatcgtttgtcgatgcggattggtttgggggcatttgcttcgggaatggtctcctgctcgtcgctcattcctgcacctccgtatctgtgtgattcagcataaggaattcatggatggctttgcgtcgctcgacaacctcttcatcgagaatcctggtgtcggtgttgtcgatgatgcgctgcagaagttcgctgagggtggaaagatcctcggtgctgaggcagtcaagcatgtgcgttgccgtgtcatggcttttgggaagttgttgcagcggtggcacgccacgacgtgccgcttcgacgttgcatactcgtgtggcggctcgtagcgcggtctgtgtgcgtgtggccttcagcttggtatgcagcagcagaatgttcaattcatgcagttgattgatgacttccttgcgttgatcggtcatgtctctctccatctatatggacacgatgtctaatatatatgcatagtgtagcgcagaatgacgcttgtacaagtgtcatgaacgacgaaagccccgaccgtcatggtcggggctttcgtcgtgtaagcaacatatcagtacatgacttacttggtgacagccttcttcagcagggagccggcggagatgcgaacgccgtaggttgccggaatctcgatggtctcgccggtgcgcgggttgcgtccggtgcgggcggcgcgcttgacgcgctcagcggagaacaggccggtcagcttcaggccttcgccggactgcatcgcctcgacgaacacgtcctggaaagcgttcacagctgcctcagcctgtgccttggtcaggttggacttctgagcgatcttcgagacgagatcagacttgttgtatgccataaagcatccttcttgggtcaggggacattctgattacgaacatccacgttctctatgatattagcgcactcttatgaggaaaatggcattttacaagggttttggtcgcttttttgaaaatcagggggaaaacaaagtgtacgggggtgtttgtcagatcaaattatgcatgtcaagccatttcatggccaacgcaccgaccggaatacgcaaccagtagaaggcgattcggtagacaagagtagcggaaaccgcgatggaggaggggatgcccacggcagtgaacgccaccgacaacacggcctccacggcacccagaccgccaggagtgggaaccgcggagcccaaagtgttggcaagcaggaaaatgaaggtggtttccgcaggattcgtgtggtatccaaacgccatcaatgctgcccagaatcccagtccggtcgcaaggttaagcaccagtgcgccggcaatgccaagggccagttcctttggccgtgcaagcacattgaccaggttgcgcgcgtatgctttgaccactggaaggtatttctcggtcaccaaatgacgcactggaggaatcgccatggcggctgacacaaccaacgcgacgatggcgatcaccatgatcagcgtattggtcggaatcatgccggacaatgtgttgcggccggtgaataggccaatcgtcagcaacaacacgatggtggtgcctccctgtacggcccagaccgcgctcataaccgcggtcgcagccgtactgcgatagccgcttttacgaaggaactgcaggttgacgaatgctggaccgacgccggccggcatggacaccgcagtgaaaccggacgccatctgagagcaatacaagccgatcgtgttgcgtttatcggaatccatgaacacacccaaggtgatagcggaaccaagccacgccacaaagccaagcgcgacgcaaaccaacgccatggcgagattggcgtctctgacggccttgatcatttcggccggctgaatctgggtgaacaccacatatacggcgaccaccagcagcgcaatcgcaatgaacgagcgaagactgaaccgggaaagcgtgactttttccatggaatccgcgacatcctgcggagcgagcgccgaaatacgcgtacgtaaatcggtaagcacatgcttgtcccagccaggcaatgcgcgcgtggaagcgggaatggcagccttctgtatgaagggtgccaaatcgatcagctgctcgtctccccaagtcctgcgagcgcaggcgatcgcacgatcattgccattgagtgtggcaagaagaaccagcaactgtactttgtcgagtgcgaagttcggagcggaactgccataatcgccattatgccaacctgcgattaccggatgcccgttttccatgcgggacagggtttccggagtgatgcgacgatgggtgaagccatgatggtgtgctgtggtgagatattccatgaacgcttccatatcatggtcggacatggtgttttggttgcattccaatggcatgcggttgcggtggaacaccagaatggaggattctccataatcggccacaccatacacgcgcggagtttccaaaccggcattggacaggccgagaatcatggcgtaatgatggtgcatggcgtcaaccgaggaacggtcgcgacgcatggaaacaccggtcaggcgaagccactgccatacttggttgagatatccggccgcatgcacttgattgtcgagtacggaaacggtgtattgcttgccgtcatagtcgacaacatcgtaaatacgggaattttcggtcagatcatcatccagcgtggccttcaatactcccgaatcgacgtagggggcgactcggcgggtgagcaatgatgtgtcaataccgatggaacgcaatgattgcgcgatttgtgatccccacgcgccattgttctgcgtgcctatggcgaaacggatcagcatgccgataacacggcctatggcgtaggatgcgatgacgccagccagtgaattccatgaaagcacgaccatcagcactgccactgcatacagcacgttccagccccatttggtgcatgagcggatacgccgagggccggagacggtgaggaacgatgccatggcggcataaaaatcggggagcagtccagtgcctacggatgtgctgttggattgcagtggaatgatcagcatggtattgccggagttgctgatcagcgcggatatgccccacaccgcaaagaatccgaatatgagggaaaccacggaaatcacgctttgcagccactctttggaagtaagcagctggatgagcacgctgacggtgatgcatacgatggcaagctgctgcaataatgccgagggaacatccatcagccagctgaccacgcggccggcggaatgaacgtcggattccacgccggacgcggtgccatgcaagtacacggagaacagaatcacgcctatgccgagcaccaaggcgaagaatgcgtgcgtcagatcggcgaaatcacgactgcgcttcggcggcacatcgtcgatatgcggggcgggcttattgactgcaggggagtgagacactgttgacttgctccatacgtgagattggcttcaggtgggtcatatcgccccactgcattcgataatacgccctgagggtggctacgaaatacgcggccaccctcagggcgtatggttttggtacttatttgacagcttcggttcagtggtcgaaatctaccagtttgctggcgacgccggtatatgttgccggagtcagcgccttcagacgagccgtggtagcgtcatcgaacgcctgctgatcgatgaactgctcgacggcttccttggagatctcatggccgcgcataagctccttgaccttctcgtacggcttgtccatgcccggcaggccggcaagttcgcaggcgcgcatggcggtctggatcggctcgccaagcacctcccagttggagtccagctcggcttcgatggcgatgtcgttcggatggatggagttcagaccgcccatcagattgttgagcgcgagcacggagtagcccaacgcggagccgatgttgcgttgcgtggtggaatcggtcagatcgcgctgccaacgggattcgaccagcgttgcggacagcgtgtcgagcagcgaacaggagatctccagattggcttccgcgttttcgaaacgaatcggattgaccttgtgtggcatggtggaggatccggtagcacccttgactggaacctgggcgaacacgccacgggagatgtacatccacacatccacgcacaggttgtgcagaatgcggttggtgtggctgatggtgccatacagttcggcctgccaatcatgcgattcgatctgagtggtgagcggattccacgtcagacccatgcggttggtgacgaattcgcgggagacgtccacccaatcgacatccgggcatgcggccaaatgcgcgccgaacgtgccggtagcgccattgatcttgccgagatattcctgagccctgaccttgttcagctggcggttcagacggtacacgtacactgcgagttccttgccaagcgtggtcggtgtagcaggctggccgtgcgttaacgacagcatggccttgtcacggtattcctcagccttctgagccaaatggtcgacgatggcctgagcgcccggcagccacacattctcgatgccgtttttcacgcagcgggcgatggacaggttgttgatgtcttcggacgtgcatgcgaaatgtaccaaagtcttcaggccggtcagctgggtgtcgtggccaagcacgtcggcggccttgtcgagctggtcgtcgatgtagtattccacggccttcacatcatgatgggtctttgcctcatgggcggcgtgttgcgcgataccctcggcgccgaactcctcaggaatggcgcgcaggaacgcctgttcctcatcggtgagcggcttgacgccgggaacgatggtctggttgccgttgccctcgaaaccgttggccagcagaatcatccattcgacttcgacgcgcatgcgctcgcggttcaacgcaggttcgctcaaatattcgacaagcggagcggtctgctgatggtagcggccgtcaagaggggtcaatgcgattgcaggggagatatcagtaagcttcatagactacagcatacgttcagccgtaaacgaaagttgcgtatctgtccgctcggtggatggctttcatgatgtatgccgtgataccgttcttgttgcgccgtggctgcagtgttttttcatttgctcatgcgcccttcgaaatacatgacttcctgcagatcgccgtcgatgatctcatcgaaatgccgttcgtgggtgttcactgcggtggatcccatgtccgttgcgttctggtatgcggcttggtgatatttgagccaatgcgtgatttccttgttgtctggagcgtctgtgacgggagtgcctgcgaacgttgattcctggttgctgctggatttgcttgcggtgccgcgtacggtcagccaatggtcggaactggggttggcggcgccatcgagggccgccacgagctcgtcgtccatttccacgctggtcacccatgttttttccggaatcggatgattggcgacgggcgacccggcggtaaccacatgttcgatgtcataatcgtctttcaggtccgaggcgatggtggcggcaacgatgccaccttgcgaatgtccgatcaatgcgacgggctcattggatttgatgccggcctgtttcatggcttcctgcaccattcgcgcactgtccgcttccatgcgttgcttgctgtccgaactcatgagttcgacgttttgcggccacccaaatggagaatcgtgcttgccgtctgtgcctggaatggtgacgagccatgagttggttccgtcggatttacggtatttggagatggcgatggtgccgtagtcaagtccgctgtcgagatcggtcttgccgagacgttcctcggcaagacgtcgaagatcctccatggcctctccgacattatgcgattcacgcaccacttcggttttcggatggacttgggtgacggtgagattgttgccctggatcaggttgtaaccgcgcgacgatgccttggagatggtgccggctgcatggttgacctcatcggtacgcagcaggcctttggccttgccgtatccgctgaccgcggcgccggccgcgctcatgatgccttcctgcgcccaatccaacgagtccagcagatatatgggattggatttgccctcattggtggatcccatcacatatcccaaggcggacatggctgcgccggcgagtatcgattccttcgggaacgatgtgatcgccacttgcagcagttcgttcagtgttcttctgccagcgtcgtcgacttgggaatataacgattgcgcgcgaatgatcagcgccgatagctcagacaatcttgccgccatggctcccagcgcgcttgcatgggcgtcacattgttcgacgagctggtcgtatggcagttcgatgtgatccgtggcattgcaataggggcttgatccggacagcgaggcgatggccgacgacgcataggggtaggaggaaagctgaaggctcaatgcccggactgaatcatgggcgcggttcagagcgtcggcttgatggctgagggcttttgccgcgcgcatatatgcctcggtttcctccgtggagtatttgcatccgccgctgactttggcggtcacttcccagctcatgccgcacctactgcccataggagacgcaaggtggcgttgatcgaatcccgtagcgtcagggattgcttgcgtaactcatcaagccgcgcgcggtatgattcggcggcggttcctgtccaatcgggcaatgaactggatgcgagcgtggcgtcaagatcgtcaagatgtttcgatatggatgtgagcttggcattgacgagcagttgggtggttcgcacgccagcacggcaatggcatggcatgcctggcgttgaggccaaggtgttgatgaggttgaaccccagtccgggaataaacggataggtgattgatgcgttcatagctatattggagcacatcgggcggttgcctaagccggcgaacaaggcttgtggtcggaggacgggcgaaaagcacgatgtcggcgtgtcatcgttgaaaaatcaacaaaaacacgccgacatgcctgtggataacttcctgaaataagcccccttaccagggttttgcgggcgaagatgtttggttggaatcctgcttggccgccgaaccggaatcatcggaatcggactgggcggactgtgcgttctgggccagaagctcctccaccttctgacgctgctcgtcagtcaaggttcctccgttgccttggcctccatcggtgacggattgcccaccttcgatggctgtgtcggcctcggtgccgtcggcatgctgcatctcttcgattttcttgcgtatggattcggtcagttttgccgaaacttcggcattatgctcgatggatgtgcgtacgtttggcagcaacaacatgccggccgcgccagcttcacggaattgcgcgtcggtctgctgctgttgggtctgcaatttgtcgaaatcggcgtcttgctgttggctggctttgatattcgcattcagactgtccgtggcctggttgtagttgctgacggatgcgagattcactatgccaagcacgcccacaataaccgatatggctgcgatgacggcgatggcgatgcgaacgggcagcgatgcacgcgctgtaacggttgtgctcacagcagcctccttgattgcgtgatccatgccccggcctcgaacgtcagcagcagcgctacggcaatggcgaacggccagaccatggcgacggttcttgtgcgttgcttggatgtctgcgtgacacgccatttgctggatgcctctttggaatccccgccactcatggtcgtcgtggcattgagctggatggcggttccactgagctcgtcggcgatggcgttcatttcgtcggcattcatacgggacacgccaggctcgccggtttccggatcggtgacccattgcgtgtcgccttcctctacgccatcgccggtcacggggatattgcctccctgctcgctgcccacggcgacggtgaacgcatcggaaaggtagcgtcgcaacgatgagaacgttcggcgtgttttcgacgaggtctgctcgccatccgaaatcaggtacagcacgatcgcatcatcgggatgctgatcgtgaatcgacttgcatgtgagcaacaactggtcaatcggcacatccaaggtcgaaccggccgaaatggaagtcgattccggtgcaagcgtgtccgcccaattatcgatcgccttcgaatcaggcgtcaacggaacatccaacgttcccgaagcgccgaatcgcaatgccgcgaaactggaattcggatacatggcggcaatatccttcaccgcctgcttggcaacatccaagcggctgagctgttcgtcggaaccatactgcgcgtccgcgaccgccatggaaccggtcacatctaccgccaccaccacatcggtggtgttaatcgcacggctgttcgtggacgagacgatgcttggcgtcaatgccatgatggccaccagcgcacaaatcatcgatcgtcttgcgcaagcccagacggtttcatcgctttggctgcgtctacggatatgaagcacaatctgcgcgactgcgcaaaccagcatgatcacgcagatcgccgtgcctaaaggccatcccaaagcaggggagagcgtcagattggtcatcgcctcaacctccaagccaagagcagccaaatcactatcgccactgccaatgccagcgtccaccatcccggtgcgtccgatattgcggccttgctgcttgccgcgctgtcatggttgcgccgcgattcgatttgcttgaccagctcagccacggaagcgccgttcgattgcgtgagaaacacgccgccatgcgattcgatttcggattcgaactgtttggtcgtctgttccgattcgctttgctgcggtccggagaacagtccgtccacggtgatttccgcctgtttggtcaggtcaagagcctcctgaagcgtgtatgtcggatctccggaaacgacattgtcggtggcgagcacaatggaagcggcacgttgacgggatgcggtctcggcgttggaactgccgtaggcgaaacctggcagcatggctgcgcaactcaccacgccgtcgccgatcagggaagtggcctctttacgattctgcgtaccttccagccagtcggaaatcgcttggtaatcgctgtctttcatcttgtcgatatcatcctgcgattcgacgcctttcagtatcgtgctggtcttgtcgagctgttcggacaccaattcgtaatcgtcggtcaacggaaacacggtacgtgacgtggaattgaaaatgctcaatccgatgcgctcgcccttgaaattgtccaccaatgtgcggtaggtatcgatcacttcgcggtcgtatggcaacgccgaaccagatacgtccaagcacagcacgatgtcgcggctgctcgcacgctcctctccctcatccacggtgctggggcgtgccaccagcgctatcgccagcaccagtgccatcaccaacagaacgacggcggcacgtgacatggtgcgccactgccgaaataatctcgatgcggtttcggtgttgagatcgtcatccaaactgaacgtccgcacggatcctgagtcgttatgcctgcgttttgcggacgccaataccatgatggcgatgacggccaatgacgcaatcaggcctgcaaggcctacccacggccagtgccatgacaattccattcatcgccacctttccacaagattggcaacccactctccagcctgttcaaccgtggcctctctggccgtgtgattgcgttcggcatccgcgaattccggcggatacaatgcctcgatggtctgcctgagcagggtgagcccatgctggttgccggtcgtgcgaggtgtcgcttcaatatcggtgagcgtctgattgcgcacatcgctgccggtggccgtggagacgaaatctctggcgatcgatgcgagcagggcgaacgcttcctctcttccgagatcgccgttggcatgacggtccaccacatcgttgatgcgttcatgccatatcgacgtgcccgtcgatgcgtcgtgacgtccgcgattggtcttcttcgttggcttgagagttggtttcgacagccataccaccaagacgacaagtgccacggcaaggatgaggcataccgcgacaacgatgcccagccccgtttcgatatgaatcgggtccagtgtgtcgaaatcgttgcgagacaaggcgatgtgattcatgctttgcctcccaaggtgagtgaggacggtgctttgagctgattgcgtgtggagcgagatagggatgcggataccatccgtacgaattcccggaacatacgttcgcttgaatcggcacggatcactgtggaaccgcaacgattcagctcatgtctgatggacgcggacagatattcgcgatgcgtgcgaacctcctgcgccgttttgccggtgcgcaggaatgccggaatgcggcggtcgctgcccgcgtcgaatacgtcgcgcgcatggctattgtcgaacggattaatggttgcgacatcgatgagcaccatcggatgggtccttgcgatcctgcgaatggactccacgtgacgttccttaagtgcgtgctcatcggtggcgatcaccaccaacgcatctctgtcgcgaatgcgacgggcgtactccagcaaagcgtcgatattgcgaggtttgttccaatcacgctgcagcgcattgtccaacgtctgttcgaattgcgtaagtccgccattgaatggcacacgggtgatcgagcctgaatcgccgaatactatggacacttcgtcaccacgacgcaggctgagcgccgcgaacatgcatagggcgttggctgcgacctgatgaacctgttcgccggaaacgcaggtaccggtcatttcctgtccgacatcgagcaaaagccaggcgcgtgaagtggatgggcgttcgcgctgcaccaccatggggcggcccacacgggcgctggtcttccaatcaatccgttttgcctcgtctccaggctcatagatgcggatatccatgacatcgtcggcgccgaaacgcttgtctgatgcgtgcgcaccctcaagaacaccgagcgccttgcgaacagtcggcaggctcaacgtggttccgagggcttcgatcttactgcggatcggatcttcggaacgaattgcgtcgatcatggaacgggaaccgcctgaacgatcgagtccacgacctgatcgctggtgacgccgtcggcaagggcctcgaacgtgagcaggatgcggtggcgaagcacttcatgtgtgaaggctttgacgtcttccggaatcacatagtcgcggccttgcatcaacgcgttggcctgtccgatgcgagtcagcgcgatggacgcgcgtggcgaggctccgagacgcactagtgtggacaatccctgcaccggcttggtgccggctcctcgggatgtggcagtgatatcgaccgcgtatttcatgattgcgtcggacacatgcacgcgacgggccgcggcgcgcaggaattcgacatcgctgatggacacgacgtcaccggtgagcgttcgtgaatcaaaagtgtcggagccgcggtgggtgagcatggtgagcatgcgctgttcctcctgcgcggtcggatacgtcatgacggctttcatcatgaaacggtccatttgcgcctcaggaaggttgaacgtgccttcctcctcgattggattctgtgtagcgatgaccatgaacggtttcggcagtgcgatgcactggccgccgatggtggtggctccttcggccatggcttcaagcatggccgattgggtttttgcgtttgaacggttgatttcgtcgagcagcacgaagttggcgtggatcgggccgatctgcgtggagaacttctgcgtcgcgaaatcgaagacctgggtgcccaccagatcggatggcatcagatcaggcgtgcattgcactcgcttgaacgatccggacacggaagtcgccagcgtctgcgcggccgtggtcttggccagacccggtacggattcgatgagaatatgtccgcctgccaccagcgtggtgatcagcgattcacgcaggttgtcctgtccaactagggtctgcgcgaagcgtgcgcggatgcacgtgccgagctgtttcgcccggttgatgtcctctgggggcaacgtgctcggtttggtgacggccggcattggaacgggggttggtgtcggtaccggattcttcggagggaataaagccatagttgctactgtaacgggtcaagctgacgggagggaccagtccacaggcttctcgcctgcggcgatgagcgcttggttggcgcgggagaacggttttgaaccgaagaatccgtatcgcgcggacataggactcggatgaggtgaggcgataatatatgcgttggtgagcagcggtcccagcgtctgcgccttgcgcccccacaggatggcgaccaagggtttgatgctgccatcgggattgcggcggttgttaagcgctttgatcgccgcgtcggtaacgatctcccaccccttgtcctgatggctgccgggcttgcccgcttcgacggtcaggcatctgttgagcagcatgacgccttgattcgtccaaggcgtcagatcgccgttcgtgggcatgggtacgccgaggtcatccgtcagctccttgtatatattggtcagactacgaggaatgggctggacatcgggcgccacgcagaagctcagtcccaccggatgaccgggggttgggtaggggtcttggcccacgataagcaccttgatgctgtcgaatgggatggtgaaggcgcgcagaatgttcgcgctggcgggaagataccggcgtccggctgcgatttcgcctcgaaggaaatcgcccatgcggtgcacctgtggctcgacctcggcgagggcattcgcccatccgggctccacgagatctttcaacggcttgatgttcgattgtgtcatgcaccttactgtacgacgtgttgcggtcctgatgacaggggtggtttggttttcacgggatggtttcacgaacgttcggaataggggtgggaatgcggctcgattgtgttctgactgaggtggtcggtacacttggcagataagtgtgtgagaaacgaggtttgcaatatggctaagcaggacaaggagacctacgattcctacgagaaggatgtgtacgacaatcctccggcgggacctatgggtgttcaccgtggcgcgcgttccgcggcgtcccgggccatgccgtacgtcattgtcatcattgtggcgctgcttgctggtttgctgttctggagcatttattcaggtgagatcaacaatctgaagatgccgtggtcgtcgcaggagagttcgactacttcaagcgccgaaaagagcaagagcggcgagagcaagtccaagtcccaatccgactccgcttccggcaataagacggacgcatccaatgccgattcgccgaccgactcgcagcaaaatgatcagaacgccgaccagaatgccggccagaatgccgagcagacggataacgccactgcgcagcaggctgtgaacacgggtactgaggttcgcgtcgtgaacgcgacgaatatcaccggttatgcgcaaagcaaggccgacgtgctgacccaagccgggtataccagtgtttctgccagcaatccgacgggaaacgttccttcgcagaccgtggtctggtatcagaacgagaccgataaggcgaccgccgaaaacgtcgcacagacgctgggaatttcgaatgtgcagcaaagcgatggactcgtcacgccaatcgttgtggtgttgcttgactgaaaaacgccgtgagcgaaacaaaaaagccttgttcttttccccaagaacaaggcttttttgttttccttggaattccaacgttgatggcttatttagacgaacaattcttcttgcttacagcgcaactggcgacatggagtttggcactctcggcctgagagtgctaatctgccaattagcactcgaggagcgagagtgataactggcagctgacggctggtgcgttcttcgcttcgaaggtgggaataataccgtgtagccatatgtggaggaacaatggcaaagatcattgcatacgacgacgaagctcgtcaaggaatgctcgcgggcctcgacaagctcgctgataccgtcaaggtcaccctcggtccgaagggccgcaacgtggtcctcgacaagacctacggcgctccgaccatcaccaacgatggtgtctccatcgccaaggaaatcgacctggacgacccgtacgagcgcatcggcgccgaactggtcaaggaagtcgccaagaagaccgatgacgtcgctggcgacggcaccaccaccgcaaccgtgctcgcccagtccctggtgcacgaaggcctgaagaacgtcaccgccggctccaacccgatcgctttgcgtcgtggtatcgagaaggcttccgaagccatcgtcaaggagcttatcgcagctgccaaggacgttgagaccaaggatcagatcgctgctaccgcaacgatttccgccgccgatccggaagtcggcgagaagatcgccgaagctcttgacaaggttggccaggacggcgtcgtgaccgttgaggacaacaaccgcttcggcctggatctggacttcaccgaaggcatgcgtttcgacaagggctatatcgctccgtacttcgtgaccaacgccgaagatcagaccgcagtgctcgaagagccgtacatcctgctgacctccggcaaggtgagctctcagcaggacgtcgtgcacatcgccgagctggtcatgaagaccggcaagccgctgctgatcatcgctgaagacgttgatggcgaggctctgccgaccttgattctgaacaacatccgcggcaccttcaagtcctgcgccgtcaaggctccgggcttcggcgatcgccgtaaggccatgctgcaggatatggccatcctgaccggcgcccaggttgtgtccgacgaactcggcctcaagctcgactccgtcgacatgtccgtgctcggcaccgccaagaaggtcatcgtctccaaggacgagaccaccatcgtggccggcggcggctccaaggaagacgtggctgcccgcgtggctcagatccgtgccgaaatcgccaacaccgattcagactacgatcgtgagaagctgcaggagcgtctggccaagctggctggcggcgttgccgtcatcaaggttggcgctgccaccgaagtcgaggccaaggaacgcaagcaccgcatcgaagatgccgtgcgcaacgccaaggccgccatcgaagaaggcctgctgccgggcggcggtgtcgctctggtccaggctgcagccaaggccgagagcgatgtcaagctcgaaggcgacgaggcaaccggtgccgcgatcgtgttccgcgccatcgaagccccgatcaagcagatcgccgaaaatgctggactgtccggcgacgtggtgatcgacaaggttcgttccctgcctgacggccagggcctgaacgcagccaccaacgagtatgaggacctgctggccgccggcgtcaccgacccggtcaaggtcacccgttccgctctgcagaacgcagcttccatcgctggtctgttcctgaccaccgaggctgttgtggccaacaagccggaaccgccggcagccgctccggccgctggcgctgacatgggctactgatccaacggtttggcaaagcctgacggcataagcaaaaagctataagtggagtccgtttcccatagtggacgcgggctccactttttgtttgcgccagctattgctttgattgtgtcggaagtaccgccgctactgcgcaaacagacgcgatgcctgcatttcggtttccgcatacagtgcggatgcctgcgtcagcgcatgctgaatcgattcgagcgactgctccatctgctgttgggcggcacgccattgttccgccaccgcattgaactgtgtggccgctccgcccctccagacgctctgcagattgttgagattggcgtacatgccctgcaccgactgacgtatcgcttggatggaggcgtttaccgccgcgctcgaggattgaatctgctcgctgtccacctgaaactgtgccatgatgatcctttcgttgccaggtacttttgtgtgctcggttggtaccgttctctcgcacttgacgtatctgaacggtaatgtggactgtatggcaacagtgaacgcgatgaatgaaaaaaccagggttgtggtcggaggatgtgcgaaaatgtgcccaatcggtgtgtcgcgacaacggcaaaacttcagaaatcgttggaatgtagcggcttgcatgcttctttctatgctgttgtgttgtgcgatgatgttgtggataactcccgtcggcagcgcggaagacaatacgggcaccggaatcacggccacggaaaatatcaccgacactgagaatctgctcggatcaaacgtcgccgagatcacggatgccatcagcgcgacaaagcaggaaacgggcgtcaccgtgcatttgctgtacctggcaagtttcaacaccgaagaaaaacctgcaaaatgggcgagcgcgctgttggaatcgcttgatccgaaaccgaatacggttttgctggcggtcgcttcgaacgatggcaatctcgtggttgccgtttcgtcgaattccgacgaatggttgaagaagaagtcgacggtcgatgcgctttccgatgctgcgcagaaacctttgatggaaagcactccggattggtcgaaatccgcaaccgatatgatggatcagattgcggtgcagaagaagacctcgacgtcgtcgcagaccgtgctgttgggtgttggcggcatgatagccgtgctggtgctgctgattgtgattatggtggtgttccatattctgcgcaagcgtggcatcatcaagcgcaaggtgcgcaagcatgcgggaaggcatgccgcgattactgtgcgttccgagccggtgaaggcgtggagtgtcgatggtgagctgtccgttgaagcgcatgatggagggcagacgtcaaaggaagactcagaatccgttcaggaaacatccagtgaacagagtgatgcttaaagcatgagcaagcctattgaagcatccattgtcgttgttgacgacgaaccgtccatccgtgagctgttggtggcatccttgcattttgcgggttttgaagtgaataccgcggcttcgggatctgaagccatcgaagtcatcgagaaaatacagcctgatttgattgtgcttgatgtgatgcttccggatatcgacggtttcacggtgacccgtcgtatccgtcaggaaggcatcactacgccggtgctgtatttgacggctcgcgatgatactcaagacaaggtcatgggtttgaccgtggggggtgacgactatgtgaccaagccgttcagtcttgaggaggtcgttgcgcgaatccgtgccattctgcgccgtacccaggagcaggttgaggatgatccgattatccgtgtcgcggatctggagatcaatgaggattcgcatgatgtgtcccgtgccggacagccgatcgatttgagccccaccgaatacaagttgctgcgttatttgatggataacgaggggcgtgtgctctcgaaggcgcagattttggatcatgtgtggcagtacgattggggcggggacgccgcgattgttgaatcgtacatttcatatctgcgcaagaaggtcgacggacttacggtggaggatgagaacggcgagaagcacaaggtggctccgcttatcgaaacgaagcgtggcatcggctacatgattcgtgcgccgaagaactaaacggtcccgcgatgagtcaggatacccgtcagccgtcggctgacccgcagaacacgcagaagaacggcggccagccgcgtccgcaacgtgtgccttggcatcggcggatcggcaggaaggtgcaggccattccgttaagcaccaagctggtcacttgcatcattgtgttgttgaccattggcactatcggcatttccttttccattcgcacgcttgtgggcaattatctgctacagaaaaccgacacgcagttggtgaatcaggcgcagatgattttcaatagcatggattcgctggacagcaccacgagcgaggatggccggagcttggtgaacacgtattatgtcgaggtgcgggacagcgaatacaagcgtaccggcgctgggtcggtgcctatgctccgtgagggcgtggtgtccgagccgagtctgccttccgacggcagtatcgacggggtcacgctcggagagccgttcaccacacaggcggtggtgcacgttaccaccagcagggtgccggatcatgccatcatgcaggccgcacagtcgccgtggcgtgttgtggcgctgccttggagcgagaaaaccaaaacggggcaggtcaaagacagcggcgtcgtgttcatcggattgtcgctgagtgaccagatcgacacgtccaacacgttgacgcggttctgtgccatggtcggcatcgcggtggtgttgatcggcgccattcttggtaccatcgtcgtgcaaagcacgcttgctccgctgaaacgtatcgagaagaccgctgcgaagattgcggcaggggatttgagccaacgtgttcccgatttgccggaaaatacggaagtcggatcgctgtccatgtcgctgaacaccatgctgacgcgtattgaggaaagcttccacgcgcaggaggaaacgaccgagaagatgaaacggttcgtttccgatgccagccatgagctgcgtactccgcttgccgcgattcacggatatgcggagttgtacaaaatgcagcgtgacatgcccggagcattggaacgtgccgatgagtccattgaacatatagaagcgtccagtgcgcgtatgacggtgcttgtcgaggatttgctgtcattggcgcggttggatgaaggacgtggcatcgatatcacccagcaggtgaagctgacttccgtggtcaatgatgcggctgatgatctgcacgcgctcgacccggatcgtggcatcacctgcggccaggtggtattgcaggcgggatcggatatggaacatccttcgcgtctcgccttccagccgggaaccatgccggacatcacgttgaccggcgatgcatcacgcttgcgtcaggtggtcacgaacattgtgggcaacatccatcggtacacgccggccgattccccggttgaagtgtccatgggcgtgcttccggcgtccatcagcccggaatcattgtctcgcatgccatccaacgagcagtcgttgcatcactttatcgaggccatcgaggtggggcaatccatgcaagtcggcatgaattacgcaattgtgcgattcagcgatcatggtcccggcgttcccgcagatgcacgctcgaagatcttcgaacggttctacacggcggatccgtccagagcacgacagaagggcggtacgggtctcggcatggcgatcgcccagtccgtggtcaaggcacaccatggtttcatctgcgcttccggcagtgacgggactggattgacactgacggtagtgcttccggtggctcctgtggaaccacgtccgttggcgcagaccagtgacgaacgcaaggtcgacaagcgtgggcgcaggccgaaaaaacaatgatgcaaacatgcaaaaaggcatgatctgacgattgttggcgcaagagatggttacatatcccacctcttgcgctaaactgtatctttgatttgtaatcggcggacgattgttctttcgttcgcctgaaggtatgtggattacgtaagagtgaggtgacaatgcctagcggacgcgttcgttggttcgatgcgaacaaaggctatggttttattcagaacgagcagggtgccgatgtgttcctgcctgcagccgccctgccggagggcgtgaagacgttgcgtaagggtgcaaaagtcgagtattccgtggtggagggccgccgtggtccgcaggcaatgggcctcacccttgtggcatccgcgccgtctctggtcaaagcaactcgaccgaagccggatgatatggccgccattgtggaggatcttatcaagttgctggattccgcggggaaccagttgcgccgccaccattatccatctccggctgaaagcaagaaactggccacgctgatgcgtgccgtggccgataacttcgacgtacaggaataattcatgtccgataccacaatggatcccaaggcgatcgcccaggcggtggccatcgaagtcgccgatgaggatggccaagtcggtgacttcgtcgaagccatcgacttgggagacaacgttactgattttcgttttgaaacctgcatacgtgggtatgagggatggcagtggtcggtgacgttgtatcgcgatgctgagttggaccattggacggtcaatgagtcatcgctggtgcctaccgacaaggcgttgcgcccaccggaatggattccatggaaggatcgtcttgaaccgaccgatttggcggtgaccgattcgatcggcaccgatcccgatgatccacgtatggaagaggggttccgcagaactgagcccgttgagtctgccgaaagcgtttccgacgatgtgcagaccgtcgaagcggcggacggcggcgacaatgccggagcggacgctgacgtggttgacggttcgcaagacgagaatgccgtagcatcggtgacctccgaagaggacatcgacgaggcggttgaggaattcgatctgtcccgcaggcacgtgctcacgcctttgggccgttcccagaccgcgaaacgctggtatgagggaccgcgcggaccgaaatcgttgtccaccaaaacatcggatggcaatccatgctcgacgtgcggattcttcattcctctgaaaggcgaactgaatcttctgttcggcgtgtgcgctaacaagtggagtcctgatgacggtcgtgttgtatccatcgaccatggctgtggcgaacattccgaaatcgagccgccggaaccgtctcacttgtgggtgcagtcgaaacctgcatttgacgacctgcatatcgatatcatcgcgcaggcgccgcgtgatgaacgcggttccgtcgaactgatcgagcagctgtcggtgaatgaagacggcaatccgaacgatgaggaagaagcctccgaagccgatatcgaagccaataccgtggatgatgatgcgaatcaggaggaagtgctcgaacatacggcccagcaggatgagccggaggtggaatccaccgttgatttgagcgatgacgaagagccggttatcgtcgaatccgaagaggatgaagcgacggatgcggaacccaccgaagccgaggaaacggacactgcagaggaaaacgctccggaagctgagtaatcctgtcttatcgaggatatgaaagaagtccgttccctatgtaaggaagcggacttctttcatatcctcaaaggtttagtgcacgacagtgacggtgcagtcggcgaaattgacgatttgcttggagacggaaccaaggaaatgcgcgtccaagccggacaatccacgggaaccgaccactagatggcgtgcgtaacgggatgccgcgatcagccccttcgcagcggaaatatggaaggcgtgcgattcgatctggaaatcgtcgggaatgccggcagtgggaatctcaaccgaatcgagcagctcgtcaagaatgcgttccgcccgttcctgaccgacggcaatcggcgctatggcgttctcatatccctcgatgacgccaagatccttgagctgccagcagaacatcacctgcaggggagcgtgatgcaaagccgccaggtcgatagcgaatcgcaaggcgtgtcgcgaggtttccgaaccatcgacgccaaccacgatcggccgctggttcttaggcagaggggagccgggcaaatcgtacgtcaccgtgttctccgaaggcgtaagcgcgttggcgatggcatcctgcacgctggattcctcgtcgtcgagaatgcgaactatggtaacgggaacctgtgcggcttcggcaagcgattccgaaagcgagccgaggaaccagcgtgccactctgccgagtgaacggcgtccgactacgatctgctgcgcatccttgccgatctccagcaatgcggacgttcctgtggccttgaccgacgtgagtttgacatgatcctcattgatggtcatgccctgcgaagctttggaaacccagtcgcgaagccgttgcgcgatctcatggcggacttcggcccactgctcttcatcttccggttccgagcccatatcccaggaatgggaccatgcgaacaccgcattgacctgctggccggtaagcgatgcctcgttcagcgcccagcgtaatgcggcgaaggattcgtcggaaccgtcgacgccgacgacgatgtcgtgcaagcggatatctgcgagcatcccggattcggttgcatttagggtggtgtcgctcatcttggtgacctccttggtcgttgctatatgtcaagcatatccgttgcgttgcgtcgagagcgcaatttacgcgcggatgaaaacaaacgtcatcgcgaatcggtagagtgttgatggactaacaagagtggaaggacaagcatgttcgaacggtttaccgaccgtgcgcggcgcgtgatcgtgctggcgcaggaagaggctcgtaccctccagcacaactacatcggtaccgagcatctgctgcttggcctgattcgtgagggtgacggcgtcgcagccaaggcgctggcctcaaagggtgtgaccttggatgacacccgcaaacaggtcgaagagatgatcggtaaggggaatgccacgccgaacggccacattcccttcaccccgcatgccaggcaggtgttggagctgtcgctgcgtgaggcgttgcagctggggcacagctatatcggcaccgagcatatcctgctcggtctgattcatgaaggcgaaggcgtcggcacccaggtgctgatcaagatggacgtcaatcttggcgagctgcgcagcgccaccatcgacctgatccgtggcaattccggtgatggcaagggtgatggcaagggcgatttggccaatgccggtggcgtgcaggatcgtcgcaaccagaccggttccgcgattcttgaccagttcggccgcaatctgaccgctgaagctgccgccggcaagcttgatccggtgattgggcgttcgagtgagatcgagcgtgtgatggtggtgctgagccgccgtaccaagaacaatccggtgctaatcggcgagccgggtgtcggcaagacggccgtggtcgaaggcttggcgcagaagatcaatgccggcgacgttccggagacgctgaagggcaagcaagtctattcgttggatctgggatccatggtggctggctcgcggtatcgtggcgatttcgaggagcgtctgaagaaggtgctcaaggagatcaagacccgcggcgacatcgtgctgttcatcgatgagatccacaccattgtgggcgctggttccgcagatggcgctcttggcgcttccgacatgttgaagccaatgctcgcgcgaggtgagctgcagaccattggcgccaccaccaccgacgagtaccgtaagtacatcgagaaggatgccgctttggaacgtcgtttccagcccatccaggtgcatgagccgagcattgccgaaaccatcgagatccttaagggcttgcgttcgcgttacgagaaccatcaccatgtgacgatcaccgatggtgcgttgcaggccgcggccgatctgtcgagccgttacattcaggaccgtcatctgccagacaaggccatcgatctgatcgatgaggccggtgcgcgtctgcgcatccgtcgtctgaccgctccgccggagcttaaggaacttgacacgaagatcgccaagcttgccgaagagaaggaccaggccatcaagggccaggacttcgaaaaggccgctgagctgcgtgataagcaggagaagctggaagccgaacgcaagcagaaggaatcttcgtggcgtgagggcgaatccgatgtgaagatggttgtggatgaggatgtcatcgccgaagtgatttcccagaccaccggcattccggtgttcaagctcacccaggccgagtccaagaagctcatgaccatggaaagtgagttgcacaagcgcatcatcggccaggacgaggccgtgtccgcgttgagccgctccatccgtcgtgctcgtgttggtttgaaggatccgaagcgtccgtccggttcgtttatcttcgctggccccaccggcgtcggtaagaccgagctggccaagacgctcgccgaattcctgtttgacgacgaggacgcactgattcgtgtcgacatgtctgaattctccgagaaatatgcggcttcgcgcctgtttggtgctcctccgggatacgtcggttacgaagagggcggcgaactcaccgagaaggttcgtcgcaagccgttctccgtggtgctgttcgatgagatcgaaaaggcccatccggatatcttcaacacgctgctgcaggtgcttgatgacggtcatctgactgatggccagggccgcaaggtggacttcaagaacaccatcatcattctgaccaccaatcttggtacgcgagacatcgccaaggccgccaacaccggcttcaacttgggtgccaacaccgagtcgagctaccagcgcatgaaggatcaggtttccgcggagctgaagcagcagttccgtccggaattcctgaaccgtctggacgacatcatcgtgttcaagcagctcaccgagccgcaggtgcgtcagatcgtcgatcttgacgtcaagcagctcaatgatcgcttgttcgatcgccatatgtcgctcgagcttaccgacgctgccaaggatctgctcgcgcagaagggcttcgacccgctgttgggcgcgcgtccgttgcgtcgcgtgattcagcgcgatgtcgaagacgccatttcggagaagatcctgatgggcgaactcgaagatggccagcgcgtgaaggtcgatgcggaaggcgaaggcatcctgggcgagttcacctttaccggtgaagcgttcgaagatccaaacacggagcctgctgaaggtgaagtcgcagctgaaaccgaggcacctgccgaatcgacggaatcgacggaacttacggaatccgcagaatctgttgaataagcaatcggtgcgtaagtaacgcgacacacgaaaggccttgaaatcgtatgtaatgatttcaaggcctttcgtatgccgaaagtatttcgaaacttgacgaattacagtgtcagcagatcgagatcggcagtgattgacgtgttacgggtgaacagtgtgcgaccctctcgtaccgagcgaagcacttcgcaacgctcgtatacggcgtcgaacacgctggaagcatcaagcacaatgaagtttgcgggcttgcctgcctcaagaccatacgaatcgcgcatgccgagcgtggttgcgccgttgactgtcaggaacttcaacgcatcatcgatctcttcaaaactcatcatctgtgccaaatgcagcacataatcgagaatcagcatcatattgccgttaccgaccggataccagggatcttgcatggaatcctgaccaagcgacacattcaccccagcttcggtgagctccttgactcgcgtgatgccacgacgcttcgggaacgtgtcttgacgcccctgcagatacagattttccgtaggtgcgcaggcgaaattgatatgtgcggccttcaacagcttggtcagatggaagaaataggcattgtcggccgatcccaaggagcaagtgtggcttgccgtggtcttcgaaccgataccggcgcgataggcgagtgcggacagcagttcaagataacgtgagtttggatcgtcggtttcgtcgcaatgcacgtcgatgagcttgtcgtacttcgaagccagttcgaccacggtgtgcatggaacgttcgccgaactcacggcactgctcgaaatgcggaatgccaccgacgcaatcagcacccattttcaggccttcctcaaccaaatccgcgccggattcgccatgaggaccttcataggagtacatgccctcctgcgggaaggagacgatctgcagcgtgacagtatctttcagttcctccttaagctccagcagagctttgagcgaggtaagattcgggtcggtcacatcggcgtgcgaacgaatgaactgcacgccatgacgcatttccttggcgatgccgattttcgcgcgttccttgatctcgtcgacagtgagatctgccttggtttcactccaacgctgaatgccttcgaacagggtgcctgactcgttcaccgcgccgggcttgcgtgcggtaaagacgtaatcaagatgcagatgggtgtcgcagaatggtggacagaccagctttccgcccaaatcgacgacttccacgctcgccatatctttgccttgtgcttcgagtgttgctttgagatggggtgcaatgctgatgaacttgccgtcttcgacgagaatatcttggattgccgctgtttcggctgcggtgctgcccggcatgccggtggcgatgtgtgcgttgatgaacagttgcgtgctcataatcactccttccaatacgagttttcatgcgagttttcgggttccggcagacgttttgtcatatgtccattgggttacggaagggaacctttgacgtaatcgttgatggttattgtcggcgtattgctttgcggtcacgttacttgatgtgacatgtgtattacttcggattggacggtttgtatggctgttacggtgagggaagtgctcgatgatgccttggttgcgacggcggaaccacaggttgaagttgctggcgatagcttggataatccggtgcgttgggtgttcaccaacgaacgcgaggacgtcgcctcatttctggcaggaggcgagcttctggtggtggaggggcgatctttagttgcggacggtcgtgaaaaacgtgcggacgaatatgtgaaaagcctcgtgaatgctgatattgcggcattgatggtcgaattggttgaagaagtcacccaactgccgaaaatgttggtgaaggcagccaagcatgaaggacttacgattattggattgcgcagtcgcattcctttcgtcgatatctgccagagcgtcaataccatgattgtgcgtgatcagatgcgtatgcagatgcaagtggacgttatgtcaacttcgttgcgttctgagcttgctcaagcgtccaatcccaaagccgttgccgatggcattgcgaacctgttcggcgaggatgtggtcatattcgacgtggacggtcttgaagtcgcccgagccggacagaacatcaataccgctacagattgcggcattgtacttgcactggaggaacagaaacggcctttgggtgctttggagatcagccagcgcaatacggtgttcgatgaagcgatgtgcagaaggatcgaacagattgccgctccggttttgacactgtatctcgatgggggagcgcgcgtcggcatggtggcgcatctgattgcggggccggaagatggcgtgcatgtttcgtcgatggaagcgcgtgagggccatgccatgcttgatgcgttgggattcgccgcttcgggcgtgtatatgccatttgccatgaaactcaagtcggtggccaacgccatgccggcaatcgtgtcgatgatcgacgatttcgaatccaacggcggttgcgaatcgatctgtttgttggaaggcgatttaatgatcggttttctcgcggcgcaagacagcggcggcgatgtgtcggtattttcagatcggtgtttgcatgcgttgacgcaagtcgctgcaaacgaatacgtatataccgtgcatggacgcgcagcgttggacacgatttcattgatggacgcgttcggtgcgttgcgcagtgtgattcgaacatgcatttcgaacgatgcggaatgcccgtatggaaccctcgaatgtgtggattcctcgttgctggaacgcatgttgggaatggaacgtaccgatgaggccgtgcgcatggtgatcacgcagacggttgggcatgagcttatgcataacgccatgctgatcgacacgttgtgcgcctgtttcgacaatctcgacaacaagaccggcgcatgcgagcaattaggtatccaacggcagacgttgtacaaccgattggacaaagtgacacagatcgtgggcatagcgcctaccgataaaatcagctggtcaatgctgcttttaggtgcgaaaatggcgaaatcgcaacataatcacaccatatcttccacttcggcgctgtaagcaaggggaacttggcaaaacgtcaaaaacaaacggttgcggtttaacaatcagttcactttggcgcaaatacttcgggcgatagtcagagtcacaacgttcgccgggtatgaagaaaacgcgaacgtacagacagattcagcagaagaaagcaggtgacatgatgagtgccagtgcaacaatcgcaaccgccaacagggcttccgtgtctgaacagtccgaagagcagaagatggtcaagaaagtggccgtctcgtctttcctcggcaacttcattgaatggttcgactacgcttcctattcctacttcgcgaccaccatcgctttggtgtttttcccgtccggcaatcacacggtcgccatgctgcagacgttcggcgtgtttgcactgtcattcgtgcttcgtccgatcggtgcactgttttggggtaacttcggcgataagaagggacgcaagggcgctcttgcgatttccatcatgttcatgtcgggtgcatcgttcctgattggctgcctgccgtcatatgctgcgatcggcattttcgctccggcactgttgctgctgcttcgcatggtgcagggcttctccgcttccggtgaatatgccggcgccgcaaccttccttggcgaatacgcgccgaccaagaagcgtggcatctactgctcgctgattccggcatccaccgccatcggtctgctcgcaggctccacgctcgccaccgtgatgaccgcttcgctgagctctgatgcactgacctcttggggatggcgtattccgttcctcatggccggcccgcttggtctgatcgtgcatttcatccgtaccaagctcgctgattcgccggtgtatgcttccatgaccgaagctttggacgacaagcagcagttcgcttccaccactaagagcgtctccccgctgcgcgagctgttccagaaccacttcaagactttggtcatcagcttcggtgcctgcgtgctcaacgcggtcggcttctacacggtgctcacctacctgccgacctatctgagcgacacggttggcatggctgccgcacagtcgtccaccatcaccaccatctgcctggtactgtatgtggctttggtgttcggcatgggtcacatctccgacatgttcggacgcaagaaggtgctgattggtgcatgcgtggccttcatcgtgctcaccgttccggccttcatggcgctgaacaccgcacagttctggccggtgctgatcgttgagctcgccatgtgcgccaccctgaccgccaacgacggtacgctttcgagctacctgactgaaaccttcccgacatcggttcgtttcaccggctttgcattcagcttcaaccttgccaacgccatcttcggtggaaccgcgccgttcatcgcaacctggctgatctacaccaccggttcgagcatcgctccggcctggtacatggtggcggtggccgccgtggcactggtcgccatgatcctctctcacgaaaacacggataaggatctgagccgcatctgagaagaaacggtttttacgaaacaattcctcgaaacaataaacgccgtccctgaaacatcgattgcaacatcgattcgcggggacggcatcatcgcaatcattatcaattgttgaaacgcaaaccaacaacagcacataaaggagcaatcatgagcagcagccgtcggatggaccatatgacctggccggaaatcgaagcatcgaaatcaaagccggttattgtgccaatcggctccaccgaacagcatagccagcatcttccccttggtgtggacgccatgatcgccagccatgtgtctgaagacctcgccgaacgcatcgacggcatcgtggcaccgaccatgaactacgggtacaagtcgaagccgctttccggaggcggcccattgttccccggcaccatcgacatgaacggtgtgacggtgatcaatcaaatgcatgatgtgcttggcgagctgatcgcggacggtttcaccaaaatcgtggtgatgaacgcgcatttcgaaaacgaggcattcattatcgaggcaatcgatctgatcacccgcgaaaccaggggagtggccaccatcgtcgaaaccaactggtgggatccgctgccggagaacgtggtcgagcaggtgttcgacggactcgtgttccccggttgggcgttggaacatgccgcagtgacggaaacctcattgatgatgcattacgagccggaattggtgcatatggaccgtgtgattgacgaaggcaatgtcacaccgaaggcttacgtgcgctacccggtgcgcaagggcgacgttccggattacggaggactggccactcctgcaggttccagcgccgaacgaggtaagctcatcgtcgatgcctgcattgatgcggtggccgatatttgtgctaccgaattcggcgaatgatagttgaatattctgtatggtgattgcgcacgtgagaacacgtgcgattatacgaagaaggctggtatgtgacggatgtcgttacgtaccagccttcttgattatgcctgagtgaagtccggctgatatttgaccgcatctctgtggcgcaaccaaatatcaggatgtgcgacttacttgatggcgttcagccactgttccttggtggccttctcggattcgagcttggccttcttcttcggatcggattccgcggcgatcttctgatcaagctcagcgagctgagcgttgagctgttcttcgaaggaggacttgcgggcgtcggcttccggatcggactgcttccaagcggcatcctcaatggccttgatctgcttgtctacagcatcgagacggccttcgatgcggcgcacttcgtcacgcggcacgtaaccgatctggtcccactcctcctgaatggcggcgagagcctgacgggcctgcttggcctcttcttcgcttttgacgggaaccagcgcctcggccttgaccagcagctcttccttcttggcaagattttccttctcggaggagctgatctggtcacgatcggcctgacgtgcgttgaagaaggtgtctgcggcggcgcggaaacgctcccacatggcatcatcgtcacgacgaccggcacgaccggccttcttccaacgatccatcagctcggtgaacttgcgggaggtttcaacccaagcggtggaatcctgcagcgcctcggcctcggcgatgatggcttccttggtggacttggcggaattacgctcttcgtcacggttctgcacccacttgcggcgggcgaaattgaacttggtgcgggccgcggagaaacgagcccacagggcgtccgcatcttccttgtcgatgcggacgttgttgcgctgatgctcctgccactgctggaagagcgaacggaacttgtctgcggtggaacgccagttggtgttctcgtcgagggaatcagccagcgcctcggccttctccacaatggcggtgcgctcctcgacggccttggcgatagcggccttgcgtgcctcggtcaacgcggttttcttggctgcgccttcctccttcagcgcctcgaactgggccttgagagcggccagatcacccaccactgccggctgttcggtttccgcggacagcgtcttgatggtctcgtcgatttcgcgggacttcacattgttggacttgagcttgttcgcgaacaggtccaacttggccttcaaatcaaggtaacggcgggcatacagagccagcgcctcttccttggaggcatcagggaactgaccgacctcacgttctccttcgccgtccttgacgaacacagtaccatcgtcggcgacacggccgaatgcttcggcggtcttcacatcggcatcggagaagccggtggatgcggcagccggagcggtgtgctgtggagctttcttggcgaaggccgcggggctcggagcatggggcttcatcgaagccgggctcggaacggccggtttgctggccttgactgcgggcgtcgttgcctgctcggtggtttcattggtgttctcggacgcggtgacattctcgtcggccatggccagctcctttaagtaagcttcatgtagtgcaggggatgcggatcgtgcgaacgtgctttcaaagcctgaaaaacgcgctgcattttccgcaacctcatttattatagggaatcgtggcaaaaggcgcatctatttcaggatttccagagtggctcccctctgaacgtgttgtggagcagcgtgttatcgacacgctccgtgaagttttcgagctcaatggcttcattggcattgaaactcgtgctgttgagcagggttcgagtctgctcaagaagggcgaaaccagcaaggaaatttacctgctgagccgccttcaggaggtcggtcatgagtccgacactccgattgaggaccgccttggtctgcacttcgatttgactgttccgctgagccgttatgtggtcgaacattccggcgatttggcattccctttcaagcgttggcagattcaaaaggtctggcgtggcgaacgcccgcaggaaggtcgtttccgcgagttcgtgcaggccgatatcgatgtgatcggcaacggtgatctgcccgatcattacgaggtcgagctgccgctggtcatggtatcggcattggaacgtctgcgtgagttcggtttgccgaaggccaccgtgcatgcgaacaaccgtaagctttctgaaggtttctaccgtggtcttggcttgaccgatgtcgagggcgtgctccgtgagatcgataagctcgacaagatcggtgccgacgaagtggccaagttgctggtcgaaggctgtggagccgacgagaatcaggcacgtgcgtgccttgagctggctgaactgaccgcagctgacggcgctgaactgtccggcaagttcgacacgctgtgcgagaagcatggcattgccaatgattccgaggcgtacgtgctcgcacgtcagggtcttgacacgttggcgatgattgttgacgaggccgctcgtattcgcccgggatccgtgatcgctgatttgaagatcgcgcgtggtctggattactacaccggttccgtgtatgagacgttccttgacggtgctgcggctcttggttccatctgttccggcggtcgttacgacaatctcgcatcgcagggcaataggaagtatccgggcgtgggcctgtccattggcctgtcccgtctcgtttcatacatgctgcacaccgccggtgcccatgcgaatcgcgtgtctccggcttccgtgctcgtggccgtgtggaacgaggaggaccgttccgcttccaaccaaatcgccaatcagctgcgcgcccgtggcattgcggcagatgtggctccgaccgcagccaagcttggcaagcagatcaagtacgcagacaagctcggcatcccatacgtgtggttccccgcggacaagtccgcgcaggacgcttcggacgaagtcaagaacatcatcacgggcgaccagcagccggccaacgcacagtcttgggagccggatactgtgtatgcccagcaaaccgttaccgtagaagcctgaaatcgcaagacttcaatcattagagaacaaggaataggggaagcatgagccagacggcttatagaacacatcatgcaaccgaagtgaccgaggaactcgtcggtcagaaggtgacgctctccggttgggtcgatcgtcgtcgtgaccacggtggcgtggccttcatcgatcttcgtgacaacaccggtcttgtgcaggtagttatctacgacgaagacatggcacgtccgctgcgctccgagtttgtgattcaggtggtgggcgaggtccgcctgcgtccggacggtaacgagaatgatcatctggccaccggcaagatcgaggttgtggcggaaaacatcgaggtgctcgccaagtctgacgcgctgccgttccaggtgtccaccgcgttggaaaacgagtccgagaacaagctgccgggcgaggaagttcgcctcaagtaccgttatctcgacctgcgccgcccgtccatgcagcgcaatctgaagctgcgttcccagatgtcgaaggctgctcgccacgctctggaagagatgggcttcgaagaggtcgaaaccccgaccatgatcaagtccactccggaaggcgctcgcgattttgtggtgccggcccgcttggtgccaggttcttggtacgcgttgccgcagtccccgcagcttctcaagcagctgctgatggtttccggcgtggaacgctactaccagctggcccgctgctaccgtgacgaggatttccgtgcagatcgtcagccggagttcacccagctcgatatggaaatggcgttcgtggatcaggaagacgtgatggccatggccgaaaaggtcatcgccgccatctggaagtccgcaggctatgagatccagctgccgattcagcgcatcacttggcaggaagccatggataagtacggctccgacaagccggatctgcgtttcggcaacccgctgatcgagctgaccgactacttcaagaacactccgttccgcgtgttccaggctccgtacgttggtgcggtgctcttcaagggtggcgcggccacgcctcgccgccagttcgacgcttggcaggattgggccaagcagcgtggcgccaagggcctcgcctacgtggtgttcgctgagaacggcgagctcaagggacctgttgccaagaacctgtctgaagaggagcgcgctggcctgaaggaagccgttggggcagaagacggcgatgccgtgttcttcgcagcaggccgtcgcacctccgctcaggagctgctgggtgccgtgcgtgtggaactggccgatcgcgccggtctgctcaagccggacgacttcgctttcacttgggttgtggacttcccgctgttcaagcccaccgacgatccggatgacgacgatgtggcagtcggccactccaagtggacctccatgcaccatccgttcaccatgccgtccaaggattggatcgacaccttcgacaaggatccggagcacgccatgtctgattcctacgacatcgtgtgcaacggtaacgaaatgggcggcggttccgtgcgtatccaccgtgatgacattcaggatcgtgtgctcgatgtgctcggcatcactcctgaagaggctgccgacaagttcggcttcctgcttgaagccttcaagtacggcgctccgccgcacgctggcatcgctctcggttgggatcgtaccgccgccatcctggctggcgccgactccatccgcgacgtcatcgccttcccgaaggctggcggcggtcgtgatccgctgaccggcgccccggctccgatttccgacgaacagcgtgcggaaaccggcgttgattatgatccggaagaagacgaagactgatagtgttttcgctttgagataacaggctgtctttgcatgagagaccgtgcaaggacagcctgtttttattgtttacgttgtctattttctcttgctgccggtatggtggagcaaagatgagtatctgaaatattatgagaaagaactgaatctgtagtatgaatttgaagcaatcgttggaaaaacatgattttcatggtgtctggatgcgacttctcgcgttggcgatgatactgattgtggcagtgagtgcactcatcgcatccccagttagtgctaacgccgccgaaatcggagatccctccgcagtcaagggcaaaacctacgcggtcggcaccgataccacattcgcaccgttcgaatatcgcgagaacggcaagatgaccggtatcgatatggaactgatccgtgccatcgcccaagaagaaggattcgaagtcaccatccaatcattgggtttcaatgcagcattgcaggctttgagctccaatcaggtggatgtggtgatcgcaggcatgtcaatcaccgacgaacgcaaggcgacctacgatttttccaatccttacttccagtccggtatccagatggccatcgctgaaaacaacgatagtattaccagctacaaggatcttgacggtaagaccgttgtcgcgaaaaccggatcggaaggcgaatcctacgccaaacagcatgcaagcgaatacggctataccgtgacttccgtggaccagtcatcaaccatgtacgagatggtcaaatccggcaatgcggatgccgtgttcgacgactatccggtgcttgcctacggtgtttcccaaaacaacggtttgaagatcgtgactccgaaggtgccgcatggtgaatacggcatggccgtgaacaaaggcaagaacgccgatctgctggccgccatcgacgatggtctgaacaagctcatcgcttcgggcgagtatgagacgattgtcgcacagtatttgggtgccgatggcgcgaaggaacaggtcgaggcgatttccggcaaggtcaccgacaacggtgccgacggtgaggcgcagaagaaggtcggtttctttggtctggtcaaacagtcgatgccggctttgctgactggtctgaagaacacgctgttgatcacgttgctgtcgtttgtgatcgcactggcgttgggtgttgctttcggcttgatgaaagtatcggagaacaagattctgagaggcgtgtccaaggtttatatcgcagtgttccgcggcactccgattctggtgtgggcgttcttcttctatttcggtgtgccgcagcttatcggacacagtgtgaacatttgggttgcaggtgcgttgacgttgtcgctcaattccggcgcatatctggcggagatcgtgcgtggcgccgtgcagtccgttgactctggtcagatggagggagcacgatcgcttggcctcaaccatcatcaggccatggcgcgcgtgatcatgcctcaggccactgcaatcgccatgccgtcgatcatcaaccagctggtcattatgatcaaagattcctcgctgctgctggccatcggctttggtgaattgctgtatcaggcgcagcaattgtatgcggcgaacttccgcgtcaccgaaacgttgctgatcgtcggtgtgatgtacttcgtggccatcaccatcctcacatggctggccaatatcgttgacaggaaggtgaatcgatgagcgagaactgcaatcacggcaacaatgatggcgaagtgatcatcgacgtcaagaatctgcataaaaactatggtcatatggaagtcatcaaaggcgtcgatcttacggtacgcaagggcgaggtgatctgtatcatcggaccgtctggtgccggcaaatccaccatgttgcgttgcctgaacggacttgaacaggcatccagcggccagatcgtggtcaacggtcatgatctgggtgatccgcatgtgaacatcgaccaggttcgagagcaggttggcatggtgttccagcatttcaacctgttcaacaacatgagcgtgattgacaacatcacgcttgcgccgaaactggtgcacaaggaaaccgacgagcaggcgcgtgaacatgcgatggcattgctgaaaaccgtgggattggccgaaaaggccgatgtcatgcctcgctcgttgtctggcggtcaaaagcagcgtgttgccatcgcacgatccttggccatgcgtccgaaggtcatgctgttcgacgaggccacgtcggcgcttgacccggagatggtcggtgatgtgctcgaagtcattcgtgagctggccgaagacggcatgaccatggtgctggtgacccacgagatgggtttcgcccgcgaagtggccacccgcgtgatcttcaccgacgccggcgtgatcgaggaggaaggcactccggacgagatcttcaaccatccaaagagcgaacgattgaagacgttcctttccaaagtgctctgagtgctctcttggccccggcgattgcttaatcgctgatcgcggatgaaatgctgcgatcgtgtgacggatggtcatacgaatctgcatgtaaaagacaggcgaatgtagggtgaaattcatcttgcgttcgcctgttcggctctttctcgttgcttggcgttcctacgttggtatgcatgagcattggtgatacatggcgtcgcgttgtggatggtttcaaatccaaggtgcccgaacgagtggtgttcggtgcggtggttgtattgttcgtaatagcggtgctggctatcgaattgccacgatggtggtagctgccacgtacggcgctcaagatatcggtattgcggtcgataacgcgctatgatgcattttgggacaacgttgtctcatatttcgagcacgtcagggggtggtgacggccgcggaaacatggctttcatatactatccgtatgacagatatcaaagaaacgcaagagacgcgcccgatcatgccgggtacggaagacagcgaccgcccgctggtcgaattgacccacgttgaaaagcactacggtgacttgcatgtgctcaaggacatcaacctcaccgtcaagaagggcgaggtgctggtcatcgtcggtccatccggttccggcaagtccacgatgtgccgcaccatcaaccgtttggaaaccattgattccggtgatattcgcattgatggcaagccattgccccaggaaggcaaggagctcgccagcctgcgtgccgaggtcggcatggtgttccagtcgttcaacctgttcgccaacaagaccattcttgagaatgtgacgcttgcgccgatcaaggtgcgccacatggataagaaggcggccgaggatctcgccatggacctgctctcccgagtgggagtggcttcgcaggcttccaagatgccatcgcagctttccggcggtcagcagcagcgtgtcgccatcgcccgagcgcttgccatgcagccgaaggtcatgttgttcgacgaaccgacgtccgcacttgatccggaaatggtcaatgaagtgcttgacgtcatggtggagctggctcacgaaggcatgaccatgctgtgcgtgacccacgaaatgggcttcgcgcgcaaggtggccgacaaggtcgtgttcatgtccgacggccagattcttgagcagagcacgccggaggacttctttgaaaatccgaagaccgatcgtgccaaggacttcctgtcgaagattctcacccactgaaatgactgacgggaataagacagaagaaggattttcgatatgagactttctatgagggcgaagcgtatgctacgcagggttatagcgaccttctgcgcatgcgcatgcgtgttcgcagtgtccgcctgtggcgcggacgacgccgatggcaagattcgcgtcggtatcaagttcgaccagcctggtttgggattcaagaagtccggcacctatgtcggcttcgatgtggatgtggccaagtacatcgccaagaaactcggctattccgaagaccagatcgtatggaaggaggcaccgtcgaagcagcgtgaggccatgctgcagaatggcgatgtcgatttcatcgtcgccacgtattccatcaccgacgaacgtaagaaggttgtctccttcgctggaccgtacttcgttgcgggtcaggatctgctcgtgcgtaaggacgaaacctccatcaatggtccggaggatcttaatggcaagcgtctgtgctccgtaaccggttccacttccgcggtcaccgtcaaggagaagttcgccaacgaagtgcagctcatggagcagcctggttacgcggagtgcgctaccgcactgttctctggcattgttgatgcggtgaccaccgacgacattattttggctggtcttgcctccgcgtcccgcggccgtctgcgcgtggtcggcaagccgttcacccaggagtattacggcgtcggcatcaagaagggcgatacgaagctggccacccagatcaacaacgccatcgccgatatgatccaggatggttcttggcagcgtgccatttccgacaacacgaagggcaccgcatacacgccgaacgcgaagtacaatccgccggagccgactgagggggagagataatggaagcgttcatctcattgttcagccagtacaatgtgccggctgcgttcttggtgaacattgaactgaccctgtggtcggcgttgttctccacgattcttggcgtcatcctcgtgatgatgcgcatctcgccggtcgcgtcgctgcgtatggtctcgggtgcttacgtcgagctgttcaagaacctgccgttgaccatcatcatggtgttcatggtgctgggtgcctacgcgcagctgaagctcagcttctccgacacgttcgccaccaacttcttctggcttgccgtcaccggtttgagcctgtatacggcggccttcgtgtgcgaatcgctgcgatccggcatcaacaccgtgccgcttggccaggctgaagcctgccgtgcgctgggattgaacttcatgcagtccgccacccagatcattctgcctcaggcgttccgtggctccgtggcaccgctgggcaacacgttgatcgcattgctgaagaattccacggttgcggccgcggcttccgtcgccaccgaaacctcgtcgttgatgagcgaaatgatcgaataccgttccgacgtgattgttccgatcttcctgatcttcgcattcggttatgtgattctgatcattccgatcggcatgctgaccacgtatctgtccaacaagctcgcggtgaggaggtgacgcaccatggcaagcgatgaaagcgcggtgctgttcgaccagcccggtcctaagacccgtaaaaccattcgtatcgtcaactggattgccggcattgtctttgcaatcgtagttgtgctcattctcatgaggcttcacaatccgccggatggcgagaaccagctgagctgggagttgtggaagccggcgcttgacgctgaagcatggaccgatttctatctgcccggattgtgggccacgattcgagcttccgtgttggcagtgatcggcgcagtgctgttcggtctgattttcggtatcggccgtctgctgccgaatatcgtgattcgtgcggtttccggcgccatcgttgagttcgcacgtgcggtccctgtgctgctgctcatgatcttcttctggcgttggttcgctttcgcaggcatgtcaagccccgcatactgggctgtggtgctcgcattggtgatctacaacggttccgtggtggccgagctggttcgttccggtgtcggcaacctgccgaacggccagcgtgaggcgtcgctcgccttgggcttgacccgcacgcagtcgctgatggaaatcgaagtgccacaggccatctacgccatgcttcctgccgccgtgacgcagttggtggtggtactgaaggataccgctctcggctcgatcatcatgtacaccgatttgctgcaggaatcgcgtcgacttggttcgatgtacttcaatattctgcagacattggttgtggctgccgtcatctacttcatcgcatgctggctgctgagccgtcttgcggaatggctgccggaacgcatgcagaagcacactgcggcacctgccgaaccggaaccggtcgctccgatcgccattatggatccgtcgaacgtgaaccagatcgccgtggctagggaaggtgtgccgcttggcggtgcccagcgcctgtaccatgtgcaccatcgtggttccaacgcgtcgattcgccattggcgtcagacccgctatgttcagggattcgatgagacgcatccggaaagccaagtcgagttcgataagaacggcaggccgatcaaagatacgtccaagcaggacaagctgagattcgacaagccgaagtcagacaaatcaaagggtgataagcccaagcagtgacgtcatttgatctgagaagaccgatagggcgctggtttcttgcaaagagcgaggaatcagcgccctattgcgtgaaagaagtcagacaaaacgtcagaaaagcgggatgcggcgattgggtgcggcgatgccacggttcaatcgccgcatcgtctatcataggggacaagcgaggaggcttgacatgtcagacaaagacaaggatgcgaagacgtcgtccattgcgaagacgttgaacaaggttgaggacaggcttgagaagggggagaactgcagttccgttgccgaagggcttgcgaatgttgccaaggccagcgagttgctcagttccgtgtggacgcttccgcccagtcagttattgcgattccatcatgatacgagggtcgctgcaatcgatggcgattccacgccgggtttcgacggcaacaaagatgatgcggaacgattcattgcgatcagttcttctgaaatcgcacgatatcagcggcttatgtacgccaatggagtgaaaggttcccgccgtcgtctgttgattattctgcagggcatggatgcttccggcaaaggcggcatcgtgcgtcacgtattcagccagggcgatccgatgggcatgcattatcacggtttcggtgctcccaaaggcgaggaaaaggaccacgattatttgtggcgcatcaaacgggaactgccgcagaatggttggatctccattttcgatagatcgcactatgaagatatcgtcatgccgcgcatttacaaaacctatccggaagaggtatggcaggcgcgatatgacgaaatcaaccgattcgaatcgcaattggttgcggacggatgctccatcatcaaaatattccttgtggtgagcaaagaagagcagaaggagcatttcctcggcaggctggaggatccgaccaaatattggaagttcgaccccagcgaccttgaagcgcgtgcccgttggaacgactacatggccgcatggcaggacgtgttcgcgcgtacgagcaccgagcaggcgccctggtacctggtgcctgccgacaatcgttggtattcaagggcggttgtgtctgaactgctccgtaacgtattgaagaacatgaacatgatctggccgcccctggaagtcgacgccgacgagatgcgacgtcagttggaaacgctgtagtcgaagaacacgacttcgccgctcgactgtgtggtgtccaaatcgacggttccggtgatggcccaatcatggtcgccatcggaatcgtcgatgatctgacgcaccttccaactgtgctcgctgttctccttggaatcgtcgaggatgaacagttcgccgctacgggccttcgcatccgtgttgacgtattcgtgctcatcgtagaagtcgtcgagcgcatcctcccattcgtgcacgccataaccccagtctttgtccagcgcgccgagctcgtcgggtttgtcgagatccatgagctgcacgcggcggaacatggcgttgcgcacgagcacggtgaggcctcgacgatcctccaccacggcctgcttcgcgccgggcgcggccaggttcgcggcggcttcggaagcgtcggtgccggctcccgcgttctcccattcgtcgaccagcgaggagtcgatggaacgaaccacaacgcgcagccaggagatgatgtcccgtaactgttcgttgcgcttctccaaaggaacggtacgcgccaacgcgcgatatgcgtcagacagatagcgcagcagcgtgccttcggagcgggcgatattgtagcgcgcgatgtaaccggtgaaatcggaggccgtttcgaccatgtcccggatcaccgatttcgggctcaaccaataatcattggcccaaggcacatcgtgacggtattcgtcgaacgcagcctgaagcatgtcttccaatggtttcggatacgtgatctcctgcaagcggtccatacgttcgtcatagtcaagaccgtcttccttcatgcggatcatcgccgcgtcgcgggcttgacgttcctgcgcgcgcaacacctgcttcggatcctccaacgtggcttccaccatggaaatcacgtcaagcgcgtaactttccgattccggatcaagcagttccaacgcagccagcaggaacgggctcaacggctggtcaagcgcgaaatcatccggcatgtcgacggtcatgaaatagtccttgccaccatcatcgcggtcttccgtttcgatcacattcgtgtcgaacaaggtctggaagatctcgtcggcacgatcatgaagacgctccttctgttccggagtctgcgcagaatcgtcgatcaggcgatcgatgcggtagcgtgcgtcgccgccctgcgccacttcgttcaacaccatggaatgcgtgaccttcatatgcggcaccaaagtttcagggtccgcgtcgatcagcttatcgaacgtgttctcattccacgtgacgaagccctcaggcgccttcttgcgcttgactttcttgagcttcttcgggtcgttgcccgctttggcgagggccttggcgttctcgatttcgaattccggaccctcggcgatgaccaagccctccgtgtcgaagcccatacgtcccgcacgccccgcgatctgatggaattcgcgggcacgcagcttgcgcatcttcgtgccatcgaacttggtcaatgcggtcaacaccacggaatgaatgggcacgttgatgccgacacccaacgtgtcagtgccgcagatcaccggaagaagaccctgctgggcgagttgctcgaccagacggcgatagcggggaagcatgcctgcatggtgaatacccacgccggtacgcagcagacgctgcagaatcttaccgaacgccgtggtgaacttcgtgcccttgatcgcctccgcaatggccgcacgttgctccttgctggacactcccgtgctcgccagggcgttcgccgtctccaatgcggcgtcttgggagaaatgcaccacatagatcggcgtttcccctctgccgaacgccagttcgacggttttctccaacgggtcaagcgtgtactcgtacgtcaacggtaccggacgcggcgcatcggcgatgatgtcgacgtccgtgtccgtcatgtcctccaacttgtcggcgattgcatcgacgttgcccaatgtggcgctcatcagcaaaaactgcgtgttcggcaatgtcagcagcggaacctgccaagcccaaccacgctccgaatcgccataataatggaattcgtccatcgccacacagccgacatcggcatgacggccctcacgcaatgcctggttcgcaagaatctccgcagtgcagcagatgatcggcgcatcggcgttgatgtgcgtgtctccggtgatcatgccgacgttctcacgaccgaacacctccaccaaatcaaagaatttctcagacaccaacgccttgatcggagccgtgtaatacgagcgacggcccgtgcacaacgcagcgaaatgcatacccaacgccaccagtgatttgccggagccggtgggcgtgttcaaaatgacatgatcgcccgcgagcaggtccatgatggcctcttcctgatggggccacggctcaacacctttgacgtccgccacccactcgaaaaagcgttcgtagatctcgtccgtgtcgatgttgcgctcgccatcgctccaattcggcgccaaggcgcccaaagaaccgtaattcgtatcgtcagccatgattgccagtctagcggctggcatgaactcaaatgtcgaacgtgtgttcgaattattgcgtatgttgcggtacagtagaaattatgactgaggatttgtttggtgcgatggacgctcccgaagatatgacacgcccgctggccgtgcgcatgcgtccgtcgagcgtggacgaagtggtgggccaatcgcgggtgctaggacagggctctcctctgcgcagactcgccaatccggcgtccaaaggctcgctgaccgcgccgagttccattattctgtttggacctcccggagtcggcaaaaccacgctcgcctatattgtggccaaacagtccggtcgagtcttcgaagagctttccgcagtcacctccggcgtcaaggacgtgcgggatgtactcagacgcgcccatgatcgtcttgtcgcggagggcaaggaaacggtactgttcatcgacgaagtgcaccgattctccaaatcgcagcaggatgcattgctgccaagcgtggaaaaccgtgacgtcactttcattgcggccaccacggaaaatccaagcttttccatcatcaaaccgttgttaagccgatccgtggtcgtcaaactcgaatcgctggaacccgacgacctgaaaacgctcatcaagagggccatcgaaagcgagcgtgggcttaaaaacgaagtcaaaatcaacgacgaagccgttgacgaaatcgtgcgtatggccggaggcgacgcgcgaaaaacactgacgatccttgaagccgccgcgggggcgcttaccggagaccaagcgcgcaaaaaaggtacgaaacggccaatcatcactcccgacgtggtatcgcaggtcatggacgtggccaccgtgcgctatgacaaagacggcgacgaccattacgatgtgatttccgcattcatcaaatccatgcgtggatccgacccggacgccaccatgcactacttggcacggatgttgcgcgccggcgaggatccgcgattcatcgcacggcgcattatgatcgcagcttccgaggaagtcggtatggcggctccgcagatactgcaggtcaccgtcgcggcggcacaagccgtgtccatgatcggcatgcccgaggcgcgcatcattctcgcggaagccgcgctcgccgttgccaccgctccgaagtcgaacgccagctacaacgccatcaacagcgcgctcgccgatgtggacgcgggattgatcggtcaggtacccttgcacctaaggaatgcgccgaccgccctgatgaaaagttggggcaatcatgaggggtatcggtacgctcatgattggccgggagccgtggctccgcagcaatacatgccggacgagctggcagggcgggaatactaccatccgaacgatcgcggctacgagcatgagatcaaaccgagactggagaaaattcgcaaaatcctgcatgagaagaacggtgataggggctgatcgtttcttcccgccgctgacgagttcacccatatccgtgtacaatgctgacctagtgaacgttaacatacgttcgtgctcaacgtggagggcgagtctgggcaaacttggacgcagtgttgaagggaatgacgaagcaatgcgaaatatgcaggatgagtctaatcaacgattgatcatgatcgtcgacgacgatcaggctttgggcgagatgctatccatcgtattggagagcgaaggatttaaaaccgtgacctgcttggatgggtggcgtgcggtggaaatgttcccgacattgcagccggatttgatgttgcttgatgtgatgctccccggtttggatggcgtccaggtggcgcaacgcatacggcagaactcgaatacgccgatcatcatgcttaccgccaaatccgacaccaccgatgtggtgaaaggcctggaagcgggggcggatgattatgtgtccaaaccgttcgaggtggtggagcttatggccagaatcagggctcggctgcgcatgcccaaggtaaacgcgcctgcaggcaaggatgagggcgacctgactgaacgattgcaatgcggcacgctcgtaatggatagggctgagcataccgccaccaaagatggtgtggatctgcagctgacgccgacggagtttgaattgctgtacgtgctggcggctcacgcgggtgaagccctgagccgtgcgaacttgctgaaacgtgtttggggatacgaaagtggcggagataccagattggtcaacgtgcatgtgcaacggctgcgcatgaaggtggagaccgatccggagaatccgcggatcgtgcagaccgtgcgcgggatcggatacaagttcgtagccccgacggtataagcgaaccatgctgatgagaacccatcgagtgtggtgtatctggcatcgtgacagacagcaggtgcgccgatcattgcaggcgagaacggtggccgtgtcgatgctggtggtgttgctgacggccgcgttgctgtctttgttttccatgtacgtcatcaggggatccgtgctggagcaggcgacggatgactcgcgcagcgatttctcatcgcagattgtgcgcgtccagaagcatctgaatgcctcgaatctaactggaacggaccaataccagcagttagtgagcaatctggcgtccgaattgcaaagcaatggttcgagcaatctggtcggcgtgtacctgatggaacgtgatgcagcggattctgcggagcgtggattcgtgccggtatcgacggagccggaatattcaaatctggtgtcgtcatctatgcgcaaccgcatgcgtgctgatacgtccggattgatctactatcagccggtacgtattccgagaacttccggaggtacgcccggcgcggttttgggatcggtgatttcgtcgaataacatgggctcattggaagtgttcgcactgtactcctaccaatcgcagcagcaggcgctgagtcagatccagatcaacatgctgatggtgtgcgtggcgttgagcgtgttgatcgggatgatcatttttctggtcatgcgttcggttatcactccggtacggcgggtcgccttggctacggaaatcatggcatcgggaactttcgacgcccgcgtggcggtggacagggccgatgagataggcgtgctgcagaaatcgttcaatgaaatggccgaatcgttggagaatcagatcgaagagctggaaaaagccggggatatgcaacgcagcttcgtttcggacgtcagccatgaattgagaacaccggtgacgaccatgcgtatggccgccgacatgctgtcgatgcacaaagacgaatacgatgccaccacaaagagaacggtggaattgctggatggccagatccgcagatttcaggaaatgctcgccgatttgttggagatttcgcgtttcgacgccgggtatgcggcgcttgatttggtggaggccgatatacgcgagcccatcgaacagtcggttgaagcgatttccgccatcgcccagaccaaacatgtgccactggatgtgcatatgcccaacgtggaagtgcttgtgagaatcgatacgcgtcgtataagccgtgtcgtacgcaatcttctcgctaatgccatcgatttcgcggagggcaagccggttgaggtccgtcttgccgccaatcagcgaatggtagtaatcagcgtgcgcgattacggcgttggcatgacctcggaacagtgttccagaatgttcgaccggttctggagggcggatccttccagagcgcgcactaccggaggaaccggtttgggcatgtccatcgtactggctgacacgaaactgcatcatggtgatgttgcggtgcgatcgcggctgggtgaaggaacatggtttttggtgacgttgcctcgcaatccggacgatgtcgattgcggtatgaacaacgctccgattcgattcgcgaccgatggcgacgatatgcgggtggtcggaggctttggcgttgccgataacggattcgtggactatctgaccaataaacccatggtggaggggctgtgatgactgcgaaaaacattcgtcgtgtgattgccgcggtctcattagtggtattgctgggatgctccatgatgcatctggccggatgctcgagcatattgggacttcctgaagatggtccggtgcagaccatgaccccggaggaacaaagcacaagaagagtgttcacgtctcccgacgggccggccgatgacgcgcagccggaagccatcgtcaaaggatttttcgacgtcatgcctgcgggagtgcagagtgacgggttcgccacgggcaagcagttccttaccgatggcgccgcatcaaggtggaatgccgataaccggactacggtatatgccgacgtgccgaaattcgtgcgtaaggccagcacggtggagtcagggcaaggcgggcagaaaaccgtggtgagcgtcagcctccagatacaaggggaactggatgcgcatggcgtgtatacggcggtggcgagcggaggggcaaaaacctacgatttctccctctccaaagtgcgtggccaatggcggatcagcaaactgccgacaggcgtgatgatcagctcctacgatttcgagcaggtgtaccgtcaggtttcgctatatcagttgggctcttccgaaaaagaactgatccccgatgttcgttggctttgctggagggattggcggacgcgcgccgtgcaggaactgcttgccggaaatgcggcatggctggaaggcgcggtaagcgacaccaataccaagcggatcgtgttgcagcccgacggtgtgcagatgcgcgattcggtgatggaaatgagtctctcatcggcgatggaacgaatgacggatgccgaacgtggcattttggtcaggcagattcgcctatcgttgggggacggcagcgccgagacggaaatcaaggtgatgtctggaaaccatgactattcgcatgccgatgattcgtcgtctcttgatgcgcagactccgctgaatcccatgtatacgttgagcgtcggcaatatcgtgtcgttgaaatcctacagcgccattcgtgtggcgcaaacggatctttcggacgtgcgaagcttcgttttctcagcacagggcggagccgtgcttggtcgtgacggatatgtgaaaaggctcgcagaggacggttccacccatgcattgatgttttcaggacgcatgatgaaaaccatctgcaaaggaaacgactccgagatttggggcatcgacacatctggcaagcacatcatggtcgatgatgccggcacggttctcacccttgacgttcccggcctcgtatcagcacaaacgctccattccatgaggctttcccctgagggggaccgtatcgcattctccatcgaatcggatgggggagcgcagtcgggtgtggccatcatcgggatatgccgggaccatgatggctccgtggctgggctgtcccaagcgttcgctttggtttccacacagtccaatgtgtcgatgatgacgttctataacgacgtcacttttctctatgccacgcaatacgagcgggggcgtgcgcagatcggacgacgtcagatggtgcctggtcctgaaacgagtcaggcgctacccgacaatggtgcggtcgatatggccacaggagaagtcggcacatatcgcaggcttgtcgtactcgaccatctcggagtggcgagaacggtcgacggatcgttggatggtgcatggacgattgctgattcccaagttacgtcgttatctgtgcaatagtgaaaaagttgtaattccgccattgttatcgtttcgttattgacttgttatcgaaacgttattgctatggattgagaccttggattgttcgaacgatactgaaaacactgatggcaaggaagcccatcaatagaaatactcgaggaggagttttcatgaagaattggaagaaagctattgcgatttgtgcttcggcggcagctatggccagcatggcggcctgcggtggcggcagctccaatggcgattccagctccagcaagagcgataagaagaccatcggtttcgtggcagtcggtccggaaggcggcttccgtacggccaacgagaacgatctgaagaaggcattcgaggatgccggattcgatctggtgtactccccgacgcagaacaacgatcagcagaagcagattcaggcattcaacaagttcgtcaacgacgaagtcgacgcgatcgtgctatccgcaaccaacgattccggttgggatgactgcttggagaacgcggcggaagctgaaatcccggtcttcaccgtcgaccgcaacatcgatatcaagagcgatgcggcaaagaaggcagtcgtctcgcacatcggcccgtccaatgtctgggccggcgagcaggccgctgaattcgtcaacaagagcttcccagatggcgccaacggcttcattctggaaggaccggcaggcctgtccgtggtgaccgatcgtggcaccggttgggataacaaggcagcaagcaatatcaaggtgcttgagtcccagtccgccaactggtccaccgatgaggcaaagaccgtgacagcaggtctgctcgacaagtacaagtccgacaatccgcagttcatcttcgcccagaacgatgagatgggtctcggcgcggcacaggccgttgatgccgctggtctgaagggcaaggtcaagatcatcaccatcgatggcaccaaggccgctctgcagtctctggtcgacggcgatctttcctacgtcatcgagtacaacccgatcttcggtaaggaaaccgccaacgccgtcaaggattatctggatggcaagtctgttgaatccgatatcgagatcgaatccaagaccttcgatgcagacagcgccaaggaagccctggatgccggtacccgtgcgtactgatccgatcagataactttccgaatagcatctctccttttcacatagcccaagaacggtgcaccgcatagcgcgatgcaccgttcgttccatcttgggcaaatatcacaaaacgataacaattttcgtaaggcgaagacatggtagataagcaaccaatcgtcgtgatgaaaggtatcacgatcgagttcccgggcgtcaaggccctggacggcgtcgacctgcgtctgtatccaggtgaagtccacgctctcatgggcgagaacggcgctggaaaatcgacgatgatcaaagcgcttaccggcgtgtacaggatcaacgcggggtccattgaagtggaaggcaagccgcaaaccttcaccggtaccggtgatgcgcagaacgcgggcatcgccaccgtgtatcaggaagttaacctgtgcaccaatctcagcatcggcgaaaacgtcatgcttggtcatgaggtgcgagggacgctgggcatcaactggaagaaaacctatgaggaatcgaagaaattcctcgcccagatgggtctggatcatcttgatccgagagcaccgttgagctccatttccatcgccatgcagcagctggtcgccatcgcccgagccatggtgatcgatgccaaggtgctgattcttgacgaaccgacgtcatcgcttgacgccaacgaagtgcaggatctgttcaagatcatgcgcaagattcgtgattcgggtgtggcgatcctgttcgtgtcccacttccttgaccagatttacgagatcaccgatcgcctgaccgtgctccgcaacggtaagttcatcaaagaagtcatgaccaaggacactccgcgtgacgagctcatcggcatgatgatcggcaagagcgcggacgagctgagccagatcggcgccaagaaggcgcatcgtgacgtgactgaaggtgaacagcccatcgtctccgtcaagcagcttggtctgaaaggcaccatcaatcctacggacctagatatctacccaggccaggttgtcggcttcgcaggcctgttgggatccggacgaaccgaactcggccgactgctgtacggtgcggacaagccggattccggtacgtacgagctcaaaggcaagaagaccagtatctccgatccgtacacggcattgcgcaacaagatcgcatactccacggagaaccgtcgagacgaaggcattattggcgatctgacggtccgcgagaacattctgatcgccttgcaggcgacgagaggcatgttcaagccgattccgaagaaggaagccgacgagatcgtcgacaagtacatgaaggagctgaacgttcgtccgaacgatccgaacaagctcatcaagaacctgtccggcggcaaccagcagaaggtgctgatcgcacgttggctggccacgcatcccgacctgctcattctggacgagccgacgcgaggcatcgatatcggcgccaaggcggaaatccagcaggtggtgcttgatcttgccgctcagggcatgggtgtggtgttcatctcgtccgaaatggaagaggtggtcaggctttctgacgacatcgaagtgctgaaggatcgccacaagatcgccgaactcgtcaatgacaacacggtttcccaggaaaccatcgtccaaaccatcgcgaacacgaacgtcaatacaggaaaggaggcatgatgagcgacaagaaaacaaagcaggacggcgattccctcgtcaagaagctgctgtcgtcaaacctcacatggtctgtggtcgcactgattgtgctgatcgtcatctgcaccatctccgatcaccaattcctctcgttgagctggaataagaacaccggaggtctttcgggaccgctgatcaccatgctgcaggaatcggcgcgttatctcatgatcgccaccggcatgacattggtgatctccactgcaggcatcgacctttccgtaggttccgttatggcggttgccggtgcggcggccatgcagatgctgacttccggcgttaacgtgtggctggcgattttcctcgcactgctcatcggcctcggtgtcggctgcatcaacggcgcattggtttccattctgggactgcagccgttcatcaccacgctgatcatgatgctcgcaggtcgaggattggccaaggtcatcacttccggccagaacactgatgccagctccgttgcaggcggcgcgccgctgaaatggatggccaacggcttcattctgggcattcccgccaatttcgtcatcgcattggtcattgtcgcgctgattggcctgctgtgccgcaaaacggccatgggcatgatggtcgaatccgtcggcatcaatccggaagcctcccgcatgaccggcatcaagccgaagaagatcctcttcctcgtatacgcgatttccggtcttctggcagccgtggcaggcctgttcgccaccgcatccgtgatgcgcgtcgacgtggtcaagaccgggcaggatcttgaaatgtatgccatcctcgcagtcgttatcggcggaacctcgctgcttggcggcaagttctccctggctggcagcgcgcttggcgcggtgatcatcgccatgatccgcaagaccatcatcaccctcggtatcgattccgccgcaacaccggcattcttcgccgtcgtggtgatcgtgatctgcgtgatgcaggctccgaagattcataaccttggcgcggaaataaaacgtaagtgcgcgctgaagacgcaaactaaggcggtggcagcatgacttctgcaacagctactcaggtcaagaagaccgtgaaaccgactcggcgtcgtcttgacgctcagatgattccaaccatcgcagcagtggtgatcttcattctgatgatcatcatgggtcaggcgctgttcggcacctacctgcgtcttggattcgtgtcgtccctgttcatcgaccatgcctacctgattattctggccgtggctatgacgcttccggtattgaccggcggcatcgatctgtcggttggcgccatcgtcgccatcaccgcggtcgtcggtgtgaaactcaccaacgcaggcgtcgcggctccgctcgccatggtcgtcatgattctcatcggcgtggcgttcggcctattgaccggcaccctgatcgaagaattcaacatgcagccgttcatcgcgtcgctggcttcgatgttcctggcgcgaggcatcgcatccatcatttcgaccaaggcgcagaccttccccgaaaataacaacttcgatttcatttcgcagaagatcaccatcatcgacaatccgaagatctcccaagatctgtacatcaatgtcggtgtgatcattgcggcgctcgtggttatcttcgggtacatcctgctgcaccatacacgcaccggacgcaccatctacgccatcggcggctcgcgctcctccgcggaactcatgggcttgccggtcaagcgcacgcagtacgtcatctacctgacctccgccacactggcctccatcgcctccatcgtgtacacggccaacatccgctcttccatcaacacggtcggtgtcggctgggaacttgatgctgtggcctccgtggtcatcggcggcaccatcgtcaccggcggcttcggctacgtgctcggttccgtcatcggcgctctggtccgttccaccatcgacccgctgacctccgacttcggcgtgccggccgaatggaccaccatcgtggtcggcctgatgatcctgatcttcgtggtgctgcagcgtgcggtcaccgccttcaacaagaaagaataggaggaacggctccagttcataccatttgtttctgattccctttgcgtaaggctggacgtgccgaaatggtacgtccagccttacgcatgccgttcccatctaggtcagggcttccattacactacacagtggttttcatacgaatgaatcatagacggcatcgcacagggccgtaggaaaaagtgcgcggataaggaattatggaagaacggaacattactacaacaactgcagccactgaatcgcaggcgattacgacaaacgccggaactcaggaagcggcgatttcagacgaacgcatccccggcaaactcatcggagcgattgtggcggtcggctccctcgccttcatcggcattctcaccgaaaccgtgatgacggtgcttttcccgcaactcatgcgggaattcaacgtcgacaccgcaaccgtgcagtggatcaccaccatctacctgctggtggtcgcggccaccatgccgttgtcgtcgtatcttaaccgtcggttcaagcaccgcacgttgttccttgccgcggtggcgcttgccgtgctcggctcgctcattatgattgtcggtcatgcgttcccggtcattctcattgcccgtgtgattcaaggcatgggttccggtgtggccacgccgttgatgatcaacatcattcttgaacagtcgccaaagagcaaagtcggtcgtttgatgggcgtcggttcgctggtcatcaccgtcgctccggcaattggtccgaccgttggtggcgcggtgtcgagcattctgccatggcgtgcgattttcgtgattgtcattccgatcattctgctggtctcgttgccggtcggtttaaaatgcgtcgaacagcatcgcccgacggaagaggcgcgtctcaattcgttgcagttcgtgtcgattgtgcttgcattgtgcggattggtgatgttcctaaaccaagctggagtggccgtcagcgccgcggtttccggcggcagcgccacggtttccggcggcagcgccacggtgtcggcagtgttcgccgtggtgagtctgatcgttggattgggggcattgctgtttttcggctggtcgtcgaagcgttcgttctcgccgctgatccgtttgggctggctgcgtgacccgatggtgttgttacatttgatcgcctacatgctgctgccgatcgtcggcatcggtttcggttatgtgatcaccaatgtggcgcagctttcgttgggaaccagcgcgttcctgtccggcgcgttggtgctgccgggtgcgctgatcggcgcgtttttcgcaccggtgggaggtatgctgtacgaccgtttcggaccggtgcgtccgattctcggcgcgtttttcgccgcgatttgtgggccgattctgctgctggtattttccatgcgactgacacccgtcacgcttgccggtttctacttcattttcggatttggttattcgcttggtttttccaatatcatgaccaatgcgttgcgtaacatcgcacctcagttcatgccggacggcaatgccgtgttcaacacctgcctgcagttcggcggcgcggcaggcaccgcgctgttctccacgattctgtcggtggctcaggctggcgcaggcgaagaggggggtgccacgttccgtcacgctacggctgtcggtggcagctggacgttcgctaccatgattggtatcgtggccattgccatctgttgcttgattgcggcgttccgtattggtgcgaaacgtaatagcaggctatagaaaaagcctgtagcgtaaagtgaggaaagcgttccgtcaaggaatatcggcttgctatgctgtctctaccgtgttattgagaggacagcaatgagactacagcacccgtatagcggcatcactaccggtctgctcaagccgattacggcggcgctttccatagttgcgctgcttgcgggctgtggatccgtggaggcgaaggattcccagcaggaagtcaccagtgccgataaggtggtcagcgtcaatatcacggaaccatcgaatggcttgttgccaagtgacaccagcgatatggccggttggaaaatcgtcagccagctgtatgacggcctggtcactttcgatgcggaaggtaatgagacgttggtcgaggccgaatcgatcacgccgaatgacgacgcttccgaatacaccatcgcacttaaaccgaatctggcgttctccaatggtgagaagatcaccgccgacacgtacgcgaaaagctggtcattcgcggccaatgctgccaatggacaggtcggagcctccattttcgaagatattcagggctatgatgagctgcaggatgcaagtggttccaaaaccgcgcaattgtcaggccttaccgtggtcgacgacactacgctgaaggtcaagctcaaagcgtcgaattcggcgttcctgtacaaaatcggagatatcgcgtttctgccgatgccatccgaagtcatcaagaatcccaaggaatacgggcaaaagccgattggcaacggtccgtacaagctgaaggcgtacaaaagcggcgaagaaatcattcttgagaaagacgactcctacaaggggccgcgcgaagtcaagaacgcaggcatcgatttcaaggtgtatcaaagtcttgacgcagcctattcggatctgctggcagacaacctcgacgtgcttgatgccattccgacttccgcgttgaaaacctatcagaacgaaaagaacatcaccgccgtcagcaagcccggtccgtcgttctcagcatttacgatttcgcagaatctcaagcatttccaaggtgaggaaggcaagtatcggcgtcaagccatcgcgcatgccattgaccgtgagaatatcgccaatgcgattttcggtggcacggtaacgcccgccaccgatttccttgcgccggtgatcaagggatatgacaccgatctcgacacggatggcgtgctcgcatatgatgagacgaaagccgaggaattgtgggcgaaggcggatgcgatttcgccatggagcggaacgttccgcatcgcatacagcgccgatggcaccgataaggagtgggtggaggctgcggccaattccattcgcaacgcgcttggcatcgatgcggaaagctatccgttcgccacgtccaaggaactgcgcagcgccattcaggagcgcaccatcgacgcggcattcaaatcgggcatgcaatccgattatccgcatccggaaggctatctggtgcaggcatacgactcatcggcagcggacggcaagggtttgaacaacggtgattacaagagcgacgaatttgatgcgctgattgaccaggctgctgcggagaccgatttggacaaggccgtgagcctgtatcggcagagcgaacgtgtgttgctgaaggatttgccggtgattcctttgtggtataccaacgtgaccgcggcatcggccaaaaacgtggaagtgagctacaactatatgggcgttcccgaatacaacaccatcgtcaagtaaggtttgttctagcgtgaagactccactgtgagcgcaatttcaccacccgtcgcttcgaagcggtaggctgtgaaactatagagaacataggaaaaggagacaaggtgagcaacctcagtgcacccctgcccgtcatggccggcgaagatatgccggccggacccgccgatccgattttcaaccgtctgctgaaagaccgcatcatttggatgggcgaggaagtcaaggacgaaatggccaatcgcatctgcgcacagatgctgatgctggcagctgaagatccgaagaaggatatttggctgtacatcaattccccgggtggttccatcaccgcaggcatggccatttacgacaccatgcagcttatcgagcctgacgtggcgaccgtcggcttgggcatgtgcgcatccatgggccagttcctgctgagctccggcaccaagggcaagcgattcctgacctcgcatgcccgtgtgctgatgcaccagccgtccggcggcatcggcggcaccgccaccgacgtgcgcatcaacgctgaactgatcatggacatgaagaagaccatgagcgagctgactgccgaacagaccggccataccgttgaggaaatctaccgcgacaacgagtacgaccactggttcaccgcgcaggaagcgctggaatacggttttgtggataagctcgtttccacgcacgacacgatgaacgccaccaagggagagtgaacatggcaagcgaagaatcccgattcgtagcccgcgcagagcgtctcgcaggaccgaccggagtggttggtttccaggctgcagcagcccgcgaagccgctttcgcgccgcagaaccgttatgttctgccgcagttcgaagagaagaccccgtacggtttcaaaaggcaggatccgtacacccgcttgttcgaagaccgcatcatcttcatgggcgtgcaggtcgacgacacttccgccgatgacattatggctcagctcctggtgctcgaaagccaggatccgaaccgtgatgtgatgatgtacatcaactctccgggcggttccatgacggctatgaccgccatctacgacaccatgcagtacatcaagccggatgtgcagaccgtatgccttggacaggccgcttccgcagccgccattctgctggccgccggagccaagggcaagcgtctgatgctgccgaacgcgcgcgtgctcatccatcagccggccatcgatcagggcttcggcaaggcgacggaaatcgaaatccaagccaaggaaatgctgcgtatgcgtgaatggcttgagaacacgctggccaagcataccggtcgcgatgtggagaagattcgcaaagacatcgaggtcgacaccttcctgaccgcacctgaggccaaggaatacggcattgtcgacgaagtgctggaacaccgtagctgaacggcgcatatgcgaggttccatctgaagtcgcatcttcacaaatcaatacccctgccgggcgttggcaggggtatgctgttcttcaatgatgattgcatgatggcgattgctcaatggcaggtacggcaaacaaaggggtgcgaatgggacgagtggtcagctacaacgatgaagtgtcacgatgcacgttctgcggcaaaaccgaaaatcaggtacgtaagctcgttaccggatcaggtgcggccatttgcgacgaatgcatcgaactgtgcgtcgacatcatttccgaagaacgtgtcaaagacgcccagctgaacacattgcagctgccgaaacccgcacagatcagcgcctatctcgacaactacgtggtcgggcaggaatccgctaaaagaacgctttccgtggccgtatacaaccattacaagcgcgtcaatatggaaatgcgcgaatccgcggcattgcgcgatcgtgcggcgcatgcgagcgacgatccactggccggcgtgcaggtgtccaaatcgaatatcctgctgctggggccgaccggcgtgggcaaaacgtatcttgcgcagacgctggcgaaggtcatgaatgtgccgttcgtcatcgccgacgccaccacactcactgaagcggggtatgtgggcgacgatgtggaaaccgtactgcaacggcttatacaggccgctgacggcgatgtggcgcgagcgcagcagggcatcgtctatattgacgaaatcgacaagatagcgcgtaagagcggcgagaacacgtctattacgcgagatgtgtccggtgagggcgtgcagcaggctctgctgaagattttggaaggtactgtggcatccgtgccggtggagggttcgcgtaagcatcgtgagatggagacggtgcagatcgacactcgtgacattctgtttatctgcggcggcgcgtttgtcgggcttgccgatattgtggcgcagcgtttgggcgctcgtgaaagcggatttggtgccgcgtggcatgatcatgaggtgccgaatcgtgagctgcttgcccaggcttcggccgacgatcttgccgatttcggtttattgcctgaattcatcggtagattgccggtggtgagcgtgcttgaggagcttacggaggatgatttggcgcgcattctggtcgcaccggagaacgcactggtcaagcagtatcagaagttgtttgcgattgacggggtgacgttgacgttcactgagggggcggtgcggcagatcgcggccacttcgattcgcaggggcacgggcgcccgaggccttcgatcgattatcgaaaaaaccttggaggacacgatgttccagctaccaagcgtgactggcgtatcggaggtggtggtggatgaggcgtccgtcaatggttccggcactccgaaactattgaaggtttccacggaggagattcctcgcagacgtgccgcgtagtgcattcggcgtgttgcgcgtcgtatgtgcgagagttcagatttcgtagggttgaagcaagtatggatgccggtgcgaaatccacgaaaacaggcgcgacacgccgagattttgctgcgcggccatttgggtgtatcttattcgagttgccgaaaacaagcaacgttgcgcgagtagcccagcggattagagcagctgactacggatcagcaggtcgcaggttcgaatcctgtctcgcgcaccggccaccggtcatcaggtggcgtaaataaatgagatggcgttgcgcgagtagcccagcggattagagcagctgactacggatcagcaggtcgcaggttcgaatcctgtctcgcgcacatgaacctccttcgcgaaatgcggaggaggctttctttttttctggaagtaacggcggcgctgccgtgaatagtgttcgagtcaatgcgattcgcaaacctaccagaatgcttatgtaaagcggctgttgtcgagatacgttcggtttctctccgagcgaacggtgtggtacaagaaaagccgccatgccgaataaaaccgtaaacaccagtgaaaaagacggtttgaaaacataaacgccgacacctctcggtacactggaaccgctattgaagcgtctgcgcatgccaataccgcagacgcttttcttaagtgaatggcgggccgtggatactcgcggcaacagacgggagagcaatgaccgaacgtaagcagggactctgggcgaaaatacgatacatagccgcttccgaccgcatatctggtctgattatgcttggcttcgccctcgcaggtctgttgcttgccaatctgccgttcacggcgcatgcgttcgaagagttggagaatttccgcatcgccattccctacaccaatatcgatatgggattgggacactgggtgcaggatggtctgctgacggtgttcttcctgactgtcggactggaattgaaacaggaactcgccacaggttcgctgtcgaaccccaaggctgctgcagtgccgatgctgtgcgctgtgggcggtatgatggctcctccggtgttgttcctgctggtattgttcctgttctccggtttcggatccgatccgttggccatcgcttcgggaacgagtttcacctttggtgagatgtctcatggttgggcggttcctacggccactgatatcgcgttctctttggctgtgcttgctttgttcgccaaagcgctgccgggctctattcgcgcgttcctgatgacgcttgccacagtggacgatctgctggccattattctgatcgcggtgttcttctcttcggtgaacgcatggtactggttcgtcggcatcgccgtatgcgctgtcgtatggtatttcctggtgcgtatgcgcaaagtgccatggcttgccgtggccattgtcggcattctggcttgggtgatgatgttcgaagctggtgtgcatcctactttggctggcgtgcttgttggattgctcacgccggctcatgagcgtttcggagagaaaaccccacgcgccgaacgctatgcggacaagctgcagccgttttccgcgttgctggctctgccgattttcgccttgttcgccactggtgtgcattttgaatcgttgacgttggccctgttcatttcgccggtcgtcgttgccgttatggtggctctggtggtcggcaagccgttgggcattatgatcacggcatggctttccacgcatgtggccggattgaaaatggctaagggattgcgtgtgcgcgacatgttccccgcggcctgcgcatgtggcatcggctttaccgtatctttcctgatttcctcgcttgcatatcaggatgccgaactgtctgctgaagcacgtttcggtgtgttggtcggttccatagtcgcggcggtgatttccggcattctgctgagccgccaatccaagaagtttgagcttgccgctgccgcatcctcgaagcataagcatcatactgctgacgaggatgctgctggggaagtggaatctgttctcgaagacggcaccgttgtggtcagccagatgatcgacacacatccaaaggtcaaataacgacgttccggcgtatggcattccgcgccatacgccagacacaacaaaagccgacactcatcacttatccgtgagtgtcggctttttgtatgaggaaacggtaggccgctgggaacggccatactagcgtttgactgctacgagcaggcccgtaccggtcggggtgagggcagtgacgaaacgctcatcggattccacggtttccagcaaaccacgcatggcaatggatttggcgtcacgattggcgggattcaaaacgccgcctgcggacgtggctgaatcaaaagcaagaatatcggtgaacacgattacgccatgcttcttcaacaggcggggagcctgctcgaaggaagcgccgtaattttccgcgtcgccggcaactacaatcaaatcgtagttttctgcattcagacgtggcaaaaacacgtcgacgggagcgttgacggcgcgaagcgtggtctgtgtctcgtcggaaagccgattaaacaacgtacgaatcagcgcaatgccctgggaagaggaatcaaccgccgtaagctgaccggaattatccaaaccgttgaccagctgcaacgtttccaccacggaaccggtgccgacggcgatcaccgatgtcgcattcaccatatgcacgagcatgcgcaacagctcggcttgggctgctgaaccctgcggaatgcctgcttcttcagcatgggtgcgaatagcattcaagtcggttgactggcgggagaacgcatggtcctcaacgtattcccatgacttggcgagattggtatatgacgttctatccatgggttcagcgttccttgacttgggcgatcagctgccagatttcctcgccgacgtcaatgccacgcgggcattcgcgggtacatgcgcggaccgactggcatgcggcgatgccatcggcggaatcaatggcatccatgcgtgcgttcgcctgaccgtcgcgggaatcgttgatgaaacgagacgccgcgataagggctgcaggtccgatgaacgcttcgccgcccgcatacacagggcagctgccttcgcaagtgccacaggcgatgcagttgctgagaagctcatacttggcaagctgctggggattctgcagatattcgaaagcgttgatcttgccgtccgcagtggtggcgagttctccacgcgcctgcagatagggcttgagttttctgatttggttgagcatctgatcgatatcggcaatcaaatcgcgctgcaccgggaaacccggcaggggagcgagctcgatgacgccaagatcccctgcgccgaccgcattttcctgaatgtcggaaacatctccggtgtgtcggaatccttcatcgtcgaccaatgtcggattcgacggtttggcccaatccttgacggacgcggtgcacagcagggtgggggtgccgttgatggacaccgcatcggaaccgcacatgccatgtccgcacgaatagcggaatgccagcgtcggatcgatggtgcgtttgatcttcaacaggcaatcaagcaccgtgtcttccggacgcacgttcaacgtgtaatcctgcaaccactgcttgccgcgcgggcggcggcgcgccgacgtgccggaatccccaaacggagagctttttctggcgaacggagagccgccacgttcgcggtcgcgggcacgctcggcgcgcggggcaaacctattcacccgcaatgtcaccgtattcacgccgttttccataccgctcatgtacccgcctttccaataaaaccgtcaactagtctgccatacgccgtgcccagcggaatcagtattcgcgggcttttggcggcatattcacaatgtgcaccggctgccaggaaatctggccggaggcattcaccatggaatgggccaggaaatgctcatcgtcgcgttccggaaaatcaagacgcttcagcgagccacgggattcgtgacgcgcatcggatgaggtgagtacggccttgccgagttccagaaggtggcggacctcccaaatggcggtgatctcctggttgaacgtgggggagtcggaatgcgcgtgcagggcttcggcacggggcgcaaactcatcatgcaatgccgttagcgcctgttcgataccctgctcgtcgcaacgcacggcgacagcgcgttccatgacggtacccagatcggccatcagctggtaaggattgtcggctgcatgctcctcgtcttccggaagctgcaccagcagatccttgagttcgttggaacgggtgtcagcggcctgctggaccgcatccgaaccattgtcggcgtcggattcagccatgggatcgttcactggagcgctggaaatgcgttccgccagcgccttgccggagcgggtgccgaacaggcatgcatccagcagggaattgccgccgagacggtttgcgccgtgcacggacacgcatgcgcattcgccggcagcgaacaggccttcgacgacatttcgttcgtcgttctgccaacggtagacttcgccgtcggtggtgatcggaatgccacccatggtgtaatgcgcggtaggcttaaccggcacgaaatcgtgtgtcggatcaagatccgcatatttttcgatggtttccaccacctgcggcagtacctcatgcatatggtcggcatcaataccggtcatatcaagccacacgcaatcctttggcccttcggggtccttcggatccgccacgccgtggccggcatcgatttcagccataatggaacggctcaccacatctcgtgcagccaaatcggcatggccgggagcatacttttccatgaatgcctcgccatcggcattgcgaagcacgccgccttccgctcgtgccgcttcagacagcagaatgccggtatgcgccagaccagtcgggtggaattgcacgaattcgctgtcttcaagctgcagtcccgcttgcagtgcgagagccatgccgtcgccggtcagatcccatgaattggaggtggtgtggaataggcggcctgcgcctccggtggccagaagcacgttgcgtgcgtggatggcgtgcgtttggcccttatgcgtgtcaaatgccactacgccttcgactttggatccgtcttcggtgattaccagatcggtcacgtaccattcctcggcgaattccacgccttcggccacgcattgctgccacaaggagaagaggatctgatgaccgatgcggtcggccgcataggcggcgcggcgaaccggttccttgccgaaatccttggtatgtccgccaaaacgtcgttgtgcgatatggccgtcctcagtacgggagaacgccacaccgtcatgttccagatcgattacggtttccgacgcctctttggcgagcagttcggccgcgtcctggtcgacgagccaatcgccgcctttgaccgtgtcgaagtagtgccagtgccagtcgtctttttcgacgttgccgaggctggccgcaatgccgccttccgcggaaccggtgtgcgagcgcaacggctggagtttggagatcaccaggatgttcggctcgatgccggcttccttcagggcttgcatttgttcgcttcgcagcattcccaatgctgcggacaggcctgccgcgcctgcgccgacgattactgcatcatacatatcttcaacatgcttcggactcatagcaacgattttcgcacaaggtgtgacctcattgcggtttgccggttggcgggtttgccgctgcatgcgtggttatgcgtgtctgatgcgtatgttttcgatggattccgttgatctgtgcaggcttggcggtggcgttgttgggcgtgatgtcatgtggcgcttgcgtcggtgatggtgatgttgccatgctgtgtgcagataagtccgttgagttccattaatcccagctccatgctgattcgtgagattgagtattctccgggattgctttcggccaggatggcgagtagaccgtcagtggagacgtggccgtatttcgcgctgcatgttcgtatggctttgagtatggctgcagtggcgttggttggttgcgacagactggtgtcggttgactcttccgacggttcgtcgtcgttgtctgccgcgtcggctgattgcgggcgatgcgctgcgtggcagaattcgtcgatatcggtcagcgagcagatgatggaggcttggccttcttgtatgagtcggttgcatcctgtgttgtgaggcatggttacatctcctggcacggcgaatacacggcggttgagttcgttggcccatcctgcggtgttaagcgcgccggagcgtgcgcgtgcctgggctacgatgagggtggatgatagcgccgctatcaggcggttcctgataaggaatcgtctggcttccggaacggttccggggcagagttccgagatgagcgcgccggaatggttgatgatggtttcgaagaggcgctcgttgcttttcggaccgatatagttgagtcctccggcgaataccgcgacggtgcgtcctgcgaggggcgttccgatctcgtccatggcttggatggctccccagtgggcggccgcatcggtgcccagagcgcctcctgacactatgagatggcctgctcgggccgcttgtttggcgagctcgtgtgcgctttgccttccgtactcgcttacgccgcgtgatccgacgacaccgaccggttcggagcatgacaccaacgcttgggggtcacctttcccccataggcataatggcgcggcccagtccgtgtgtatggtgaggtcggcaagctgcgaaggccagtaggggtgatgcggcgcgacgatccactgcgtgccgtttgcggtgaaccacgttttgagctcctcggggtcggtgctgggcaatgtggtcaggcgatgctgccacgagaccattgcgccgtggaaggaggccatacctcgagcattgatggtgcgtccccaacgtgtaatgccgttgatgagcgccgcgtccaaggttttataggctgccgtggccacgctttcatgattgcccggaccgctgtcggcaagcagttgcaaggtatgcgtggctgatccgatgcctttgaccagcgcgtacatcatcgcatcggcgctgtccagacaataggtgagcaccgcgcgtgacagggtctcatcgtcgatggcggttgcgttgacgctcgtatcggcggttgtgttctcgttcatgtcaacctcgttctcatggagattccttgcatcatctcttccggtccgggagaggttttgcctgacaggtcggatagcgtccatgcgagtcgcatggctcggtccgcccctctgaggctgagccgttcgctggccaacgcatggttcacgagctcgatggcttttgtggacgtgttggcgcgaagccatgttccggtggcttgcgcattgcagacccatccgaattcccggaaacgttcctgtgccgtttgccttgccaccatgacccgcaggcggatggcgtggctggattcgccggaaggaaccgtgcctgggttgatgcgttccacaggaggcacttcgatctgaatgtcgatgcggtcgaggatcggccccgacaggcggctgaagtacttgatacggtctttttccctgcacgtgcagcgctcgccgttgccgtatgcgtagccgcaggggcaaggattggccgccatgatcagttggaatcgtgccggatagtaggtggtacctttcgcgcgggatatcgccacatacccggattccaatggttcgcgcaaggtttgcagggtgcgtgccgagaattcgggcgcctcgtccatgaataggatgccccgatgcgcccgcgtgatcgcgcctggttgagccaatcccgcgccgccgccgaccaaggatgcggtggatgcggtatggtgcggcgcttcgaatggcggaacatcgctgatgccatagctgggcaatgtgccgcatagggagcggatcgatgcgacttccagttgttccgattcgctgagcggactcataatgccgggaatgcgcgaggcgagcatggtttttccggtgccgggaggaccggtcatcatcagatgatggccgccggcagccgccacttccaacgcccatttggccgtttcctgccccatgacttcgttcatatctccgggaggaggacataccgacatggcgccgtcgttggcatccacgtctcggatcatatcgggtatcgtatagttcgcggtgcctcccatcagttcgatcagttcgccgacgtgacgtattccaatggcgtcgacgtcgggcacaagggccgcctcgtccaaattggcatgcggtacgatcaccttgcatacgccttgatcgcgtgcatgcagcagaatcggcagcagaccgttgatgggcagtaccgtgccatcgagattcacctctccgagcacgacggtgtcgttcaagcagtcatgcggtatcgttccggatgcgctaagcacgctcgctgcgatcgccagatcgtgtgaggatccgcgtttgggcatggacgccggcgaaagattgaccgtaacccgtgtctccggccatttggcaccgctggcctgacatgcggatttgacacgttccctcgcttcggagagcgaggtgtcgggaagtccgatgatggaaaagtaggggagtcccggagatacgaacgcctggatttggatgatgaaggctttcaggccgatgagacccacggaaagcgcgctgccgatagccatcagaacgctccttcgatatggtggacaagcggtttgccatcacggacgatgacggtgacgacgtcgaagcgcacgccgttatgcggcgtgcgatggtcgctgtccgacagccattgcacggccgcgtggcgcaggttgatctgcttggatgacgtcacggcttcctgcggagtgccatagcggagcgtccgcctggttttgacttcgacgaagacgatgattcccgtatcgtcgcgtgaaacgatatcgagttcgccatatcggcagtgccagttgcggtcgagcgtctgccagccttggccttccagccatgcggccgcatactgttcgccgagttcgccgacctgtcgtgcgcacagtgtgccatcatgcagtcgccgtgcgatggaatcaagaagctgttccgagcgctgcgttgcgttcggaacgttatgtgttgtgttgccgttcatgattcaagtccagcagaaaggaccggcgcgaagcaagggcgaacggcgaatgtggatagaggatgcggtttcgggcgtgtttgggatagttggtggataacttgccgttatccacattgctccacaaggcgagcggccatggagcgcccgaaaccgcatatggttggaatgttcagcggcgaaccagacgcgtcaactcgtcaaggttcagctcgaagctcacaccgcgctcagtgtggttcggctggaattgcgtgctttccatggcatggcgtacgaattcgccggcgatatgcgccgattcagccagaggtctgccggccatcaccgcaccgcataatgcggatgcgaaggcgtcgccggtgccatgtgtcatgaacggcagcttgtcgtgcgcaatctcttgcttgccggatgcgccggaagtggccgatgccacatagttgcgaatgatgccatcctgacggtcaacgcctttgagcaccacgtttttcgctcccaaggcaagcagcgcgtcaataatgccgttcacttccgcgttgtcgatgttctgccccgggtaggtgcgtcccgtcagcatggacgcttccgtcagattcggcatcagcacgtcggcgccatccaccagcgtgcccatcgcctcgcataattccggcgtgtatgtggcgtagatctcgccgccgtctcccatcaccggatccaccaaacgcaaggcgtgcgggtaatccgcatacagacgtttgataatcgcgacttgttcggcggaaccgaggaaaccggaatacacgccgtccaaatcgacgttctccttgcgccacgcatccagatagccgtccaaaatttcggtcgtatcgtggaacgtgaacacgctgtagcgcgtatgcgccgaaaacagcgccgtcggcacggggcatacgtcgcatccggccgccgacagaatcggaatggccgccgtcagcgagcacttgccgtaaccgcacatgtcgtgcaccgcggccacacgtggaatgtaccgtgggtcacggtcgaacagaatcacatcattcatgggaaccctctcttgcgattgcctgaccatgactttagccgcttgcctgacttcaccgccccatcgcctcgtacggcgagtcaccatgatgccgtttgctggcgtgtcgcaagttttttgatggctaccagagtagttttgcaaagcctggatggcaatgattgcaacggtttataaggggatataggcaagtgcgataacgtttggcttgcattgcggagcgcggccggattattgtcgctaccaacacctgaccaaccgccacacacggcaaggcgggtggtcagcaagacaagcaacgaaccacttccccacaaggagcagaaaccatggcagattccaagaactaccgcttcgaaaccctgcagcttcacgtcggccaagagcaggccgacccggcaaccgattcccgcgcggtgccgatctaccagaccaccagctacgtgttccataactttgatcacgccgaggcgcgttttggtctggccgatccgggcaacatctacggccgcctgaccaattccacccagggcgtgttcgaagaccgcatcgcagcccttgaaggtggcgccgctggtttggcagtcgcttccggcgccgccgcggtcgaatacgccgtgcgcaacatcacccagtccggcgaccacatcgtggctgccaagaacatctacggcggcaccttcaacctgctgcgccacaccctgccgcgtgacggcatcaccaccaccttcgtctccgctgagaacccgcaggagttcgaggatgccatccaggagaacaccaagctcgtctacttcgagaccttcggcaacccgaacgccgacctgccggatttcgaagccatcaccgccatcgcacacaagcatcatctgccggtgatcgtcgacaacactttcgccaccccgtacctgttccgcccgctggagcacggtgctgacgtcgtggtcgaatccgccaccaagttcatcggtggccacggcaccaccctcggcggcgtgatcgtggaaggcggcaacttcaactgggccgaagtgccgggcaagttcccgactctgaccgagccggatccgtcgtaccacggtctgaacttctacgaggctctgggcggttccgcgttcgtgacccgcatccgcgccatcctgctgcgcgacaccggcgcaaccctgtctccgttctcggccttcctgctgctgcagggcaccgaaaccctgtcgcttcgcgtcgagcgccatgtcgagaacgcgctgaaggtcatcgactacctgaagaccgttccggaagtcgaatccatctcccacccgtccatcgaaggccgcaaggacaacgagctgtacaagaagtacttcccgaacggcggcggctccatcttcaccttcgacatcaagggcggcaaggacgcggcacgcgtgttcatcgacaacctgcacctgttcagcctgttggccaacgtggccgacgccaagagcctcgtgatccacccggcctccaccacgcactctcaggagacgccggaggagcttgaggaccagggcatccaccagggcacgatccgtctgtccatcggcaccgagaacatcgaagacatcctcgacgatctcaagggcggtttcgcggctctgcgcgaatccggtctcgccaagtgaggcgtatcggatcggcggaataacgccatcctgagcaaatgaaacggtttgtggcaccgaagagaaggttggtgccacaaaccgtttcgccatattcgcggacgttgtcatcgtaatgtagcgcagatggtatagaatctgcgattgttacgaaaagtaatatctaaattctatcttttgaaagaaagaagttcagatttctttcaaaaagataaatagtggtaatgatattgcggattacgtaaagagagaagagagaggcgattatggctcaagaagtcaagaacgatatcaaaaaggcgttgcaggtcaacaccattccgctgatcgccattatgaccgcggtcaccacggtgctgaccatgctcgtgaagatcccgaccccgatccgtggctacctcaacctgtccgacaccatgatctatttcagcgcgtatgcgttcggaccatgggtgggcggcattatcggcggtcttggcccggcgttgagcgatctgatttccggttatccgcagtgggccatcttcacgttcgtcatcgatggcctgcaggccgtgctcgtgggcctgctcgtcaagaagttcaatccggcgaacatcatcatcggttcggtgatcgcaggcgtatggaaggtgttcggctatttcatcgcaggcggaatcctttccggatttggcccggcgttgggtgagatcgcgggcaactccttccagatggcggtgggtctgattgtgggcttcgcgctgttcaccgccgttcgtcaggcctatccgccgctggtacgtttgggcaacctcggtattaaggcgggggagtgatacattaatatcatgtgaaggcaggcccgtggatttgccgatgaaaggcgattccacgggttttattgtgaaatgcggttaccggctgcggaaaaaatgcgtgaaagcacggggtgagcgtcatgattacggttcgcgacttaggatggaagtacgcgccactgaccgacgggggcaagccggtggaaagtctcaagcgcgtcagcttcgacatccggtccggatccttcgtcggcatcatcggaccgaccggagcgggcaagtccacgctatgcatggcattggccggcatcattccgaacctggccgacggcaccatgagcggcgtcgtggaagttaacggcatgaatacgagcaggcactccgtctcggcactgtcggagcgcgtcggctacgtgcaacaggatccggaagcgcagctgttctgctcgagtgtcgaggatgagatcgctttcccgctggaaaaccgcggagtagccccaagcatcatcgacaagcagatcgacatcatgctcgacttagtcggcatggccggataccgcaagcgtgtgccgaccagcctgtcgggaggccagatgcagcgcgtggccatcgccgccgcgctcgcggcggaacccgatgtgcttattcttgacgaacccaccgcggccctcgaccccgaaggcaagcaggaagtgttcgacgtgctcgaccgcattcgccagacccgttccatgacggtgatcatggccgagcaggataccgaacacatcgcctactgggccgatcaggtgctcttcatggtcaacggtgaagtggtgcgcaatggagacgccagcctatttacccgggaacgtagactgttggaatcctccggcgtgcgggtgagtgacggaccatctccagtcatcaaggcgttgccggtagggaacgacgccaagccgaagcatgcgatcatcagtctggaccatgtgacgcaccgctatgggcagggcggcaatgcgtctcccgcactggacgacgtcagcttggatatcgaacagggcgccttcgtagggcttattgggcgcaacgggtcaggcaaaaccacgctcgccaagcatctgaacgggctgattcaacccacgcaaggaatcgtgaatgtggatgggctcgacgtgtcgaagcatagcgtgggcgaaatggccgcgcacgtcggattcgtattccaaaatcccgaccatcagattttctgctccagcaccaaagaggagatcgcgttcggcccgaccgcgctcggacttgacgcggccaccgtgttcaaacgtgtcgacgaaatgatgacattgttcgacctgcaccggtatgaggatgtttcgccggccacgctcggctacggcgaacgacgtgcggtggcattgtcttcggtgatcgccatgcgtacgccaatactcgtcctcgacgaacctacggcgggtctcgaccatcgtctcgcatcacgattccttggaaccgtggaaaaactcaaccggcatggcgtcaccgtcatcatgatcagccatgacatgcgtgccgtatatcggtattgcacgcacgtgctcgaattggaagacggtcatatcgtgcaatatggaccgatcgacaaatcgcaggaagcgcaacaatcgcccgcgcgacaggcgcgtcagccgtacaagtcgcgcggtccggtatcggcgacccacgtattgttgaaaatcgccaaggatgaatgcgacaaggaggaacgctgatggatgccgacctgtatgtgccaggcgacggatggttgcatcgcaccgatccgcgcgtcaaattcctcatctccatcgtcatgctggccctttgcctcgtatggcgtaactgggcgttcatcctcggcatcctcattctcgaacatgtgatgctcgccaccgaccgtgtgcccgccgaacgcattggatgggtgtggaagatcctcgccgtgctcatcgtgttcatcgtggtgctttggccggtcttcgaccagagtggaacgcacgtgctctggcagtggggatggttgcgtctcacgcaggagaacctgctcatggcggcggtgatgggtctgcgcattccagcgctcggctttgcatgtttcatcacgctgttcaccaccagccagaccaaactggttcgtggccttacctcgcttggtatgccctacaaggccgggcttaccctggcaaccgcattacggtatattcccgtgttcttttccatcttccaatccgtgtccgaagcgcagcgtgcgcgagggcttgatctgagcggcaaagtcaatgcggcaggtaaaaaacgcaacatattcgtacgtctcgtagaccggttcaaatcgtatctgccgatcatcatcgccgtattgatccgcgcctacaaaatgagccaaagcgtgggctgggccatggaatcgcgcggactcaacctgaatcggaacggtgtgaaacgcacatatcgggtcaatctcacgatgagcattgccgactggattattctcgtgattgccatcgccgccgccgcaggcagcgtgtggttgatgacatggctgtcatagggggtgcaatgacacaggatgaagggcgtaccacaatcaccgcacgtgatttgaaggtggtatcggcactgcaatgcaacggacgcatgaccatgcaggcgcttgccgataaaatcggcatttccgtatatgcggcgacggaaagctacaaacggctcaccgatgcgggcatcatgaccattgtgcccgtatgcaatccgttgagtctcggcaattacagtcaggtgcttgtgggactgcgcatcaacggcaatcgcaacgaggcgctcgccatgctcaaagccatgcctcaggtcacctatgtggtctgcacgctgggcgatgccgacatcatcgccgaagccgtggtgtattcagccgacggtatggaccatttcctgaagtacgatttgcgcgcactgcccggattgacccgtctgcaagtgttctcctgcggtcgattggtgcttgacgaccataatgtcagcgtggtcaaccgtctgctggccgaacgcggcgaaactggattcatgaccaaacgtgaggccagcgtcggcaccgatattcccgtgcatcggttggacgcgcgattcgtgcacacgttcaacgaattgcagaaagacggcagggcaagttacgccatgctgggggagcatcttggtgtgacgcacaccgcgattcgtgggcgcgtcaaaaaactggaggattccggtgtgatgcgcattatggccacggtaagccccatgcgtttaggcggattccgccaagcgtttctcggcatcggtgtgaagcctccgtatcgcctcgacgtcgaacagttgttagcgatcgacgaggtgacatatgcaatgagcggagtcggtttgaatggcgccgactacctcatcgaaatcatcgccggagatgacgaggacctgtggcgtgtggtggatgagtccatccgttcgctgccaggcgtggaccagacatggtgggcttccaccgtcagcgtggaaaaagagtcgtactggctcgaacctccgcaggatggtgtacttctcgacgattgatgaatcaatggtattaggcgcctcgtctttgctcattctcaaggatgagatgataattcagaccaacgcatgatattcgaatcagctgtttttccgtaattttggaggtaatccaaagaaaggaatgacagcatggatatcagggacaccatcaaagctaccaatacggccattgcaaccgtggatcttgtgaaggactacggttccggaaataacacggtgcatgcgttgcgtggcgtcaacgtcgcttttgaaaaaggaaaattcacggcgattatgggaccttccggttccggcaaatccacgttgatgcacacgttggcaggactggattgtgcaaccggcgggcacatcatattcaatggcgacgatctgacgcgcatgaacgacaaccagcttacgttgctgcgccgccgcgacatcggattcatcttccaaagcttcaacctgctgccgatgttcaccgccgaacagaacattctcatgccattgaccttggctggagcgaaacccgaccgacagtggttgcgtctgctggtggaaacgcttggccttaaggaacgtctcaaccatcgtccgaacgaactatcgggaggccagcagcagcgtgtggccatcgcacgagcattgatcaccaaaccgaaactggtgttcgcagacgagcccaccggcaatcttgattccgtatcaagcgccgaagtgctgagcttcctgaaacgttccgtcaacgaacttggccaaaccatcatcatggtcacgcatgatgcggtcgccgcgtcttacgccgaccgtgcgctcgtgttcgccgacggccagatcgtggcggacgtaaacaagccgacagcagaccagatgagtgaactgctgatgaaggaacgtgaggccgccacaatgaatgtggcttccgcgagacattcccgctaaacgcactatagaagcattcgaagaagggaacagaatccaccatgtggtccatcactttgaaactcatgcgaaaaaccaagcgcatgctcatacccgcaggcatcgccatcatgatcggcacggcgttcatcgccagcaccttcctgttcggcaatgccatgaacgactccctgacacggcagctgaccgccatgttcggaaacgccaactatgcggtgaccgtcaacagctccgacctgagcgataaggaactcaacgaggcgtattccagcactgtcggcgactttcatctcgaccagatcgccggcatcgaaggggttggcggcgtccgtgcctcggtggaaaccggcgtcagcgtttccaagggagacagcaccgtcagcggcgagatcatttccaccgcggcacagaagaacatgctccccgtgaatatcacggaaggggaccagccgaaggattccaacgaagtcgcgctgccggaagacatggcgaaacagttgaacgtcggcgttggagacactgtaagcctgacctcccgatatgcggtaggcgacgatggcaaagccaaggcggacaacgtgcgcgtggtaggactcacgtccgatccgaacggcgcctactcatactatggtggtgcgatcgtaggatccaacaatctgcttgccgcaatgcagggagtggacgatttcaacgccaccggaacaacaatggtgtatctcgaccttgccttggatggaaacagcgtatccgcaaaaaccatcaacggtgtgaaagcgttgctgccaaagcatttcgatctgatgtcacgacagcaaatcagtgacgaaagcatcaaatccttaagcggcaaccaaaccaacatcgtcaccacattccttatgtgcttcggcgtgcttgccatgttcgtggcggctctggtgatcgccaacacgttccaagtgctcgtggcgcaacgccgccgcacactcgccttgctacgcaccatcggcgcaaagaaaggccaactgtatggttccgtgctgttcgaagcggtggtgctcggcttcgtcgcatccgtgcttggcgtggtgcttggaagcctgctcatgtggggcatgtgcgtcagcgacatcatgcaggcgggtatgcggttcaacttctcctggcaagccgccgtcgtaccgattctcttcggcattgtggtgacggtgcttgcatccatgggatccgcacgttccgccaccgcggtaacgccattggaggcattgcgtccgattgaactgaccgacaaccgtcgttccagccttacgcgagccataatcggtattctgatggtggcggtcggtatcgccatggccatattctccatctggcaggtgcaggccaccaacggcggcgaggatgcgagcggcgatcaattcacgatgattctgctcatagccatcgccggtgccgcactggtgttcctcggcatggtggtcaccgcggtattctggatgccgaccctcatgaagggcgttggagcgttggcctcgctgacaggtccttccgcaacagttgcacacgccaacattcagaagaatccgcgacgcatcgcagcaaccggtgccgctctgctcatcggtgtcaccttggtctccaccatcgcaaccggtgccgctagcgccaaagagactatgaatggtgcgctcgccacccgttatagcgtcgacatcgtggccatgggcgatgacatcagccagcaaatggtcaaggatgtatctgacatcaacggcgtgtccgacacgttgtatgcgccggcggtttccgtgaccttggagaaagcggatggaacccagcctacgtccgcattgctggttggcgtgaaaaacatcgatcaggtcaagcaggtcatgcgtgccaacttgggtaacgcctccatcgacagtgatagcgtgctcatgccaacatacaatgcgcaaaccggcaaggagctgcagttcgccaatggcacggctgatttctccactgaatggaaccagaacggcgacgctacgcgttcgctgacattgcaagccaaccaagccgactaccgtcgtgtatccgcgcaatatggagctgtcggattcgtggatgaaagccatttcaccaatggtgaccttgacgccgccacccatgtgttgctggtcaaggcagacactgacaagtcgggagtttccgttgacgacatctacaacgacatgcaggccgcattggagaagagcactgatgcgacagtgaccggaccgatcgccgaacgcatcgtatgggcgaacatgattgactccatgatgatgcttctggtggggttgatcgccgtggccgtgctcatcgcacttgtcggcgtagccaacacgctgtcgctgtcagtgatcgaacgcacccgagaatccgccacactgcgtgccatcggcatgacgcgaggccagttgcgacgctccctcgcggtggaagccctgctcatctcgctggtatccggcatctcgggcgtactgcttggcacactgttcggctggctgggcgcatacgtggtgttcagcatgtacggcaaagtggtgttcccgttcgaatggggcattaacggcatcgtactcgccgtggcagccgtggcagcactgctcgccagcgtattccccgcacgcagggcagtgagcacgcctcctgttgaggcgctcgccgaagcctgagcttcatagcaaacacaacgaaaaggactcctaccacaaacatggtaggagtcctttttgcgtatcatgcatacgcaaaacaacaaaccagtcagaccaaatggttttcgtaagcgaacaccaccgcctgtacgcggtcacgtgcattgattttcgccagaatatgcgccacatgcgttttcaccgtcggcaggctgatgaaaagcttgtcggcaatctcctgattcgacaatccatgcgcgatctcaataagcacttcgcgctcgcggtcggtcaggtcatccaattccggatcggtatatgttgaatccgtagtagaagtagttgcggaattttcaggcctaccaacgttcgcagccatgaaatcgccttccatcattttctcgataagacgtttcgtggcggacggtgcgataatcgcattaccttgaaaaaccgtgcgaatcgaattcagcaatgtttccggttccgtatctttcagcagaaaaccggacgctccggcagtgatcgcagccataacatattcatccaagtcgaatgtcgtcagaatgatcactttggtatgagtgacttctgattgcgttccatcggcagcgaagcgatgccgcaacgcactgatctgccgggtcgcctcgataccatccatgccgggcatgcgcacgtccatcaacaccacgtcaggatgcagcgtttccgccaacgccacagcttccgcgccatcgcgagcctgcgccgcaaccgccatatcaggttgggagccgatcaccatggcgaaaccggcacgtaccaattcctgatcatcggcaatgaccacacgaatcttctgttcctcgctcatactctccaccttatcggcattgttccgctcacagcgcgaaacaaacccttaaatctccctgaaaaacttgaatcggctatcgagacacgcgctgcagctgctcctccaacggtgccgcgggcctcaactgcagttcgctcgcactaccggcatgagcgtcatcgctgaaaccagtctcacgaagcacgccaagcagttcgcgcatacgcttgagcgcggcgcgcccctgctcgccaatggctttgaacgctgcggaaatctcgtcggcggtaggctccttgccttgtgcttcggcgctgtccaacatatgaataccatcgacggcctggctgatcacgctgttcaacgtggcggtgacttcagcctgaatgctggcactgatacggtcacgttccatattcgccgcgagaatacgctgcttctcctgctcggccaccagtgcctcttcgcgagcctgcaataccagtgcgtttgaatcgctggaacgcgcccaacgtgcccacgccatgatgccggcgcacagcatcagcactgcaaccgtatacatgacaccggtaaagaacgctgcactactacttgacgtggctgaaaccggttttgttaagcccgcggaagcggcgatggcgccgaacaaggtagtgtatccgtgctggtcggctgcgattttcaagcccatcagagctgaacaggtgacagcggcaagaccggtccagcgccatgcgtgttcacgcccatacaatacggctgaatacagcgcacacagcgacgctacgatatgtccaacctcaatcaatcccaaaagcaccaattgcacaaccgacaatacgaacacaataagcgcgcaagtctcggggaacctgcgtcgaagagccagcgccagcaagcagcatgcggcgatcgcatgagagagctgcgcatcgcgtgaactatcaaaaaagaacgtaatcgacatgcgattcagcagcatgaccaatatcacggcgccaacggaatccatgagcacataatggtgctgcgtccacgcggaaacacgttccacccaattcagccctcgcgaattggatgtattggcaagttctacggatttcagtttcaacgatatgagcaaatcatgcagattgggtgcggtaatgcgcaagtgttgcagggcgttcgaacgatgatcgcgaccggttggtgggttggtttcctgcgtctgttccgatggttgatctgggattcgcgccgatatgttgacggctgtgtgaggtgcgattgcttcgtcggataatttcgctttgctggatatggcagttgtgttgcaagattcggactgttccgaggcatactgttcgccggtttcgtctgtcgctggctctttaccgccgtaaggcagggtggccataacttcgaagcctccgccgagttgagggccagcctgcaatgagcctccggccgattcgatgcgttccttcatgcccaacaggccgtaacctggcgtatgcccgtcgatattggccgccgcgccacgaccattgtcggtgacgctcaaagtgagcaaaccgttgttccatgactctttgatatgcacatcgacgtgcggccccgcatacttgcggatattcgtcagcgcctcctgcactacatggtaggaagctatcgaggcttgttcaccgagttgttctgggctggcggtgccggtgatattccgtcggattcgaatgtcgggggagacgtttcgcgcttgttccacaagattgccgatatcgttataatcggcgtgcggtgaacccccgaatactcccagaagacgttgcatgtcatgcagtgcgcgttccgattcgtgtcgaatcgtctccatggtgtttctagccaccgcgggatcatgcgtgcctgcatagcggccgccatcagactgcacgatgatgattgacagggtgtgcgccaccacatcgtgcatgtcacgtgcgatgcgtgctcgttccgccaacgcggcgatatcgcgttcgtcctggtctcgcgcggcgattgcctcattgcgttcccgcatcatgcgaacggttgccagacgggcacgctgccagaacgctacaatgacggtggaaatgatacatacttcgaaaatcggcgtcagcaccagcatgtattgcgccaccatgtcggcgacttccgacatggatgttcctgtgtagatggagccgagagtgacttccgtgaccattgcgccatttggatttgagccattccaactgctccacgtatgcactttgccaccggtgagcagcggcccattggtcatggtccatgccatcaacgccgaagccagaagaccgatggccaacgccaaaataatgaaggctttcgtgtttttgggattgccgtagacgatcaccgaatacagcatgaccaatgccagaatatcggcgcccaatatgcaagggccgaatatgagatgcgtcaaggccaatgccacacagagcaacgctccggtctgtggccgccatcgacgaatcagcagcgggatcagcattgccgcttcccacgccatctgtatggaaggattaaggtcaaacagcaatcccggattataggtgatgctgccggtcacgccgaacagccgaacacctataacaagcgtgaggatgagatcgcctgcgaagacatgaccatgcatccacgacaagagacgctgcttgaaattcgacatatgctccaccctagcgccagatacgctgtggcgccatcatgcgcaggaatgaaatggcggtaagataaagccgcttttgtgaggtaaggttgtctccgcgtgtgggtgggatggaagccatcaagaagccactactcgcattgaatatgccgatgacgccaaaggaaaggtgaatgcatgacgttgctgagcgaatactacgtgcccggattgcatattgaggatcgttccatcaaggtgccgttggattggacgggccacgagcccggtcatgggttcgatggcgaatcgatcagcctgttctaccgtgtggtcaccgctcccgaacatgtgcatgacgacctgccgctactcgtgttcctgcagggcggcccaggcggttccggtccacgtccgctcggcccaagttccgatggctggatcgaggaagcgatcaagcatttccgcgtggtattgccggatcaacgtggtacggggcgttcgtctcgtgtcgacacgcatgtgattgagggcatggacggcgacggcaaggccggtgccgcgtttttgaagcgtttcctcgctgattcgatcgttcgtgatttcgagcatctgcgtcgcaccgaattcgggggcgcacgttgggtcacgcttggtcaaagctatggcggattcctgacattgacgtatctttcgctgttcccgcaaggggttatcgccagcttcactacgggcggtattccgcacgttcccgccgatgcgaccgacgtgtaccgtcatacgttcccgcgcatggcggcaaagacgaagcagttctacgagcgctacccgatcgatatcgaacgtgccgctacggttgccgacatactgcgatctcgcaaggtcacattgccgaacggcgatccgcttacggtggaacgcttccaatgcttgggatccgatttcggtatgaagccaagtttcgaacgcgtgcattggattcttgatcaggcattccttgacggagacggttcggcctcgacatcgacggaactgtctgacgaattcctgtcttccgtgatggatgcgacctcgtctcgcccactgtattggccgttgcaggagttcatctacgccaacggcgagctgaaaacgccgattcgctgggccgcccagcgcgtgcgctgcgagcatccggaattcgcgggtgacattcgtccgcttaatttcaccggcgaggccatgttcccgtggatgttcgagcaggaacgtgcgttgcgtccgttcaaacctgccatggacgtgcttatggaagacacgcacttcggcacgatctacgatgccgaccagttggctcgcaacgaggttccgctgcaggccgccgtctattttgacgacatgtacgtcgattctggattgcagctcgacacgctgtctcgcgtcggtcgttcacattattggactaccaacgagtttgaacatgacggcgtgcatggttccaccgtgttcagacatctgtttaccgaggcgttgaaccgcggagatttggcggagttgttctgacgattgttcggcaacgacgagtatcgatagcaaaggaaagaaacatggccaatccaaccatcggattcatcggatacggcaatatggcacaggcgatcgccgaaggcctagtcaacgctggcgtcgtcaatggcggcgacatcgtggcctgtgccgcgcattacgacaagctggaacgcaacgccgccaaactcggcgcaaaagcggtgcgtaccgccgcgcaagtcgccgaagcagctgacatggtcgtcatcgccatcaaaccgtatcagatcgaaaccgtgatcgcaccgatcattgatcagctggcgcaagagaacaccatcgtcgtgtccattgcggcaggctgggatctgaacaaattccgcgacctgttcggaacgtctttcgaacaggcacacatccaatgcaccattccgaacacgccgatggctgtcggcaaaggcgtgctggtcacggaaatcgacaacacgctcacgcaggaacagacggaaaccttcgaaagcctgttttcgtcaatcagcctgattgaacgcgtggacaccgcacacatgggcatcggcatgtgcatcgccggctgcgcgccggccttcaccgacatgtacatcgaagcattgggcgatgccggtgtgaaatatggattgcagcgtgctaccgcgtatcgtctggctgccaaaatggtggaaggcgtgggcgcgctctatttggccaacgaaacgcatccgggtgccatgaaagacgctgtctgctctccgggaggcaccaccatcaggggtgtcgcatcgttggaggaaagcgcgttccgtggtgccgttatcaaagcagtcgacgccatcgaagcctaatactaagctagggaaccatgtctcttactatcggaatcgtcggactgccgaacgtcggcaagtccaccatgttcaacgcattgacccgcaacaacgtgctggcggaaaactatccgttcgccaccatcgaaccgaacaccggcattgtgccgttgccggatgaccgtctgccggtgctcgccaagctcgtgcatacggagaagatcgtgccggccaccgtcaccttcgtcgacatcgcaggaatcgtcaagggcgcttcggaaggcgaaggcctgggcaacaagttcctcgccaacattcgcgaagccgacgcgatctgcgaggtcgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagttggagaaggatttgcgcggtaagaagatcgaaccggcctacatggaggccgtcaagcaggcgaagaccattcttgaagccggcgaaaccattgataaggcggctcgcgaaggtcgtttcgacaaggattccgtctacgatctgcacttgatgagcgccaagccgttcatctatgtgttcaacgtggacgatgccgaactgcagaacaaagacatgcaggccaagctcgccgcatccgtggctccggctccggccattttcctcaacgcgcagtttgaagccgacctgaccgaactcgacgaggctgacgctcgcgagatgcttgcggacgccggtcttgaggagtccggattggatcagttggcgcgagtcggctacgatacgctcggcctttccaccttcctcaccgcaggcgagaaggaagttcgcgcatggcagattcataagggctatactgccccgcaggctgccggcgtgattcatacggacttcgaaaaaggcttcatcaaggccgacatcgtctcctacgacgatttcgtggctgccgaaggctccatggtcaagatcaaggaggaaggcaagctacgccaggaaggccgcgactacgtgatgcaggacggcgatatcgtcgaatttaaattcaacgtctccaaaaagtaagtgtttctctggctcccctctttgaggggagctgtcgctacaagcgactgtgaggagcggcacggataaggcctgagaagtcgtcttctcaggcctttgtcatgacattgttctgcaaggactggctgctgcagcagcataatgtgtgttttattattcggccttggtggcttgctggtcaatccaattgttgacgtcggtgaccgcctcgtcaagggttgctttggcggctttgtagtatttggaatctacaggttgacgatttccgcgccgaacggccagagcgcaagcttggtcatcttgaatgattgcaatccgaacggaataccgataatggtgatgcagttgagcacgccggctcccagatagccgagcgccatccgccagccgaccagcaccacccacaggatattgccgagaactcgcatgatttgcccctttccgattccggtcgatgcctcgcatgttcggcttcactattttgccagacagcatgacggaaacacgagacgtaacctttagctcgcccctgattcattctcggaccgctattcaggcggatcgtatgcggtaagcccaatccttttgtgaagattttgtgtattgtcgggcatacgtggttttcaccgtcgatttgaatgatgataggcttctcgatgtctgccgtatgaagacccatcaaggagatgccatgaacctgtatcgctacgcgatgttcatcgcacgcgcctgccgtgggtcgttcgtcggcaatgttctgtttgccaatccacaaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttaccccggactcatcagtgtccccgcgtcttgacacaagtatggggccggatcgtccatacatgccgttaccaacagaaggaaatgctgtgacctcacagaagaccgcggaatttgggtccgccgccagttccgtaaagcctattgattcgcacgcccgattcatcgtcgtgggcgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcaccgaatttcatgctgttgctcgtcggacgcatactgcaatccgccggctccggcgtgctgttgccattggtcgccgtagtgccgatgctcgtctatccgccggataagcgcggcactgccatgggcatggccggtatcgtcatggccgccggcccggctatcggcccggttgtcggtggtctggtgattgacagtttcggatggcgcccgatgttcattggcatcgcagttgtggcactggtcatccttgtcggaggcacgatgatgctcaagaacgtcggcgagttgaagaacccaaagctcaacatcctgtccgtgatcctttcgaccatcgcgttcggtggcctgctctatggcttctcgtctgcttccacgatgggatggaccagtccggtcgtcattatttcaatcgtcgttggtcttgtggccttcgtcgcattcgtatacaagcaagtcaagctcgatgagccattgttgcgcgttgacacccttgccacccgcaacttccgcaactccgcgattctggtcactctgattaacgccgcagtcgccgcaaccaacgtgacgttgcctatcttcatccagaatgtactcggccaatccgccaccgtcaccggcatggtcatgctgcccgccgcggcggtcggcatcatcctgagtccggtcgccggtgccgcattcgacaaattcggcccgcgcggcgtgggcatcggcggccttgcgctcatgaccatctctcttggtcttctcggcaccatcaataccaggacatcagtgctgtttgtcgccgtgttctgcgcattgcaggcatccggtcaggctatcgccaacatgccgatcaacacttggggcgtcaacgctttgccgaacgacatgatcgcccatggcaacgccatcgccaacaccggccgccagatcgcggcagccattgcgacctcgcttctggtcaccgcagaaacatccgtgaccgcctcgcacatgtctcagggtgtgaagtccgccacggccagcggcatcgcgttctcctacctgctgtgcgccgccatctcgctggtcgccctgatcatctgcatcttcaccgtcaccagccgtgccaaggagaaggccgcacgcaacgccaaggcctacgaggcgcaagcctccgccgaagtcgcggtcgaaaccactgaaggccagcccgccgagcatcactacgccggcgcatacgtggcccccgccgcctccctgttcaagcaggcccaggaacagtccatcggcggaatcatggacgatcagccctacagctgcctggacagcgatgacatcacgcatgtggtgcacgagttcatccgcctcaacgtctccagccttcccgtggtgaacggcgatggcaggctcgtcggcttcgtcagcgacggcgatgtcctgaaagcgattgccacctatgaatcccgtacggttcccaccggcaccggttcgacgatggtggtgttcgacgacgaaaccgtggcctccaaggtgcaggcgctctccggcaagaaggtgatggatatcgccacgcgtaaggtcgttgccgccacgcccgaccagcatgttggagaggtggcccgaatcctcgccaagaagcagttcaagaaactgccggtggtggatggtgatggcagactcgtcggtgtgatccgccgtaagtccgtgatggaacatgccttcgacgcgctgttcccaaaggatgatcggtgattcggcgtcatcatcgctgaatagaatgaatgaaatatgaggcttcccttctcgcggggaagcctcattgctttgtccgcggagtcttacggcacctgcgcaagggcaacgtcacgccttcatgatgcactattgaatagtgtgttcctatcgttgcatggtgacgctaacgcatggcgtcacgatactgaagcctgccatctaacggcgggtacggctcgttgctggagtcgtgcacgcatacgcgcgtcggcgtgcgtgggatgtccattcaggtttttcccatcttcggactcgtaaaataggcgaggttaacaagacgaagaacgatgacatccgtcgattcgcaaggggtggacgcatatggattatcagtatcaggccgttgaacagccttccaatccccgcaaaacctggccgattgtcttttccgtggtcgtggcgctcactgtggcatgcagcgcaggagcgtacgtctaccacaacaaacggcaggaggcgttggacacatgccggcaatcgcttgcggaattcagctcggcccgtaaggccgtgctcgacacatccgaaaacggtagcgagctgcagaaattgatccgtggtgcgctcggcgtgaacgacatcatcgacgcgttcgcggacgcggctaccagcgcagagaacacggtcgatacggaaggctgtaaggcggacgccaccatcacgcagctcaatctcatcgccaaaacactagacagcgccacggactccctgaataacagcctgaaggacatccgggagaagaacggcacgaatgcgctgcaggattcgcggaacgattcggatggcacgacaacgaacggaccatcctccaatactcagtccaatacgtcatcggggcaattgctcgacgttccttcgaacggttcttccgccacggaatcgttggatgaatcgaagaaggaactgcagcagtcgctcgacaaggcggacaaattggtcaacaagcttggcaaggacgaaacactgacgttgactggccgtaaactgctgtccgcattgtccaaagctgtggattccggtcaaaaactcattgaaaacagcaatatcaaggattccaagtactacaaggcagccaaagtcacgctcgatgaggccatcgatgtggccgagaattgggtggacagacaggcgtccaaagcgcaatgacgattctccctcgtgttgcttccatacgcatgtctaaagtttcccggaaaaacgtcgacgattatgacatcagagaatatgacgccatgacggatggaagcgtaagaggggatacgaatgacgaaatcggggtgtgggccgtcgggaaacctcgcgtttgcgaacccggtcgcccgtccatatcctaggcgatcgggttcgcaagaccgatcagaagaacagcgctgagactccggccgcaaagcacatcagcagcacagacgtgatgaaactggctaggaatgccttctgccccttcttggcgatggcgctgaaattcacgttgatgccgagcgcggccatggccatgccgagcacgatgtacgcgaaatcgaccagattcggtgcgatggcaccgatgaacggcacgaacgtgccgatgatggaagcgccgatgaaaccgagcatgaaccatgggaacgacactttgcgtttaccgtccgctggcatttcggaatggtttttatcccaccaaacggcgatgacgatggctgcgaacaccagcatcagcactcgcgacagtttcatgatggttgcgatgtccaccgcgccgaacgcgtcgccggccgccacggcatgggcgatttcgtgcaaggaagctccggcggtaatgcccagctgtgtcttactcaaaccggtcaatggtccaagggtgatttccagtaacgcgaagatggtgcccatgatggcgatgatggccacggccattacttcgttgttggctttttcatcctctttttccggcggtactttgatggagccagacaatcccatgacggcggccgcaccgcaaatgccggtgccgcccgccaccagaatggcgagttgcgggtcgacgccaaatttgcgggcgatggcgtagcacaccacgatggtgagtgtcacgaccacggccgcgatgggcagacacttgatgccttgggtgaacaatacggtcagattgagcttgaatccgagcagaatgattcccagacgcaacagtttattggaaataagtcctgctgcgtccttcacgccggacctgtgttccacggaacggctggaataccatttgcgaatcggaaactggaccgccatgccgatgagcaatgcgatgatcagcgcgccgaacagactgaatcccggaaactgtttaagccacgaagccactagtgaggcggccaaagtgacgatgctgacgaaaaccatttccttggtggctatgcgagcccaccatgttttgcaaaaatcaatcacgtgtctcaagtgttccggccggttcggacatcggtatggtgcagaaagcgataacttcagcgccgtgccaacgatactgaaatccaatgcgcgatcggcagcaggtacaggaacactgccaatgtcagactggacgtgggcgctcccaccgaagcgagcggcaccgctccggcgatggaccatggaatcagcggagccaccaccacggcggtatcctccagattgatggccttgcgatgctcgtcggactccagatggtcgcatagctgatttgtcagcatgatcgacaacgtttgattgcaggcgacggcactcgctacgagagacgttaccagcgtggcgccgaatacgctgatatgccgggcaagcgatgcgaccatccgatgcgcgccatccagcagttccgtctcttggaaaatgccggaatatgacgatgaaatgcatacgatcagcatcactttgaccattgaaacgattccgccaccatcgatcagcggtgcgacgcgcgcgtcagcacagtggaatccgaataccagtgcgtggccaatcgcggtccaatccatatgttgtactgcaacgcaaatcggcaatgcagtcagtatgctggcggtcatggtgatgcgcacgtcaaccctggcgatcgccagcgcgaccaacaccactgcgggcaggacggtgacccaatcaagatcgaacgcgttggaaaacagtccggcaatgtcaatggagctgttggaaggatgcgtgcacagcgtcaatgccgcatacactgcgcacgtcagcacgaacggtaccgcggcggttttcaacatcagtcggatattgtcgaaaatgttcgtgcgcgtcagcgttttgaccaattgggcgctggtggatacgggggagcagcggtcaccgaaatagatgccggacagtatcgctccaccgaggaacaccggtggaacctgcatggaagtgcccaacgtcatcgtgatcacacccatcgtcgcggccgaagcgaacgatgatccggtcagcagagacatcagacagttgagtaggaacgtgagtaggaccaccacatgaggatgcaccagacctgccgtattcgtcacaatgaacgacacagtgcctgcggcgcgccacagggtggtcagcaggccgatcagaacgaacgttactaccacgatgctggctgcacgcatggtcgcgaaacctttggaaatcatggcggtgaacgtatgcccggtaagacgcccatgagctaggaagatcaccacgccggccaacaacgccggaataatggaaatgccggcgataatgcagacgatcaacgcaccacagaacaacgccattgtgatgagctcggccatggatacacgtccttccttcataggtgccatgcgaaacaccgcaccagtgaacccgattggcatggttgatgcgtggactgtttcgatatatgactatcggtgtggcatgtggccgttgcgctgcgtcggtttgcttcaagctgacttgaagttggtaatctggctctggaagcaaaatcgaacagaataaggagaattcatggctgatttcgaagcaaggaagctggacgaattggatcatcgcactgatgatgcctccgcgcccgaagtgttcttcacatctgtgatcacgccggaaagcctgatcggagcctatcatgcgctcggacgcaagcctcaaggcaacgtggccattaaaatccattccggcgaatcggcgaaatccaataacctcaatccggcgctcgtcaaggatctcgtgcaggagatcggcggcacgctcgtcgaatgtgcgaccgcatacgatggcaatcgcgaaacgcctgagaaaagccttgccgtgttcaaggaacgtggatacgcggatatcgcgccgatccaaatcatggacatgggcggtgaaatcgaaattccggtagccaagcaccgtcatatcgcctatgacatcgtcggcaaacatatcgacgactatgattccatcttcgtgctctcgcatttcaaggggcatccgatgggcggcttcggcggcgcgctcaaaaacgtgtcaatcggcatcgcatcgtcgaacggcaaacgctggatccattccgcgggcgtggccaccgaccactgggtggaaaccgcccaagatgacttcctcgaatcgatggccgaagccgacgaggcggtgatcagccacatgcatggcaacatgatgtatctgaacgtcatgaaccgcctatccgtggactgcgactgcatccccaccccatccgaaccggacatgcacgatatcggcgtgttgtcatcgcttgacccggtggcgctcgatcaggcatgcgtggaccttatccacgttgcccccgacggagcttccgtcaccgaacgcatcgcttcccgccacggcgaacacacgctcgaatacgccgaagaactcggcatcggctcacgctcgtaccgtctgaccgtgctcgactgacagtgtccgtaatgaccacgaaaccggcgggaacaggcggtgtcgtaatcgcccatattgaagcgctgcttgccgaacgcgaccatgtgctcgttgcgatagacgggccatgcgcatccggcaaaaccatgctcgccgcaaccgtcaacaagcgtttcggcggcaacgtgctgcatatggacgatttttttctacgtcccgagcagcgcacgccggaacgattcgcgcaacccggcgggaacgtggaccgcgaacggttcgaaacggaagtattggctccgcttttcgccggaaaaaccgtgcaataccgtccatgggattgtcattcgggcgatttcgcggtctctcgtaccgtcgaaccggctcggttgaccatcgtggaaggcagctacagcatgcatcccgatctgcgcgggtactacgattgcatgatctgtcttgcgattacgcctgctgagcaactgcgtcggcttgagcaacgtaatccgcgcatgctgcgacgtttcgtcgacgagtggattccgttggaaaaccgttatttcgaagagaccggaaccgaatcggctgccgacatgatcgtcgacactgcattgccggataacgtatgacgaccattgaagagaagaaaacaaaaggagaatgaatatgtctgattctgcaactatgtccgtgcgcgctttgcatcgtaccgaactgccgaagctgagcctgagcaccaaagccgcggccaccgtgttggccattgtggccgcggtcgcattgccgcagctgttccatgtcatcggtgccgtttccgggcagggcaccatgcttggcgtagcatttctgccgatgcatctgccgatcatctttgtcggcctgattgccggtcctgccgtcggcgccatcgccggagccgccgcgccgctcgccagcttcctgctgtccggcatgccgatgctggcgatgctgccgctgatgatggtggaattgtgcgcgtatggtcttgtggccggtctgctgcgcgaagtcaagctgccgagtcttgcgaaggtggtcatcgcccagctggccggccgtgtggtgctgaccgcggccactgcgatcgctgtgttcgcgttcggctcaagcaaggcggtcgccgcaacatggacgagcgacctggccgccggtctgccgggactcgccttgcagtgggcgctgatcccgctcgccgcctactggaccgagtcgctgattgccaagcgcaatcactgaacaacgatagttcaaacgcggcagtcagccacgttctgaacaaaaccgatattttcgggagccaagccattacgcttggctcccgttgtcatatcagtcgggaaatcgggagaaacggtcatgatcgcgggagtgtccatcaccacattgctgctggtgctcgcagccggcatcggggcgggattcgttggatacgcggtcggcgcatcctcgctgatatcctatccggcgttgctggcgttcggcattccgcctgtgctgtccaacaccacgaacacggtgggcgtgtgcggtacgggcatcggcggactgctttccgcccgaaaggagctcaaaggccaaggcgtgcgcgtggccgtctacgcctgcatcggattggtcggtggcattatcggcggactgttgctgctggaactgccggcagaagtgttcgaatgcgcggtgccgccgctgatcctgttcagcgcgatcatcatcgcactcaatccacggaagaaggcggccgcgcgagacgccgtggcgcaggcgctgccgcaatcgcatcaaggcgaacgagccgcgcggatcgccagcaaaaccgcaagcggcacgttgcgcaacgatccgtggtggctatggcttggcgtaagttttgtcggcatttattccggctatttcggtgccgcagcaggtacgcttgccttggcgattctcgacttgggtaagatcggcccgttccaccagatcaacgcgctgaagacggtagtcgggttcggtgcgaacatttccgccgcaatcatgttcatcatccgtggttccgtcgattggccgttcgccatcatgatgtgcctcggttgcacgatcggcagtgcgatcgcaccacccgtcacccgccatattccggagaacatcatgcgcgccgccgctgtgctcaccggcatcatcctcgccgtcaagctcggctggtccacctacctgtgacatgcgctgtacattgattcgcaaggtgaagtcccgctggaagaaccggtttctccagcggatttctttttctagctgccttgcgattgaaggacctgcgagccgtccatcggtatctcgcaaaacagcatcgtgtcagataagcgtcgacagcgctcgcatgacgatgtccacgtccttgttttccaattcgcgaatgacatgcagataggtttcctgtgttgtggtcatgctggcgtggccgaggcggcgcgacacgctggcgatcgatacgccggcgaacagcagcagtgatgcgtgcgtatgccgcaatccgtggatggaaatgactggcacatccacgttcttgcaatgtctggcaagcacgtcgttggctgtggaattgtagactttgccgtgcacgaagatgggtttgtcatgcggaagattcttgagcagtccggaaagctgcatgatgagctgccagtcaagctgcactttgcgcacggaggattcgtttttcgtgggtacaaaaccgccgccgtttttgtaatcccaggttttgctgacggaaagcgtttggtgggcgaaatcgaagtcgtcgggcgtgagcccaagcgcttcggagaagcggagtccggttttcgcgatgaggagaatgagccaatcccaacttgcctcatcgccaagatcaagatcagcgagcatagcgtgcagctcgaattggttgagatacttcatttttttgatgcgtggctgcttgcctttgataatgactttgcgtgtcggatcacggggaatgagtccttcatcaacggcatcgagaatggcgcctttgatctggtgatgaaaatccatggtggtctggcgctcatgatgctgcgcgtaaccgttaatgagctgctgataggcggtgcgatccatatcggcaagtcttagttcagggatgagtttgccgatccaagattgtgtgagtcgatatttacccatggtcacgtctctgatggcaccttccttatacgttctcacccactgggcgtagtagtcgcaaaacagcgattccgaagtgatgttttcctgcatagtgtgcacctttctaaaaagatgggggataaggtgcagccatcatacttacgctgatgaagggtgatgagcgagtccagacagtcgaagaacgcgccgatttggcgctgctctggtaaagacggaacgagaatttcctgctcaaggaagtcctttacaactaattcgttcatcatagtgccactttttgtggaattcacaagaattggccgcataacttcctcgctgtgaataaagtacttccagaatgagtactcctgttcaacaattggtcgcaagcaagtgaatcttggtgacataatgccgtttccagcatcattaagcacgaaccttccataagcaaattctttgttagcatgtccttcaaatgcgatatcgcctaatcgaagccgcttgtagctcggcaaggaagattcatcagctccgttgcctgtagagttaaacgtcattgaagcaacggataaggttcgttcagatcctaaaccatcagtatttcgctcatcatttttctgatatagctcacccagcttacgctgttcccaagcgggggcgcggtattcttatggaagatgtgcagtcactcgtggagccgtgcattggtttgccggtaccgcaatgaggagggatagatgaataagcagcagctcgcttcgaagatttgggaatccgccaataagatgcgttccaagatcgaggcgaacgaatacaaggattacattcttggcttcattttctataaattcctttcggaaaacgagctgatgcgcttgaaggccaacgatttcaccgaggatgacctgccacaacttacggaggataatccggacattgtggaaggcgtacaggatgagtgtggctatttcatcgcctatgacaacctgttttccacatggatcaaaaagggcaacgatttcgagatttccaacgtgcgtgatgcgctttcggcgttctcccgcaacatcaatccggcgcgtaagagagtgttcgacggtattttcgacacgttgcagaccgggctttccaaacttggcaccgacgcgagaagccagtccaaggccgcgcgagatttgatttacctcattaaagacattccgatggatggtcgtcaggattatgacgttctcggcttcatctacgaatatctcatcagcaatttcgccgccaatgcggggaagaaggccggcgaattctacacaccttctgaggtttcccagctgatgagcgaaatcgtcgcctggcatttgcaggggcgcgagcagatcaagatctacgatccgacatccggctccggttccttgttgattcatatcggtcaggcggtggctcgacgtaacggcaatccggattccatcatgtattacgcgcaggagctcaaggagaacacctacaacctcacgcgtatgaatctggtgatgcgtggcattcttcccgacaacatcgttgcccgcaacggcgacactctggaggacgactggccgtggttcgacacgttggagaacaaggaggaaacgtacaatccgctgttcgtggatgcggtggtctccaacccaccctattcgcagaattgggatcccactgacaaggagatcgatccgcgtttcagctatggcatagctccgaagtccagggcagattatgctttcctgctccacgacttgtaccatctgcgtgccgatggcatcatgaccatcgttctgccgcatggcgtgctgttccgcggcggagaggaaggtcagattcgtaagaatctgatcgagaaccgtcatattcaggcgattattggtctacctgcgaatattttctttggtacgggtatccccaccatcgtgatggtgttgcgcaaaaaacgtgacgacgacagggtgctcatcgttgatgcgtcgaaacatttcatcaaggacggcaagaacaacaagctacaggcttctgatatcaaacgcattgtcgatgtggtgtcgaacaatcgcacggtacccaagttcagccgtctggtgtccatcgatgagattcgcgccaacgattacaacctcaacattccgcgttatgtcgattcatccgaggatgcggaaatgtgggatgtgtacgcttcgatgttcggtggcgttccgaagagtgaggttgagcagcttgaggaatattggaacgcttggccgagtttgaaggctgaactgttccgtgataatggtgcctgctatgcctgcgatcacgatgatatcgccactgtggtgcgcaacaatgccgacgtacaggcgttcattgcctcgtatgggcaagccatttccggcctgcctgctgacctgcgctcccgtttggtggcgcatcctgaacaggtggatgcgctcgggcaggaaacggccatcggcaaggaattggatgcgatggttgccgataccgcgctgatcgatccgtatgacgcctatcagaaacttgatgatgcgtggaacggcatctccattgatctggaagtgttaggttccgaaggtttcgatgcggtaagagccgtggatccgaacatggtcgtcaagaagaaggccggcaaggatgtggaagtgcaggatggctggattggccgcgttctgccgttcgacctggttcagcgcgagctgctgcacgatgatttggccgcaatcgagacggacgaacgccgtgtgcaggacatcgattccgaggttgaaaccattttggaaggtttcgatgaggatgacaagcagaacagcgatgcaatcaatcaggacggtgacgccttcgttgccgccgagctgaagaaagcggtcaaggcgatcggcaagaatccgtcctccgatttcgagcgtggcttggtgcagtcccagaaactgtttgatgaggcgaagaagctgaagtccggcatcaagaccaagcgaaacgcgttggaggagaagacctacaacacgattaaggcattgagtgacgaggaagccagaaggttgctggaagccaagtggattacgccattgcagaagcagttggaagaactgccgaatgccgtgatcgacgagctcattggcaaagtgaacgcgttgaagaacaagtacgccaccacatatgccgatgtatgcggccaaatcgatgaagcggagaaggaattggccggaatgctgggcgatttgaccggcaatgctcgcgacatggcgggtctggaagagctcaaagcactgctcgggggtgaatgatatggccgaacagcatggaaaagcgttggttccgcagattcgttttgctggtttcactgacccttgggaacagcgtaagctgggggaagttgcgcatttcatcaacggtagagcatattcgcaaaatgagctcctctcctctgggaaatatcctgttcttcgggtcgggaatttctacacaaatgattcctggtactattcaaatcttgagttagaagataagaactatgcttatgaaggtgatttgctgtatacatggtcagcaactttcggtccgcacatttggcatggcaacaaggttatctaccattatcatatttggaaagtgcagctagaagcagctcttgagaaactatttgcatttcaacttttggagcgagacaaggaacgaattctatctgacaaaaatggctctacgatggtgcatatcaccaaaacaggaatcgaaaatacgagcgtgttaatgccttgttcggttgaagaacagcgccgaatcggcgcgttcttcgaccgtctggactccctcatcacccttcatcagcgtaagtatgacaagctctgcgtgctgaaaaaatccatgctcgacaagatgttccctaaagggggttccctgtatccggagattcgtttcgctggtttcactgacccttgggaacagcgtaagctgggtgaactgttcgaggagagtgatgaacgagcttccgatagagagattttgtctgtcagcgtagccaacgggatatacccagcatctgagtccgatagggagacgaatcctggcgcgagtctcgcgaactacaaaatagtgcatttcggagatgtcgtttacaacagtatgcgcatgtggcagggggctgtagatgcaagtcggtacgacggcatcgtaagccccgcatatgtagtagcaaggcccaattccgaggtttatgcacgattctttgcgcgccttcttaggcaaccgatgttgctaaaacagtatcaacaggtttcgcagggcaattccaaggacactcaagttttgaaattcgatgactttgcttcaatcggaatttctatgcctgcctcagaaaacgagcagcgccaaatcggcgggttcttcgaccgtctggactccctcatcacccttcatcagcgtaagctcgaattactccggaatatcaagaaatccatgcttgacaagatgttcgtataggggtgttcatggcaataatcacgctatttcacggttccccgcacgagtcagtgacccccgaatacggtttaggtaacgacaaacacgactatggccgtggtttctatctgactaaaagtgtcgagctcgccaaggaatgggccgtgtgcaggccggatgagtccaatggctgggtccaccagtacgaactggacacgaatgggctgcgcatcctggattttcaggaacataacgtgcttgcctggctggccgagctgatgaagcatcgtgatgccgccgattccaaacgttatcgcgtgcttgccgcgaagttcatcgccaaatacggcattgaaaccagcagttatgacatcatcaaaggttggcgtgcgaacgcctcgtacttctacatcgctaaagaattcgttcgagataatgtggacgtcgatatcttggaggaactgctgtcgcttggcggactgggcatccaatattgcatcaaaagcgaaaaggcatatgggcaactgcgagaagtcaaagatggcttactttccgtcagctatagcgaattcaacgacaaatacaatcagagggatgttgaggcacggcagaacatgcgtgatcttatcgattccgatgccaatacggtgaccaacgtgttcagcacgttgctctaggggtgatgacaatgcaggcatatccagaggtctaccgggatgatgtggtggaaagccaaggcaagctcttcgactacgtggcgcagtcgtttccgggcaagagcacagaggatttcatcgccacgtatatgacgagcaaaacacgcaaaagcattgatgaagccaaagcctacgtcaatacgatggatgcggaagagctgtggaagtatttcaccgagactgagcattaccaattgaaggacggcaaggcgcttaaagggttcatgcccgattggatcggtgagttctatgcctactaccaatggttctacggtcttcccagttctgaagtgattaccagggtgccgttgaacttcctgaagaaagcctatttcgggctgcatgatctagatctggaacttgcggtgcggaaagtcggcgaagaatgacaggcatcgtttgcttccataatcccgatgaggagaacgggtacctgagcaactggtatccgtcgcacttcgttgtggatgatgttgagttttcctcaatggaacagtacatgatgtaccgcaaggcatgctgtttcagcgatgccgaaacagccgcgcgaatcctcgaaaccgatgacgtggccgagatcaaacgccttggccgacgggtggccggttatgacgatcacgtatggaacggcgttcgccaaatcgaggtctatgaaggattacttgccaaattcagacagaacgccgaactcggggcacggcttgaggtaaccggcatcgcgctgctggcggaatgcgccgtcaaagaccgcatctggggcatcggcctgtcgatgcatgacccagccaggttcaatccgagccaatggcgcggtcggaacctgctcggatacgctctaatgctcacaagaaggaagctcagccgtatagattgatggtaatacggctgttttccgggctctaattgtccccgcttgggaacagcgtaagctgggtgaactgttcgaggagagtgatgaacgagcttccgatagagagattttgtctgtcagcgtagccaacgggatatacccagcatctgagtccgatagggagacgaatcctggcgcgagtctcgcgaactacaaaatagtgcatttcggagatgtcgtttacaacagtatgcgcatgtggcagggggctgtagatgcaagtcggtacgacggcatcgtaagccccgcatatgtagtagcaaggcccaattccgaggtttatgcacgattctttgcgcgccttcttaggcaaccgatgttgctaaaacagtatcaacaggtttcgcagggcaattccaaggacactcaagttttgaaattcgatgactttgcttcaatcggaatttctatgcctgcctcagaaaacgagcagcgccaaatcggcgggttcttcgaccgtctggactccctcatcacccttcatcagcgtaagtattgtggtgttgcttcttggatgttaggggttgcgctcgtaagattgggctcagaaagtgacggtgcattcggggagatgaaacatgttctacgataaagaatcggatttcgaagacgatctggttgcggtgttgaagcgccatggatggaccgatggcgtgttggaatatccaactgaacaggaccttatcgacaattgggccagtatcctgttcgacaacaacaaaggcatcgatcgattgaatgggcagcgccttaccaaaggtgagatggcgcagatcctcgaacagatcgaaacattgcgcacaccattggcgctgaattccttcattaacggcaagaccgtgtccattaaacgtgataatcccagggatgaggctcattacggtaaggaaatcagcctgaagatctatgatcggcaggaaatagcagcggggcaaagccggtaccaaatcgcaagacagcctatttatccagctaaaaataagatgttgaacgatcgcaggggagacgtttgcctgcttatcaacggcatgccggtcatccacatcgaattgaagaaaagcggcatccccataagccaggccaccaatcaaatcgccaaatacgcgcatgaaggcgtgttcaccggactgttcagactcgtacaggtcttcgtggcgatgaacccggacgatgccgtgtacttcgccaatcccggtgaaggcgatttcaacgacgattatttcttccattgggctgactacaacaatgagcccacagcggcgaacaagcatgtcgggcaggatgagtggaaacggttcgcgtcggacctgttgtccattcccatggctcatcagctcatcggtttctacacggtcgcggattccgcggacggatgcctcaaagtgctgcgcagctaccaataccaagcggtgaacgccatttccgaccgtgtccgcacctgcaaatgggacgagcctgtgccgagcggcactccgggccgaccgggcggttatgtgtggcacactaccggttcgggcaaaaccatgaccagtttcaaagcggcgcagcttgtcgccgattcgaaggatgccgacaaggttgtcttcctcatggaccgtatcgagctgggcacgcagtcattgctcgaataccgttcgttcgccgatgatgtcgacgatgtgcaaggtacggaaaacacggatgtgctcaaggcgaagctggcaagcatcgacccgaaggacacgcttatcgtcacgtccattcagaaaatgagcaacatcaaggccggcgaagggcatatcaccgaagaggaagtgaagaagctcgccggcaaacgcatcgtgttcatcatcgatgaatgccatcgttccacattcggcgagatgctgcaggatattcgccattccttcccgaacgcgttgtatttcggtttcacaggcactccgatccatgaggagaaccgcaagaagggctcaaccacatcaatggtattcggcgattgcctccaccggtacagcatcgctgatggtatccgcgatggcaatgtactcggattcgacccgtacatggtgttgacctaccgagacaaggatgttcgccaggctgtcgcgttgcagaaggcgaaagcggcgacggttgaggaagcccaagcggatccggtgaaagccgaagtgttctaccattacatggatccgaatcaaatgccgatgggacctatggaaacgcaggccggagaacgtatcaagggcattgaggattacctgacttcggcgcagtacgcgcagggcaccccgcatgagggcaaggttgtggaggatatcctcgaccaattcccattgctgagcaggggcaacaaattccatgcgatgctggccacgagttccattcccgaggcgatcagctattatcgcttgttcaaggagcgtgcgccgcagatgcatgtgactgcgctgttcgatcccaatgtcgataactccaacggcgcgattctcaaaggggacgcgcttcaggagatcatcggcgattacaacgaactgttcggcaaggatttcatcatccccacatggccgaagatgaagaaggacatcactgcgcggctttcccacaagcggccatatctgacggtcgatcagcatcgcgaggaacggctggatctgctgatcgtggtcgaccagatgctgacgggcttcgattccaagtgggtcaacacgctgtatctcgacaagatcatcgactacgagaacattatccaggcgtttagccgcacgaaccgactgttcggctccgacaagcccttcggaacgatacgctactatcgcaagccgcataccatgaaagggtatatcgaagcggcggtgaaactgtattccggagacaagccgcttgatctgtttgtgcagaaactgccggaaaacgtgcgtctgatggatgcgcgtttcgaagagatcgcttccgtgtttcgtgccgaaggcgtggaggatttcatgaagctgccggagtctgtggaagcatgccggaagttcgcgaagctgttctcggaactcaatgattttcttgaagccgccaaagtacaaggatttacatggcagcagcgtgaatactccgtcacccatgacgatggttcggtggaggttgtgcggccggagctcgacgaacgcacatatctgattctcgttcagcgatacaaggagttgtttgctggagatggcgaaggccatagtgagggtcctgaggctccatacgatcttgatgggcacatcaccgaaatcgacacgggattgatcgatacggattacatgaacgccaacttcaccaaatggctcaaggcactcggcggaggagatacagccctgttggcatccgccgaggaggagctgcataagtcattcgcttcgctcagtcaggaggagcaacggtacgctgaactgttcatgcatgatgtggagcgtggcgagattgagttggaggagggcaaaacgctgcgtgactacattacgtattatgctaacagcgccaagaacagccaagtggagaagatcaccaaggcgtttggcgtggatggagctttgctcaacgagatgatacggcttgatcttaccgaagcgacgctgaatgaatttggtcggttcgaccggttgaaagcgtccatcaacaagcctttggcaaaggcgtttttcagcaagccggatagctctgtcacccaattcactgcgaatcttctcgccaccaagttgctgaaaagctttatccttgaaggaggattcgatctggacgatcgtaaatagcggacggtagtaaaacagggggagaatcatgtcggttgtcgatgaggcgaaactggggtatctggactttctttcgcgtgaggatcgggtacgccaccatcgctacgttgaggaaatgaagcagtatgacatgatgcgctccggcgacatcaatgccatttcggaaagcgcgaaactgtgggattccggactatacggccatctgtcggacgatcctctgaaaaacgcgaaataccgtttcgtcaccaccattaccttggccacgcgtttcgccattgaaggcggcatggacgaggaagacgcatacaacgcctccgatctgtacattcaagatcttgacaattgcaagaccccggaagacgtgcgccgactgcacaccgacatgatgaccttcttcacttgggctatggccgacatgcagaaaaccgacacccattccaaagccgtcaacgaatgcatggactacatccactaccatctgcatgagaaaatcactgtcgcgattctggcacagcacgtgcatttgaatcccacgtatctgtcagaactgttcgcacgcgaaacgggaacgtcattgtcgcaatacattaccgacaaacgtatggaagccgccgaaaacatgctgaaatattcggaatacagcttcaatgagatcgcacagatcctcgcataccggtcgcaaagccacttttcgaaagtgttcaaaaaacatagcggcatgacaccgggtgagtaccgcgccaagtattcacagaacggcatctggccggagtagtagcgcctcggcgtgtcgcgggcgatgcggtgaaccggacgtaacgacatcgcgaacttcgggtgtgccaatcgtgaaatcgatgtggtttcgcgtgtggcatacgttcgaatcgactacggtgaaagtattcaatgatgatgcgcgccggccgaatgaacgacagaacggaaacgcgcgcaggatgtggatgaaagcaaaggaataaacgaatatgggaatgccccttgatttgtatgtgattcgacatggcgaatccgaagcgaacgtgattatcagtgccggtgaacagggtgacaactcgctgtatacgcaggacaacgtcaccgtgcccgaccgttcgtggaggcttacggccaccggccgcaagcaggcggactgcatcggccgctggttggtctcacagcagccgttgttcgaccgctacctcgtctcgccgtacgtgcgcacgcgtgagacggctgccacgatggccctgcctaaggcgaaatgggaggagacgcgcgtgctgcgcgaacgctcctggggtgagatcaataccatcacgaaagacgatttcaaaaccaattacgcgcgtaactggatgttcaagaacactgatccactgtattggcgtccgccggcgggcgaatcgatcgccgatgtggccgaaaaccgcgtgcataatctgctcacatccctgaaccgcaagtcggacgcagaatccgtggtgatggtcagtcacggcgacctcatgctggcgcttatgctcactttggaggacttgtccgacgaggaattcatgcaccgtgcggcgtccgacgaatggaagatcactaattgtacgtgcttccattattcgcgccgtgatccggcgaccgggcgtacgcataagcggttctgttgggagcagaccgcccgcccggtgttcgacgatgcggaaggtcgttgggcggtgaaagtggacgattggcgtgaattcaagcgtccagtgctgtcgaatggcgatttggtggacgttgttcatgcggttgaccgtcacctgtgatgtgtgttggtctgttgattgcatgatcggattggctgatatcgacgattgatgcccccatcttgcgtgtgcaacgcgcccgtgtccacgccccactacaatggctgtgacacgcggcgcgtttttgcttgccgcgaaagagagttaaggagacaatcacatgtccaatctgttcacgtggcaggtccacggtgatggcaagacgctgaagccgggcgaagtcgttgagcctgacgagcgcctgacttggccgcgcaccgccgaaattggcgcacagcatgtcatcgccatgttcggtgccacgttcctcgtgccgattctgaccggtttcgacccgtccaccactttgttctttacggccatgtctaccgcactgttcctgctgatcaacaagaacgtgctgccgagctacctgggctcgtccttcggtttcatcgcgccgatcgccgccgtggccagcgcccacaagggcctcgctgtcgcgtccttcggcatcatggtcaccggcatcctgctggccctgatcggcgtgctcgtccattacgcgggcgccaagtggatcgacatcatcatgccgccggttgtcaacggtgccattgtggctatcatcggcttcaacctggctccgagcgtgtggaacaacttcaaggtcgctcccgacaccgccatcgtcaccctcgtggccgtgctgctcgtcgccgtgttgttcaagggtctgctcggccgactcaacatcctcatcggcgtgatcatcggctatgcgtacgcctgcttccgtggtcaggtcgacttctccgccatcggcaaggccgcatggatcggcctgccggaattccgtctgccgcaggtcgacttcaccatcctgccgatgttcatcccagtcgtgctcgtgctcatcgccgaaaacgtcggccatgtcaagtccgtgtcccagatgaccggccgcgattatgacgaccagatcggcaccgcgctgttcgcagacggtctcggcaccaccatcgccggcttcggcggcggttctggcaccaccacctacggtgagaatatcggcgtgatggctgccaccaaggtctactcgaccgccgcatactggtgcgccgccgcgttcgcgctgattctgagcctgtgcccgaagttcggtgcaatcatcaacaccattccggctggcgtgctcggtggcgtgaccaccctgctgtacggcatgatcggcatggtcggcatccgtatttgggttgagaacaaggtcaacttcgacaagccgctgaacatcatggttgccgcaatcaccatgatcatcgccatcggccagttcgcgttcgctttcaatggcatttccttcaacggcatcgccattggcaccatcgtggtcctcgtcgcctaccacggcctgaaggccatcggcaaggctaccggcaccattgccaaggacgatccggacattctgtgacggacggcaatcagccgtatcggacccgtcggtcttatgaccggcgggttctttttgtatgtgttttcatgcaaacgttccaacatatttcgtcaatcgatcaatgtgttgcgttgagcaggttttatgatggtgcgtgtaagtgaatgcgcatgcggcaagggaggtatgatgagcactgcagcaggaaagaagatcgctatcgtcaccggttccgcgcttggattgggatatgagctgactcgacagctgatcgccaaaggatggttcgttgctggtattgatttcaatggcgcacgtcagacggagttgtcaaagacttttgctgccgacgaatacagagcttttgtgggcgatatttccgacgaatcgttcgtgaagaactctattgccgcaatctcgaaaatcggtcatatcgatttgctgatcaacaatgccgggcagccttcgttcaaagtcccgaccgcatacgaggcggccgatgtggacaagtgtctgaaggggctgaaaggcatggtgttgtggagtgtggaaacgctgaaagcagacggtgagcgggatctcaaaatcgccaacgttatgtctactgcggcaacgcgaggcaatcccaacgaatccgtgtactgcgccaccaagtggggcgagaagggctacaccaagagtttgcaggccgcatacaaggggaccagtgtgaaaatcgtgggtgtctatccgggtggcatcgacaccccgttctaccgtgacagccatgactacgtttcagaagaaaagcagcataccttcatgcgtgccaaccaactggccgaagtgattctgttcaatctggtcaacgaagcgaatctgaccgtcactgatatcgaaatcaaccgcaatccggcgtgaatataacgaatatgaaggattgaaggaacgtaagaaaaagtatcgggcataggctacagttatcaggtttgcgcaacgtgcgtaatatttgacatgaaaggccattgtgcccgataccgtttttgatgaagataccctcgcagccgcttccgaagtgatgggcgaggaagaggaacgcccgctgacattcgccgaactcggcgttcctggtccgctggtccgcgtgcttgcggctgatgacaagaaaaccgcttttccgattcaggccgacacacttcccgattcgttggctgggcgagacattcttggccgcggtcgtaccggttccggtaagacgttggcgttctcgattccgctggtcgctcgtctgggtgaagtggatgccaacgaatatgagaatatgagccagttccgccatgaggttgatcgtgtgaagcaggctcatgccaaggagcggcgcgccgatgatttcgtgcctcatccgcgtggcttggtgcttgctccaacccgtgagcttgccaaccagatcaacgacgtgctgatgccacttgcccagatatacggcatcaacaccaccaccgtgtatggcggcgtacgttatgcccgtcagatccgtgaccttcaggccggtgccgatattgtggtggcttgcccaggtcgtcttgaggatttgatcgaacagggcgcgctcaccttggacaaggttgaggtcgcggttattgatgaggccgacgaaatggccgatatgggcttccttccgccagtcaagcgactgctcggacagatttcgttcgacgcgcagatcatgctgttctccgccacgctcgaccatggtgtggacgaagtggtggaaaccttcctgtccgatccgaaggtgcatagcgttgattccgcgacggcgaccgttgacgagatgacccaccatgtgttcaaaaccacgcagggcaaccgtcacgagctggtgcgcaccctcgcttccggcaagggccgtcgcattctgttcacccgtaccaaattccagacgcagaagcttgccaaggatttaacgcagaacggcattcctgcggccgaattgcacggcaacctgagccagaaccagcgtgaccgcaatctggccgccttcaactccggcgatgtgaacgttatggtggccaccgatgtggccgcgcgaggcatcgatgtttccggtgtggaactcgtagtgcaggtcgaaccgccggaagatccgaaatccttcctgcatcgttccggacgaaccgcgcgagccggtcattccggtgacgtggtgaccatcattctgccgaaccagcgccgcagaacccgtcgcatgatgcgtgaggccggactgacggtcgaaccgatcgacgtgacccctgattcgccggaagtgttggagctcgttggcgaagtggccgagccggtgttcggctggacgcttgagcagtcgcagccggtaggaaatccgcgccgcaggaagaatggcaagggggatgccgacggcgaacgttccggcaggccgaaccgttccggcgggcgtaacaaggatcgcggcaaagacaagggcggcaagccgtttaagtccgaacgtaaggatcgtcgtgatcgcgaccagcgtgaggagcgtaacgacagcgcgaagaagttcgagccgaagaagaaccgtgcggaacgccgtgccgccaagttcgaaggtcgtgacaatcgtgaattcgaagcgcgtgaacatcgttgggaacatcctgaaattcaggaggaacgccgcgaacagcacgaggaaaagcgcaacaacaaacgtcgtgaaaagtacacgcgcctgcatgagcagcagcgcagcgacaatgaacagcgcgaaacaacgaacaagcgtaggaacgacggtgattacggcaataccgacaatcgcaggaagccgggaaaaaagaagtccggacagcttgcgaaaaagcagggtgcgccaagcaagaagcagcgcaagtctgaagcccgtgccgagcgtcgatatgacgacgatcgtcggtccaaaggcaagaagcatgacgagcgttcctcggacgcgaaacgctatgaccgtcatacggaagtcaagcgtggcggccgtggcgaacgtcacgacaagcatgcagggcagtcacggcatcgccatgcgaacatcaggaaagcgccattccgtatgcgttgatcgctgaaaagcaaaatcaaagtttgcgtagctggcaaacaatagaaaacggtgtccgccaaaatctatgaacttttggcggacaccgttttctattaaatctgatcatctattaatttgcttggctatatgaaaagttgctcagcctgtaatcggattgtattggtcgtctgcagtgaagcacttacggtacgccatcaccataatgagactgtcagccagaagcgtcaacgctgcgatggcggcgagaatcaggaactggtatttcgcagcatcgataggattgccgccggcgatgatctgaccggccatcatgccaggcaccgtcacaatgccgctggaagccagcgaggcggtagtcggcagcaaacccaaacgaatcgacgagacgatggacgggcgtgcggcctcccaagcggtcgcacccaatgccagcagcgtatccacttcgtcacggcgttccttcatgctttcgaagaaccggctcaatccaaccgccaaagcggacacggtattgccaagcagcatgccggtcaacggtaccaccaattgcggcgcataccacggttgcgggcgaatgatcaattcggtgaccaacgaaatcataatgagcatggtgatgaccaagctcaaaaacacgggaccggccaagcccctcggcacacccttggcacgggacagggtgatttgcacggccgcgatcagcatgaacatcaccagcagcagcaccagccatggattgttcgacttgatgacgaactccataatgaaacccatggcgcacaattgcagcaacgcgcggcacgccgaccatagcagtgtcttgccaatacccatgcgcatcgcttcggaaatgcccgcggccacggcaaccataaccaatgcgataagcagaccccaaatatcaatggaatagtaattgccgctcatgcctgcgctccttgcatcgaatcggactgtgccgcgaaatcattggaatcattggttgctgtggttcgcggagcattcgcactttgcaatacgccattggccagtgtaagaatacgcgtggcacgtccatccggtgggcgatgacgaatacggatcaccgtcatgccccgctctgcggcctgagccatgatggacgccaccttatcggcgttctcatcatccaaaccggcgtcaacctcgtcggcaagcagcacttttggcgaagtaagcaaggtgcgcgccaaactcacgcgggcggcctggcctccagacaagtcatgcggagcacgccccaaatcaatatccgcgcagccaatggcgtcaagcgtggctcgaatgcgatcatccggcagtagatcggcgggtttgagagacttgccggacgaccatttcttgccgaatccttgcttgccttcgcccgcacgaatagccaatgtgaacggtagacgaatcgcctcggccacactcgaaccgatcaatactggcttctgcggcaaatacgccacctgactacgccactgctgcggtgtgaattcgctggcagagcgcccttcaagctgaaaatcgccgttcgcattcggattcaatcgtgcgaaagcggtaagcagactactcttgcctgatccggaagggccaaccaaatccacaatctcaccaagcttcatatcaacggataatccgctgagaatcgtgcgttgctcaccatcgacaggcacgacacaggaaacattcgaagccgaaaaaacatactgcataatccaacaccataccgcttgactgccggtcggaagcattggatgcgtttcttagtgtcttctaagctggatcacattgcatgggaatattgcatctgccagtcacgaattgaaaacactgctcgccatcctctatacaagagccgatcttattgaattccgccataagcgagataagtccatcgacgagccgttgaatgagctgagattcgatgtggaccgcatgaacatgatcatctccaatctgctcgacgtggtgcaggcagacaatccggaaaacaccgtcaatgcggcacatgatggcgttcgaggcgtgatcggcaaaggcaagaacgctaccgaatagcatcattcattcagcttgctcacagtatttttcgttgatattccaaggaaaatcagcctcaaggatgaggtcgtgccaacgtttcgtggactacaactggcacgttggaagtgaaaaatatgaaagcaagaagtgagcatgcgtgcatggttggtgaacataagtttggtggatggctggtttccggcaacgttgttttcgataaccgcggtgctggcggcgatactgctgggtattgcgatatgggagatggttggcggaagctgtggcggtggtaaacgtgcaattgccgtagttgcgtgtccgatggtgattgcggttattgccggcattgtcggattggtgattgcctggttgctgtcggacgtgtttgtggtgttcggtgttgagctgggcccgcgtgtgatcgcgtgggctggttgcagttgcgcgatcatcggttttgcggtcagccatgcgatgctgcataggggagtgttgcgtgccgtcgccgtaatactggtggtatgcgcagtgttttccaccgccaccggcatcgatcaggcgtatggagaatatgccaccatcggatcattgttcggccaagacgcctataacgaagccgacctgacgggaatggcgaaacgcaacgatttgattagcgtcacgcaatggaggcaggaagcggcagacggtagcatcagcgatattcccgcacatggcgaagtcagtaaagtaaatattccagccacaacatcgcatttcgaagcgcgacaggcgctggtatatctgccgccggcagcgcttgtcacagccaaacacaagccggcgttgccggtcatactgatgatgagcggccagccgggctctccggggcgcgtgtttgccgcgggcggcattcaaaccatgatggacgattacgcgcagcatcatggcggactcgcacccattgttattgcggccgaccagttgggagacgattcgcataacaccctatgcgtggattcgccggtgtacggcaaggcgttgacctacttgacgaaagacgtggtcgactgggtgaaaaccaatcttcctgcggcacggcaagcacaagattgggcgatcgcaggtttttcacagggggccacatgttcgctgcaaatcggtgcgaaccatccgaatttgttcagcaccatcatccccaccggcagcgaactcaaaccgaccaatggcagtgaaagcagtatgatcagccggttctttcacggcgatcgcaccgcatatgagaagcagattcccatcaacgccattcgcaaccatgcgccttcgaaccagacgcttgtgatcggcgcgggggagcgtgatcgcgagtctgtgcgcaatgtcgaactcatcgcaccggttgctcaacaggagggcatgcatgttacggcagtcgaatcgctcggcaatgcgcatgactggcatgccgtgcgagacacgttgcggtatgggcttgtcgtattcggttataacacgggactgagtgatgctaagccgaaattggctgactatccgaatcttaaacgcatttcaatctgaatcatcgaacggaagtactgtattatgacgcaatcgcaggaatcaacagtgaaaccattatttggctttcgtgcgcttatggccgatcttgccgactggattcgtgagcatcgcatgaccttggggtttgtgctgttcatcacgctgttcaatgtcggcatgcagctcgtatgcggcattagacatacgcaatttccgccgcaattgtcgcgcgtgagttttgacgcgctcgcgcatgggcgctggtataccgcgccgatttcactgctgtcggtgcctcagttgggtcgtctgctgatcgacattccactgatactcatcgcattcggcttatgcgaaacggtgattggaaaggcgaagacggcatgggtgtcgctgatcaccacgcttggcggcatagcgctcggtatgggattatgctcgctgttcgcaggcaaaagtccgcaatggcatgcgatttcgcatgatggtgcgattttggggccgctggttgttgtggtgggcacgctgatgtgtgccagcgcgttcaccgccatgctgtggcgtcggcgtattcgtgtgatcggctatagcgtggtgctgatcctgttcctgtatcgtggtgaagccggcgattactgtttgctggcgtcggcgttgcttggccatgtgcttggctatttgatggcttccgagagtcaaggtgatgtgtataggcatggtgccttgtatgagatgcgcaggctgattggtatggctgccggcgtacaggcggtcggttcgctggttgccgtttcctcaagacaatcattcggattgctctccatgttcggcttgctgacaggttccacggaattcgacacggaacaagtgttggattgcctcaacggttcctcgcatgccaactgtttcgcgcaatatcgtatgatgcgattcaccatgcccggaaactggctggtgtcgttgatgccgacgctgatgctgctgttgatcgcatggggtctgtatcgcggacgccgtattgccgcagcgttgagcgtgctgttcaatgcgtgcacagtggtgcttgcgatgctgttttatgtggtgcttccgctgcaatatgttggcgattcgcaggctgatgcgttgcctgcgttggctcgtcatggtgcgtttcatgcgatgttttccactatggcattgccgttgatttttatcgttatcgtcattgcgttccgtcagtgttttacgattcgcactagaagtgagattatgttgcgtgctgcggcaggtgcattgtcggcttttctgttgttgggattgatgtatgccggatatgggcttgcctctcccgacgatttcaatgaaagtccgcaattgatcgcattgcttgccgattatgtgcagcgattgctaccaattggtctgttgagtggtatcgaacctgagtttgtgcccgtcggccgaatttccttgctggtatatcagtgcgtcggtccggtgttttggattattgcattgctttgcgcttgggattgtctgcgagatcgttccatggtgaatgatgcttcacgtcatcgcgttgatgaaatcattcctcttggcggcgaatccatgtcgttcatgactacttgggaaggcaatgactattggttttccgcaaccggacgttccgcgatcgcctatcgagtgtcttacggcatcgcattgaccgtgaccggaccattcggagatcccagcgaatatgcggatgatctcattgatttcgcaacattctgcgcacggcattcttggacgcccgtgttctacagtgtgcacgaatcgcagcgagccgaactcaccaaagccggatgggattcgcttgacgtcggtacggaaatggtcgtcaatcccaacgaatggcagacccgaggcaagaaatggcaggacgtgcgcaccgccatcaacaaagccaaacgagacggcatcaccgacgtgctcaccactttcaaggaggcacccttctcagtacaaacgcagattcgtgagatctccgcacagtgggccggcaaaaaggccctgccggaaatgggattcaccttgggaggcgtcgacgaactgatcgactcccgggtgcgcctactctacgcggttgacggcaatggcaaagtccttggcgtaaccagctggctgcccacctatcgtgacggtacgatcatcggttggacgcttgacttcatgaggcatcgcaccgacagcgtcaacggcatcatggaattcctgattgcacgcatggctgaacgactacgcgacgaaggcaacgtggaattcatgagcttatcggcggcgccgctggccggtatgggatccaacaaaggcgaacacgaggaaagcgaagtgttgcgtcatgcactgcaaatggtcgcagacatcatggaaccagcatacggattccactcactattccgtttcaaactgaaattccaccccgatgaagagaaagtgtatatctgctatcccgacgcagccaaactgccgcaaatatcgcttgccgtggcacaagcctacgtgccgtcgctcacacctgccgaagccatgcgattcgtacgtacgattgcgccgcgtgattgacatgatgtcagacttgagacggtccatggttctggggtagctcgggtctacactaaagaacggttcataaagtactacttttcctgatggaaggggccagcatgtcagctgaagcaaacgtcggcgtagtcggtcttgccgcaatgggcggtagcctcgcacgtaacctcgcacaccacggcaacaaggtggcagtgttcaaccgctcttacggccgtaccgaaaagctcatgaacgaacacggcaacgaaggcgaattcttcccggcaaaaaccctcgaagagttcgtggacagcctcgtcaagccgcgtaccgccatcatcatggtcaaggcgggagagccgaccgacgccatgatcaacgcgctcgccgacctgatggagccgggcgacatcatcgtcgacgcaggcaacgcctacttcccggacaccattcgccgcgagaaggaaatcagcgctcgcggactgcatttcgtcggatgcggtgtgtccggcggtgaggaaggcgctctgcttggaccttccatgatgccgggtggctccgaagaatcctggaagactctgaagccgatttttgaatccatcgcggccaaggccgaaggcgaaccgtgcgtcacccatatcggtctcaatggtgctggccacttcgtcaagatggtgcacaacggtattgagtactccgacatgcagctcatcgctgaaagctacgatctgatgcgtcgtggccttggcatgactccggctgagatcggtgacgtgttcgaagagtggaacaagaccgaactcgactcctatctgatcgaaatcaccgccgaagtgctgcatcaggccgacaagaagaccggtgagccgctggttgacgtgatcgtcgaccatgctggcatgaagggcaccggcacgtggaccgtgcagaccgcactgtctctggccgtaccggtcaccggcatcgccgaagccgtgttcgcccgtggtctttcctccgaagctgatctacgtgaggaagccgccaagcagggcttcaatggccctgacggcaacctgaacctcaccgacgatgagaagaaggccttcatcgaagacattcgtcaggcactctacgcttccaagatcgtcgcctacgcccagggcttcaacgagattaccactgctgccgaagaatatggctgggatatcgatctggctgccgtggcacgcatctggcgtggcggctgcatcatccgtgcgaagttcctcaaccgtatttccgaagcgttcgaatcaggtgaagccaacgtgtcgctgctgttcgctccgtacttcaagaacgccatcgaaaccgccgaaaagtcttggcgtaacgtggtggctcaggccgccgtcaacggtttgcctactccggcgttcgcttcctcgctgtcgtacttcgacggactgcgttccaagcgcctgcccgccgccctgatccaaggtcagcgcgactatttcggcgctcacacctaccagcgtgtggatcagccgggcgcattccacacgctgtgggctgagccgggccgcgaggaaatcgaagcctgatagacgtatttctgcaacgaatctagcggattaacagatgaaaagagcctcacgctttatgaaaagtgtgcggctctttgtgttgcggcaaatatgatcagccgcaagggaaactcgttgagttgcctcctgaattattcgcgatgctggttgcgtgggttgccgccattcatgattgcggcgacccgtcgcgtcagagcgcgggggagtagtcgttccgctgcggctccggctttggtgaggtagccgtggtaggcaagcgtgcgcccctgcttcatcttccgatacgcgtaggtggcaagctggtaggcggtggccggtttggtcagcgtgaagaaattcatgccatgcatgttcgcggccttggcgaaccctgtggatgtcggtccggggcatacgcaggtcacactcacaccggtatctcgcaattcgtacgacaccgcttccgaaagcgatcgtacgaacgctttcgacgcgaaatatatcgccatatatgggcctgccatcattgaagcaacagaagagatgttcaatatgcgtccgtgaccctgctcgcgcatatcacgaccataacggtacgtaagttcagccaacgcggccatgttgagctgcatcatctcatgctggcgatgccagtcggcgtcgagaaaacccgtccaatccgcaaaaccggcgttattgacgagatgatccacttcaaaaccttgcgaaactgtgtaatcatgcaactgttgcggtgcgtcagactcgcttagatcaagcgcaaccgtctccacatgcacgccatagcgatgttccagcgtgcgcttcacgtcatcaagtttgccttgactgcgtgccgtaatgatgagatcatgcctgtcggccgcaaacaatgccgccatctcacgcccaatgccactcgaagcccccgttatcaacgcatatgccataaaaccacctttcttaagtattgatgttcatggtagtcaatacgcatgcaataacgccatttgcaacgcaatggtccggaacttttcgactgggctggctgattgacagttttcatgcacttctcgcatggaaagtaatacatcatttacattagttattttggtttggttcgttcacaatgggtgcgtcagcatgaatgtgaaagaaccagtatggaatgttcgaaaggccatgtttttgaactcatacaacagggcggcccgaccgacaaagtcattacaatgcatgtcgtgaaaccgggatcattcacagcttgcatttgacttcgtccacttgaagttcttaagtttgatggcatgacttacgatttcgacactcccgtagaccgatccggcacgtattcgctcaagtgggaagaggcaggagatgcgctgcccatgtgggtggcggatatggaatttcaaaccgctccacagattcgagccgcactgcagcagcgtcttgaccacggtattttcggatattccatcgtccctcctgaatggaatcaggcatacgttgactggtggcaccgtaggcataatcttgatatcgacccggaatcgctcgtattcagcaccggcgtggtgccggcaatctccagcatggtacgaaaactcaccacagcaaacgaaaacgtgcttatccaaactccggtctacaacattttcttcaattcgattatcaataatggatgccgcgtgcttgaatcaccgttggaatacgacggttccggacattactccatcaactgggccgatctggaatccaagttggccgatccgcaaaccacgctgatgatcctgtgcaatccacacaatcccgtaggccgaatctgggatcgcgacaccctcgcacgcataggtgagctttgctggaaccatcatgtgaccgtaatcagcgacgaaattcattgtgatcttaccgatccgggatatgattacgtgccctttgcctcggtgaatgagcagtgcgcaatgaactccgtgacctgcatggcaccgaccaaaacgttcaatatcgccggtcttaacacggctgccgtaatgattccaaatcccgtgctgaggcataaggtatggcgtgcgctcaacacggacgaagtggccgaaccgaacgccttcgccatgacggccacgctcgctgccttcaacgagagcgagccttggcttgaggaattgcgcgcatacttggcaggcaacaaagccgaagcacgagccatgatcaacgaatacaatgctgccgcggcaccggaacgacgcatcgccctgattgaaagccatgccacctacttgttgtgggtcgattgttcgaaactgacgcacgataccgctctgttgtgcgaacatctcaagcgcaatcatcaggtgatgttctccgaaggtgccgagtatggcggcaacgggcatgatttcattcgcatcaacgtggcctgcccgcgaagcaccatgcaagaaggattcaatcgtctgttcgccggattacgtgattttcggtgaattaatataagaccatcggctgtgatattgctcacagccgctaggaaacggctggttttgtgggttttcacaaaatatggaaaggacgtttttcggatgggcaccgccgtccgtgacctgttggcgatactatgaggcatatgactgaaactgtttcatccgtacttggcacgcctgaagagtggacgaatccgctgcgcgatccgcgcgatcttcgacttccacgtattgcaggcccgtgcagtattgtgattttcggcgtgaccggcgatctgtcacgcaagaagctgcttcccgccatttatgatctggctaatcgtggcctattgccgccaagcttcggtttgacgggttttgcacgtcgtgattggaccgaggatcatttcaaggatttcgtgaaggagaacgtgcaggcgcactgccgcacgccattcaaggaggcgacctggaagcagctcgccgacggtattcgttttgtgcagggcacgttcgatgatccgaaggcgttcgaacgattgtcgaacactgttgccgagcttgaccgtgatcgtggcacgcgaggtaaccatgcgttctacatgtcggtgccgccgcgcgcgttcccgcaggtttcccgacagttggcggattgcggtctggcgaagtccgacaagggcgcttggcgtcgtgtgatcatcgagaaaccgttcgggcatgatctggccagcgctaaggagctggatcgtgtggtttccgaggtgttcgacccatcgagtgtgttccgtatcgatcattatctcggtaaggagacggtgcagaatattctggcgcttcgtttcgcgaacgccatgtatgagccgatttggaacaataattacgtcgaccatgtgcagattacccacgccgaggatatcggcgtggccggtcgtgccggatactatgacggcatcggtgccgcacgcgacatcatccagaaccacctgctgcagctcatggcattgacggccatggaggagccggtctccttctccgccgctgatctgacggctgaaaagacgaaggtgctgtccgcagtgcgcttgccgaaggatctggcggcgcatacggcccgcggacagtatgccgccggatggcagggttctcatgaggttgtcggctatttggatgagaagggcattaatccggcttcaaccacagagacttacgcagcgatccgactggatgtcgatacgcgccgttgggccggcgtgccgttctacctgcgtacgggcaaacgtttgggcaagcgtgtcacggagattgccgtggtgttcaagcgtgccccgcatctgccgttcgagtcgaccgcaacgaaggagctcggcaagaatgcgatcgtgatccgcgtgcagcccgatgagggtgtgaccatgcggttcggcgcgaaggtgccgggtggcacgtcgatggaggtccgtgacgtgtcgatggacttcggttacggccgttcgttcaccgaatcgtctccggaagcctatgaacgtctgattcttgacgtattgctgggcgatccgccactgttcccaaccacacgcgaagtggaattgagctggcagatcctcgatccgatcgaagagttctggtccacgcttggccagccgcagccgtatcgttccggaacgtggggccctcaggaagccgttgaaatgctggcccgcgatggacaccgttggaggatgccgtgatcattaccatgaagaacaccgaaacccgtgagatttcggcgaaaatcgatgaattgcacgaggagcgtggcgaagcggctctgggtcgcgtgctcacactgctgatctccacgaatgagacgtcgctggagcatgatctcgccgtggcgaacaacgccagccgtgagcatccctgccgtgtgatcgcaatcgcgccgaattcacgtagggtggatgccgctgccgatgatggcaagccgcacacctttctcgacgcggaagtgcgattcggttccgacgctggcgcgggcgaaatcatcgtgttgcgtccgattggtgggctggttcaccaccctgatacattggtgattccgctattggtgccggacgctccggtggtggcttggtggccgaacgaagctccggcgaatctgtcaaacgatttgctgggttccatggcgcgcagccgtatcaccgatgccatgcattcctcgaatccgatgcggaccatggatgatctgcgccgcaactggtcgtcgaagaatgtggacatgtcgtggactcgcttgactgtttggcgcgcaatgctcgcttcgatgcttgaccagccgccgcatcttccagtaagcggcgtgcgtgtgaccggaccaaagaacttcctgccgttgaatctgctggccgcatggcttcgtcttcgtctgaacgtgcctgttgtggtggaagacgatccgaatgcaaccgccgtgaccggcgtgtatctgacccgttccgatggcgtgctgagtttggaacgcccatccaccgacgatggcatcgccgtattgaacgttccagggcagtccccgcaaaccatgagcgttcccgcacgaaccatcgaggaatgcttgagtgaggaattgggtcgactctatccggacgagatctatgcggaagtcgtgactcaaggctgggatcttatcaattcgaagcactgaatcgattctccgaaacaataaaggaacaatgcaggaaaagcatatggcagaacgcaccaccgttgtatatcccaatcctcagattctggctgaagccgtggccgcacgtacgctgttgaccatcaccgatcttctgtcggaaccgaatcgcactcgcgttgacattgccgtgaccggtggaaccgacggcaatcgagtgttcgacgccatgaacgcgagcccattgaacgatgccgtggactggagccgcgtgcacgtatggtggggcgacgaacgattcgtggccgccgatgacgatgatcgcaacgccaagcaggcgcgtgaggcatggtatggcaaactggttgccgacggccgtatgccggcaggcaacattcatgcgatgccgtccgatgagcgtaacttggaaagcgtcgcggcagcctcacccgaacagactgatgcggtgctggctgaagccgccgcgcaataccagcgtgaactcattgaacagttgggtgagaatccagctttggacatcgccatgttcggtatgggaccggacgcgcatttcgcatccctgttccccgaccatggcgagtcggagatcgacgatccgcatgtgcttgtcgccggtgtgcgcgattcaccgaagccgccgccactgcgcctgacgctgaccgtgccgatgatcgcacgatcgaagcacacgtgggtgttcacatctgaagtacgcaaggcggatgcggttgctgcagcattcgcgcaacgcaacaatccgcatgcgccaagctcttatgccgatggtgaggaactgctgtggcttatcgacaaaggtgccgcctccagattgtgatgcaagaaccgggactatggaatcccgatagccgggttccgttggttccgtgacgggcacgtcacctaagtctctgcctgtcatggattactcccatggctaaacatcaaggctgaatcgtttggatgagtgagcgcgcaacgccatgcgtgtagtatggcggcagtcaaacatgacagaccctgcattatgactatgagaggaaacggcatcatggaacagccatctaagttccaacatcagcttcagcccgatatgccatcgtcttccacgatgtccacgtcacctcatccggaacaaactccgccatggggcgcgctatgggtgttggctttgggactggccatgattgtgctggacagctcaatcgtcaacgtctccatccccaccattatcgacgatatcggcatcgacctgaccgacgcccagtgggtcacatcactgtacaacatcgtactcgccgcgctgctgcttcccttcggcaagcttggtgacgccaaaggacgcaaactggtattcccaattggaactgtgattttcgtggcaagttcattgctcgccgccacatcgcaggacgctggcatgctgctcaccgctcgcgcgttgcagggcatcggtggcgcgatgatcatgccgaacaccctgtccacggtgtccgccacgttccgtggcaagtatcgcgctgcggctttcggagtctggggcgcggtaatgagttcagccgccgctctcggaccgttgctcggcggcgtgcttaccgagaccttggggtggcgatggattttcctggtgaaccttccgctaggcatcatcatttttgtggcaaccattcctttggtgccaaagaccggtggccatacctcgaacatcacttcctcaaccgcttcttctaccattcgattccaaagcattgatgtggacattccaggcgtggtgctgtccgcactgacttctgccctgctcgtattcggacttatcgaaggcgagacctacggctggtggaagcagacttccactcagttgaagatgggtggtctgacatggaaccacggctggctgtcgccggtgccgatttgtctggtcgccggtatgctcctgctggtcgtcttcataaccgtagaacttgcacgaggcaaagccgggcgaccggtgatgctggacatgaccctgttccgcatcaagacattctcgtggggcaatctgtcggctgcggccatcgccgccggcgagttcgcgctggtgttcgcgcttccgctgtatctcatcaacgcgcgcggactcgacacgctacaggccggtgcgatgctggccgtgatgggattgggctctattatcgccggtagtcaggcacatatgctggcctccaaattcactccggtcgacgtggtccaacttggcttggtgattgagatcatcgcggtagccgtgattgcagtcctcatgccggtggaattcgcagtgtggtggcagcttcttcctttgaccgcctacggctgcggcttagggctcgcttccgcgcagctgaccagcgtggtgctgtccgaagtgccgattccccagtccggtgaaggatcggccacccagtccaccgtccgtcagcttggcaccgccatgggctcggccatctcaggcgcggcattgaccatggccatcaatgggacgttgccggcacgacttgaatcccttggactgcccgctaaagtcggcgatggactggccaaggcggtcagcagctcggctggcggtgtaattggctcgttccgcagcggagatggatcggcggcccaattcggtgacgaagcgccgaaaatcgccgatgcgatgacttccgggttcattgagggcaaccgttggacacttttggtggcaggctgcatgctgctcatcggtttgctggcttcggtcgctgtgcgacgcgcggcatcaacgcatagcacacactgacaaacatgaggcagggacgatctgctgaatggttttggtgggccagcagctcaacggcgaaaagttctactgaagccggccgataccaaggcgaaactgatcgcgcggtaaggtggggttatgaaagtagtagtgcaacgagtgagccaagccagcgttgacgttgtcaacgaactgggcaccatcgaccccaccttcgaaccgcagcagatcggatccggattcatgctgctcgtaggcgtaaccgatgaggatggtgaggagcagatttcttggcttgcccacaaaatcctcaacctgcgggttttcgaagacgagcaaggcaaaatgaaccgttccatcaaagacatcggcggtgaaatcctgtccatttcacagttcacgttgtttgccgacgtgaggaaaggcaaccgtccaagcttcgtcaaagcgggcaagccggaacatgccaacattacttggatcaaattcaacgaagcgctgcgatccggcggtgtgccagtacgcgaaggccgcttcggagcgcacatgcgcgttggactgatcaacgacggtccggtaaccatcgccattgataccgacaatctgtaatcaatagtaaagcgacgattgcttggtgatataaaaaatatttgaggagctgtgatataatttgcagctcctcaaatattgttttttgattgacaatgatgtttacctgttgtcggtaattatcgtcaccttgttcggatcaatcttcattgggtcaagagtcaattccttgatgacatccgcacgaatcgtgccggacgaaggattgaatacactatcgatagtgctgtgaatatcggcatccacattcgaatattcgaaagcaagcgtcgtattgattagacggcaattacgtaatacgagattatccacatagcacaaaccctgcagactttcgatcgtacagttctcaaacgtgacattacgggaattccaagccaaatactcgccggaaatgaatgaatcacgtactgtcacattctcgcaattccagaagcaatccttggaaatcaatcgagaatttgtgatttcaatattacgtgcgccatcaaatggataattgccaaccaaacgcagattataggctttaatatcggaacaattcatcgccagataatcgccacgagcactcacattttccagtgaaacgttcgaacaagcccataatgtttcctcggcattgacgaaatcaacattcctcaacgcaacatcatggcaccggcggaaattcttcggcgcttcaaacgtgcaatcctcaacacgaatggtattcgtataccacacgcccgcgcgtgccatctcgaaccatgtgcaatcctttgccaaaatatccgagcaataccacagcggatacttccatttgaacgaactcgacttaagctcaatatcatgcgcatgcttcaacggtgattcgccatcatcgaaaatcgtgtcgatatatcgcttgcctgatgcttggaattcggcgcgttcgccggtcagtaacgcctgacgaacctcgtgcatgtcactcactgataactctccttgaaaacgttctgttgccaagatagaaagttcaagtacttgaagtcaaacgcatgcccatgtttcgctggcgggcgaagcggatgagcgatggaacgcgttataagcaatgtcgatatgcgtgcgggtgtttgcgaaacatgactgtcggtaccatgaattgaacgattagacaattgggtggttacaaggcattgtggtcgcgaacgggcttgccacgtatggcagggaggaatgcggatgagccagcggaatgggggagtgaagacgcgtgcgttcaaagccgcgttccccaaagtgctgccgatttgcatcagcttcttctttctggccatgtcgtacggagtgcttatgggaacccgcgggttttcgttcctgtggccgttgtacatgagcgcgttcatctacaccggttccatggaattcgttacggtgaatctgctggtttccgcattcaatccgttcgccacgcttatgttggcgctgatgatgggaacaaggcacctgttttacggactgtccatgctggggcgtttcaagaacatgggggcgaaaaaaccgtatttgatttacgccatgtgtgatgagacgttcgcggtcaacaacagcgcgcaaataccggcggatgttgaccgcggctggttctatttcttcgtgtcgctgctgaatcaggtttcctgggtggctggagcgacgctcggaggcattgtcggctggcgattgacgttcgacaccaccggtttggatttcgtgatgaccgcattgtttgtggttattttcgtggatcaatggttgacaacgaaacgcaaaagccatatggcggcgttgacgggcactgtggtgccggtgatttgcatggcgctgttcggtgctgacaatttcatgatcccgtcgttgattgccatgctggtgatgttcattatgttgcgtccgtatttggatgatttgaaacctgataatgttgggaaacgtgatgatgctgatggtgcggtcgaatccgctgcggatcgtaacgaagtaggggaggcgcggtcatgatcatgaccacatggcagggcgtcgtcactgtactgatggcggtgcttggcaccatcatcacccgttttctgccgttcgtgctctttcccgagtcaaagaaaccgccgcacatcatcgactatcttggcaacgtgcttccgtatgctatgaccggactgctggtggtgtattcgctgaaaaacgtcaatccttttgctggaagccacggcattcccgaagcgatcgccatcgccgcgatcgtcgtgctgcacgtatggaaacgcaacatgctgctctcgatcgccggcggcaccgtcgtgtatatggcattacttcagcttgtttttgcatgattgtctgttttgtaggattgcccaaatctgaagtgagttttatagggattttccacagttgttattgctgatatcccatatcgtgagaagaaatgcgttgatgcgattgacgcgcctactctttttctttagccaataaggagctgtgttgagcggctctggctgtatagaagagttatatctaacgagagagaacaatatgactagtgcagcaagcactgccaatgccgcggttccagcgcccggcaaactggagttcaaggatgattacacgcctgaggaagcggaacgcgtcatccgcaattcgaaggggctccctgtcggtgtgaagccgaagatggtgtggacgtggccgaaggccctgctgtgggccgtcattgccattgtgtgcgctattggttgggctattctggcggtttcccgtggcgagcagatcagcgccatctggttcgtggttgtggcattgtgctcctacgcgatcgcttaccgtttctacgcgtactatattcagatcaagatcatgcgtaccgacgatgcgaacgcgacgccggccgagcgcgtgcatgacggcgccaacttcgaacgtgccgaccgtcgcgtgctgttcggccagcatttcgccggcatttccggtgcgggcccgcttgttggtcctattctggccgcccaaatgggttatctgccgtccgtgatgtggatcattctcggtgtgattttcgccggcgccgtgcaggatatgctcatgctgtggatctccgccaagcgtcgcggccgttccttcggtcagatggcaaccgacgaaatgggcaagttcggcggcactatcctgtcgatcttcctgatcgtgatgaccgccatcgccatggcattccttgcgctcgtggccatcaaggccatggcttcctcgccgtgggccgtgttctctattggtatgaccattccgatcgccttgatcatgggctgcttccagcgtttcctgcatcgtagcgttatcgaaaccacggtgctcggcttcgtgctgctcgtgatcgacatcatcgctggcggttggatctccagcgttccggcaatcgccgacgtgttcacgttgaacgccaaggaactggttatcgcactggtgatctactccttcgccgccgccgcgttgccgcactggctgctcgtcaccccgcgtgactacctgtccacgctgatgaagatcggcacgcttgtgctgctcgtgcttggcattctcatcgccaatccgtccgtgcagatgccggctctgactgaattcgcgtccacctccacgggaccgaccttcgcaggcgacctgttcccgttcctgttcatcaccatcgcgtgcggcgctctttccggcttccacggcgcagtgagctccggcctgaccccgaaggctgtggagaaggaaaaccagatccgcatgatcggctacggttccatgctggttgaatccttcaccgccgtgatcgcactgattacagccatcaccatttcccagggcatctacttctccacgaacatgtccgcctcgcagatctccaccgcttccggcgtgaccctgaccgccacttccactcctgacgagcgggctgaggccgcggtcaaggccgtggattcgatgaaggtttccgacattgaaggcaaccagatgaaggtcacttgggattctgtcgacgagaacggcaatgccaagacctatgaaggcgccgacgctttgaagcaggccgcttccgacattggcgagaacaccatcgtttcccgcaccggcggcgccaccacgttcgctatgggtatggccaacttcctcaagtcctacctcggcggtcatgactccatggccttctggtaccacttcgccatcatgttcgaagcgttgttcatcctcaccaccgttgacaacggcacccgcgtggcccgttatcagattggtgagttgctgggcaacgtgcgcaagctgaagaagttcgctgatccgacgtggaaaccgggcaacatcatcaccacactgatcgcaaccgccctgtggggtggcctgctgtgggtcggcgtgtgcgatacgaatggtggtatcaacgccatgatgcctattttcggtatttccaaccagctgcttgccgccgcatgcttcatgctggtcaccgtttgcgtggccaagcttggctataagaagtacctgtggattcctgttgttcctctcgtttgggatgtggccgtgaccttcaccgccgacttccagaagatcgtcggaccgatcagttacttcgccaccgcttccaagtatcagacgctgatcgatggtggcactttggaaggcgaagcgttggtcaacgccaaggccgcactctccaatgcgtaccttgacggcgtgctctccgtgttcttcatggtcatgatgggagtcttcctggtcgtcggcatctaccagaccgtgaagattcttgccaagggcaagttcggtgtggaaaccacgtctgaggagccgttcgtggaatccgaatggttcgcaccgtccagcctgatcgccaccaagctcgaaaagaaggtgcagcgcgaatacgcggccaagagctatgagctggcgcagaaggaacaggcagcagcctgatgcagggattcaccaccatggtcagacgaatctggtccgcattattgaaagccaaggccggattcgtctggtatgtgcgcgaattcagcggagaagcgaaatacgaccactatctggagcatttcgcaagcgaacatccctgcgaaaccccgctgaccgaacgcgaatactggcgcatgcgagaggaatacgatcgcaagcatcccaacaccagttgctgttgctgaaactaacggccatacataaacaatccccgtctttcatttcggaagacggggattgtttttcttatatttatgttgcttgcttgcgattattcctataccgaagatattcgattgcatgttccgcaatcaatatttcgcaatcaagaagcgagtcccatgctgtatttcaatgtcatcacacgaatcgcggactgcgttactttgtctgcaaaagcggaatcagccgcggccttcgcattcaaaccatccaaaacctgctgaacataatcgaaagcgccaatgcaggcaagatcaccgccggcctcaaccaatcgcacacccaaatcactcggctgaatgccacccaacgcagtggcggacaaagaatccgaagtgatgacaccttggaatccgaccgtattgcgcaaataatccgttaccaaagcgctggagaacacggcgggattattcggatcaatagcctgataggtggcaagcgacatcatcaccatggaagggttcgcctccaacgtactgttgaacgcgccgatttccgcaccgtccaacgtggtggtggtatcaagaatgccgtcggcggtgaaatcggtgttgcccgtcaccgaacccaaaccaggatagtgcttgatggcgctgcctacacccgaatccgccatgccctgaatgaacgccttggcatggtcggcattgccgtccgcatcaagaccaaaatcacgatacagtgcgccgatcgggccattggaagccctatctaccgttaccgtgcccaccaccggcgccaaatcaacattgatgccggccgacttgagttgggaaccccatacggcagccgattgccgtagctggttggtcgacattgaaccctgattggtggcggaaggcatctggtcgaacccatcaccctgcagatgctgcaccaaaccaccttcctgatcggtggtcatcaggagttgattattaccaggggcatacgattgcaaggtggatgtggcggtggccacgccagccgttcccgaattccaattgccgatgatcaacaccgatccgacatgctggttcacaatgagatcctgtaacgaggaaggatcggatcccgcatacaggggtgccatgacgagctgaccgacgcgctctgcaagactcatggcattgactgcagccacagctctgccatgcggcgagtcgtccaccacgcttggcacgttggatttgtcaagcgcatcatgtgatgcatcggactgctgcgaattggattgctcggattggttggagccagcattcaaactcgcgctggatgaacacccagcgaacgatagcggcagtgcgatggcgcacagtgcggcagcacaacgagcgaaatgaacgtgaactctcctcatagtgtcattatctatcacatgccggtgatggcgaatacgatcgcataagaaaagaacgggtggattcgtgttcgtgaattgcgtaaacattaggctagcggcataaagcacgttccgtgcctgtcgataggctattagtatgtctttttttgatatgtttggtcccatgttcgacccggaaagcggtccgaaccgctcccaagggcagcgtgccaataaatccggcaacgatgatcccatcattctcaatgtcgaaaccgatggtgataacaccgcccggtcttcggcgaacatgcctccaagaggtccgtccggtccgcgtatcacacgccagccgaaccgtccgcgcaaatcgtcgaacggcaacaagattctaatcggtgtggtgctggcgcttgccatcatcatcggcctgttctttggcttggcgcagttcatcaccgacgtcatgtggtatgcgcagcttggcttccaaagcgtgatttggacgcagttgggtaccagggtaggcctgtgggtggcgtatgcgctgctgatcgccgcggtcggattcctgtccgcgtcgctggcgatctgggctcgccccgatgctgccgatggttccacgattcgtattaacggcgacaccatcgaagtgggcaagggcgtgagctcaaagaatgcacgtcgtgtggctgtggtgatttcattgatcgtcggcttgatgttcggatcgcagtttaatgcgaattggtctgaaatcctgctgatgttcaacgcgcagagtttcggcaccaccgacccgcaattcggcatcgacaatggtttctatgtgttcgtattgcctggcttgaagctgatcatgtcggcagtgtcgttgctgctgcttgccggcatcatcttctccatcgtcacgcatgtgatgatgggcggcatccgaatcaccatgccagtgcatggtcgtggactgttccacatcaccaagcgtgcgcgtagacagatcggcatctggctgatgctcaacatgttcgcatgggcgacgaatcaggtgcttggcgtgttctcccacctcacgcaggagggtagccgcatcaccggtgccacgtataccacggtcaacgccacgattcccgtcaccttcatcatggctgccatcaccgtcattctcggtgtgattctcggcgtgtggatcatgaagtcgcatgcgttggaaggccaggctccgattgcggtgcgtgcttccgaagcgcttaaagcgtggaaggtgccgaccgtggccatcgcatccgccattgtggtgagcttggtgcttaccgtggcatggccgatgctgctgcagcgtttccgtgtgaatccgaacgcgcaggaaatggaatctacctatatccagcgtaatatcgacgccacccgtgaagcatacggtctgaacaatgtgaagaccgaacagtatcaggccactacggaaggcgaggctggtgcgttggctgattccgcggaatcgaccgcgcagatccgactgctcgatccgcagatcgtttccccgacattcaagcagctgcagcaatccaagcagtattacacgtttgccgatactcttgccgtcgacaaatatgaggtcgacggtgtgagccaagatacggtgatcgcagcacgagaacttgaccttgccggtcttgacaatcgtaactgggtcaacgaccataccgtgtacacgcacggctatggtgtggtggccgcctacggcaacaaggtgacggccgacggccagccgaagttcttcgaggcgggtattccaacccaaggcaagctcaccgaatccgaacagtacgagccgcgtatctacttctcgccgaacgcttccgaatattcgatcgtgggcgctccggaaggtacgcagtcgtgggagttcgattacccgaccggttccgaaggcgccaccaacacgttcggtggcaatggcggcccgaagatcggtaatatcttctcccgactgctgtatgccatccgtttcggctccgaccagattctgttctctaaccgtgtgaactccgaatcgcagattctctatgatcgttccccgaaggagcgtgtggccaaggtcgcgccatacctgacgcttgacggccgtgtgtacccggcggtcgtggatggtcgtgtcaagtggatcgtcgatggctacaccacgtctgacgcctacccgtattcgcagatgaccgatctgggcgaagcctccaaggattccactacggaatcttcggccacggtgagtgagctggcttcgaagaacgccaactacattcgcaactccgtgaaggccaccgtcgatgcgtatgacggttccgtggacctgtacgtgtgggacgaatccgatccggtgatcaaggcatggcagaagatcttccccggccagtaccaccagttgtcggagatttccggcgatctgatgagccacctgcgttacccggaaagcctgttcaaggtgcagcgagaactgttgaccaagtaccatgtgtcgagcgccagccagttcttctccggtgaggatttctggcagactccagtcgatccgaccgaatcccagcaggctcaggaacgcgacattctgcagccgccgtactatttgacgctgcagaccggtggatccaacgaaccggtgttctcgttgacgtcgtcgtatattcccgcaggcacgtcaactcgagagattttgacgggattcctgtctgtcgattccgatgcgggccacgaaaaaggcaagatcggcgcgaactatggcacgcttcgattgcaggagttgccgaaggattccaatgtgccaggccccggtcaggcacagaacaacttcaatgcgtcggccgacgtgtcgaaggaacttaatttgcttgaatccggttccaccaatgtgcagcgaggcaatctgcttacactgccgctcggcggcggattggtgtacgtgcagccggtgtacgtcaagtcttccggttccaccagtttcccgctgttgaagaaggtgttggtggccttcggcgaccaggtcggattcgccaacacgttggacgaagcgctcgatcaggtgttcggcggcaactccggtgcatccgctggcgatgctgaaaacgtcgacggctcgaccagtggcaagactgatacgtccgataccaacggcgatgcctccaccgatggttcttccggaaccgatggcacggattcgtcatctggaacagactcgggcaatgacagcagttccggcaataccggtagtagctccggcacgatgagcaacggtctgaagagcgcgcttaacgacgcttcccaggcaatgaaggattccgacgcggccatgaagaaaggcgattggtccgcttatggcgaggcgcagaagaaacttcaggaagcgttgaacaaggcgctcgaactcgagcagtagtttccgcacaagttccgtacgattgctgtttgcataaggcgggagactggttccatatggagaaccggtcttccgccttatgcatatgcccggtatgctcaaaaacatgatcgagtattcctaccgcatcgcaacgcaaaacgacattcaagcaatcaccgacatttacaacgctgcagtcatacgaggtggatcatcggccgatataactccacgcacatacgaacagcgcaaagcatgggttgaatcgcatcatgatccgtacgcggtgttcgttacggaaacggtagatgatgacggagagaggcggatcattggattcagcgcgctttccgttttctacgatcgcgcaggatacgacggcgtcaccgatctcgcctattatatcgatccgcaatggcagggcaggggagtcggtacatacacactcaccaaactgcttgaagaatgtcgaaagcgtaatatgcgtaaggcatgcggcattattttcgcagacaatgccggttcgatcgcactgatgaaacggttcggttttacacagtttggcctcatgccaactgccgccaccgattccaccggcaccatgcgtgacatgagttactggtatctcgacctgtaagtacaatctttgcggttatcaagacgagacaacgtgacgcaatatgaacgcgcacaaacgtacgtatgaatgaatggaacgatttcaatggcatctgatttctggttgatcgcaggacttggcaatccgggatccaaatacgaaggcacccgtcacaatatgggatttatggcggccgatctgttggccgaacgttggtcggtcaacttttccgaccataaagggcttgccatgctcggcaaaggcgtgatgaacctgtctggccgtaacgtcaaattcttcctggcaaagccgctcacctacatgaacgagtcaggcaatgcgttggcttccatcagtgcctactatcagattgaaccagaccatattgtggtgattcacgacgacatggatcttgatttcggacgtatcaaagtcaaggcaggcggctccgcaggcggccataacggcatcaaatcaattgatcgtgccttgggaacgccaaagtatgcccgagtgcgcatgggagtcggtcatgcgcaacgcggcgcccacgcccacgacaacacggtgaattgggtgctgggcggattcggtccggatcagcgcaagcagcttccggaattccttgccgacggtgccgacgcggcggaaaccatcatcttcaacggcctcgccaaggctcaggagcagttcaatggccgctgaaccggtgcaactgccgacgtcaggttcgctggctggcattctcgacgtactcgaaaccgatgaggattttcgtgcgctgatttccgatgagatcgaagtgccggaatccgacatagaccccagcatcaccgttggcgttcccgaaggattgcgtccggcgctcgctgccggggcagcgggaacacgaccggttgtgcttgtggtggcttccgggcgcgaggccgaggaaatggttgaggcgattcgttcgtggtattccggcgatccaaacgatgtggcacagcttgaagcgtgggaaaccttgccgcacgaacgtctttcgcctcgcgccgataccgtggcgagccgtatggcggtgttccgcagactgatgcaccctcaagagggaagcaagctgtttggccccatcaggattctcgtcatgccggtgcgttccctgattcagcctgtggttgcgggcttgggggatgtggagccgctggtgttctcccaaggtgaggagttggcgctcgatgaggcgtcgcatcgactggtggagaatgcgtatactcgagtcgacttggtgatggatcgtggtgaattcgcagtgcgaggcggcattatcgacgtgtttcctccaacattgccgcatccggttcgtatcgaattcttcggtgacgaaatcgataccatcaaggaattccatgcatccgaccagcgtacgtatggcagtgacattccgatggtctgggccacgccatgccgtgagctgcagctgaccgaaaaggtgcgcgtgcgtgcgaaatccctgatcggctccattccaaacgccgaagacatgcttgaatccattgccaacgccattcctgtcgaaggcatggaatcgttgcttcccgcattagtcgatgatatggaaccggtgcagggcatgcttcccaagcgtgcgttggtgatgctgtccgatccggaaaaattgcgtcgcgctgccgacgatcttgccaaaacggctaatgaattccttgcagccagttggcatgttgctgcatccggtcatggtgccggtgctccaatcacattcgatcaggcgaatttctacgattttgaggaaacgatttcctcactggtgttctctaggcatgacgtatggaagcttacgagtttcggtgtgaactccagtagggaaggccgcgttcagctcgacgccaccaatcctggagaatatcgcggagatgaggccaagacagcttccggtatcgaaggtcttcttgatgccggctatgccgtcaccgtcactgcaggagcgcaaggcactcttgttcgactcaaacgtgccatcaacgaaacgggaatcgccaacttcgactgcatcagatcgcgtgccatcgacggattcgtcgataatgccgcgaaagtcgcactgcttaccgaacgcgacctgaccggacgtacatcggccgcgggacaggcaaaaacacctaaacgtcgccgtaaggccatcgaccttatggagctcaaagccggcgattacgtggtgcatgagcagcatggcatcggcaggttcctcgaaatgcgccagcgtaccatcggagcgggcgccaaccagaccacacgcgagtatctggtcatcgaatacgcatccagcaagcgcggcgcacctgccgacaaactgttcatccccaccgaccagcttgaccaagtcagcaaatacatcggtgccgacgctccaaaactcaacaaactgggcggatccgactgggctgccaccaaggcgaaagcacgtaagcatgtgcacgaaatcgccgaagatctggtcaaactgtattcggcacgtcaacgtatgcaggggtatgccttcagcaaagacaccccttggcagaaagaactggaagacgctttcccgtaccaagaaaccgctgatcagctgaccaccatcgacgaagtcaaatccgatatggaaaagcccgtgccgatggatcgcctgatttgcggcgacgtgggattcggcaaaaccgaaatcgccgtacgtgccgcattcaaggcggtgcaggattccaaacaggtggctgtgctggtgccgaccacattgctggtgcaacagcatttcgagacgttcaccgaacgttttgaaggattcccggtggaagtaagggcgatgagccgtttccaaaccaccaaggagatcaacgacaccatcgagggacttgaagacggttccgtcgatgtggtgatcggtacgcacaaactgctcggaccgaaggtcaaattcaaggatctgggactggtcatcatcgatgaggagcagcgtttcggcgtcgaacacaaagagacgttgaaggcgctgcgtaccaatgtggatgtgctgagtctgtcggcaacaccgattccgcgaacgctggagatggccgttacaggcattcgtgaaatgtccacgttggccacgcctccggaagaccgcttgccggtgcttacctacgttggcgcgtatgaggatgctcaggtcactgctgcggtcagacgtgagctgttgcgcggtggccaggtgttctacgtgcacaaccgagtgcaagacatcgcttcggttgccgcgaagattcacgagctggtgccggaatcgcatgtcggcatcgcccatggcaagatgggggagaagcagcttgacggtgtgatccgagacttctggcatcgcgacattgatgtgctcgtatgcaccaccatcatcgaaaccggtcttgatatttccaatgcgaatacgttgatcgtcgatcatgccgaccgtttcggcctaagccagcttcatcagttgcgtggtcgtgtcgggcgaggccgtgagcgtgcctacgcgtacttcctatatgatccaaccaagccgatgacccagcagtcgcatgaccgactggccaccatcgcgcagaacactgcgctcggttcaggttttgacgtggcgatgaaggatcttgagctgcgtggcaccggcaatctgctgggcgacgagcagagcgggcatatcgagggtgttggtttcgatctgtatgtgcgcatggtgtccgaggccgtcgagcagtacaaggaaccggaacgtacggaatcggttgctgtcaccatcgatctgccgatcgaagcgtccattcccgtcagctacatcgattccgacaaattgcgattggaagcctaccgcaagttggcgggtgctcgtacggaagccgatcttgacgagttgcgtgatgagcttacggatcgttacggcaagcctccggtcgatttcgaggcgctgttcgatgtggcgagacttcggttcaaggcaaggaagttgggcattaccgaaatcatcgggcaaggccgtaacgttcgtgtcgccaaattcgagccacgagaatccgtgcaaatgcgcatggccagaatctacaagggcattcaataccgtccgatgactaaaacatacctgattcccgcgccgttcgcaggttcgctgggatctggtccaatgagctctgatgaaatcgttggttggacgaaccaattgctggatgaccttgactggaagccaacgccaaagaaatagcaggtgaagttccagacgcatccgacacgatttgtgtgagcgttcacacaaatcgtgtcggataagtttgccatacgtccacaaaacgcactattctaggcaatgtcatcacaacctaacgtttataaggagtagttgtggcagtaattgaaagcgtttacgcgcgtcagattctcgattcccgcggcaacccgaccgttgaggtcgttctcgacaccgaagacggtgctcagggcctgggcctcgttccgtccggtgcttccaccggtgaagctgaggcttgggagcgtcgcgatggcgacaagtccgtgtatcagggcaagggtgttctcaatgccgtcaaggccgtgaacgaagagatcgctccgaaggtcatcggcatggatgcttccgaccagcgcgctctcgatgaggtcatgatcgagctcgacggcaccccgaacaagggtcgtctgggcgccaacgccatcctcggcgtgtccctggctgctctgtacgcctccgctgagtccgcgggccagccgctgtaccgctacatcggcggcaccaacggccacatcctgccggttccgaacatgaacatcatgaacggtggcgctcacgctgacttcgccaccgacattcaggagtacatgatctccccgtacggcttcgacacctacagcgaggctctgcgtgcaggcgttgaggtctaccacaccctgaagaacgtcctgaagaaggaaggcctggccactggcctcggcgacgagggtggcttcgctccgaagatgaagtccaacaaggactccctgaactacatcatggacgccatctccgccgccggctacgagccgggcaagcagatcggcatctccctcgacgtggcttcctccgagttctacaacaaggagaccggcaagtaccacttcgaaggcgacgatcgtgaagccggctacatgctcgacttctacgagaacctcatcaacgagtacccgatcgtctccattgaggatccgttccaggaagaaggctgggaagactgggctgccatcaccgccaagctcggcgatcgtctgcagttcgtcggcgacgacctgctggtcaccaacccggcacgtctggctaagggcatcgagctcggcgccgccaactccctgctggtcaagctgaaccagatcggtaccgtcaccgagaccctcgacgccatcgagctggccaccaagaacggcttcacctccatggtttcccaccgttccggcgagaccccggacaccaccatctccgacttggctgtggcaaagaacaccggccagatcaagaccggtgctccggctcgtggcgagcgtattgccaagtacaaccgcctgctcgagatcgaggaggagctcggctccaccgctcagtatgctggctacagcgctttcaaggcctgcaagaagtacatcgccaagtgagcgtaagcgcatcgaatatgcgctgatgtagagtgcccgtcgtgttcctcgtcgaacgcggcgggtattttcattgctatgagttcaaagtcacgcaagaaagcatccagaaggggcagcgctggccccatcgcgttctttgtggcggtatttatcgtggctttgggatccatccagctggcgtcgacgttccatacctatgcgctgaatatggctgaattgaatggcttgaagaagcaggaagctgcgctgatagcgcaaaagcaggaactggaaaacgacattgcgcgttgggatgacaaagcttacgttacagcgcaggcaagggatcgtctgggattcgtatttccaggagaacaggcgattcgtgtggaacatcccgaagcggtgaccggcgaaaccacagaagatgcaaaaaagacggatgaatcgcagaaaaccgtactgccttggtacaaggagatggcgtattcgttcaaacaagccgaccaatcggacgaagtgaaatcgaaatcgagggaaacgtccgaaagtacgtcaaccggtgaatcggatgcgaatggaacaagccaggaatccggtggccagcagcagacttcacaagacaacaaccaacagcaatcaggagatcagcaggagtgacacagggtatgacaatcagcgaacaggccaaaaccttggcgaagaaggttctcgaccagcctgccaccgagcatgatattgctgtggtcgagcgtcagctgggtcgttacccgcgtggcatggtggctgtcggagcacgttgcgtgtgcggcaggcctttggctgtggtcacgcgtccgctgctgccgggaggtgtgcctttccctaccacttgctatttgactggcccggaagcggtgaaagccatctcccacatcgaagccgaaggcaagatgaaggagtacaacgatcttttggctgaagatgacgatctgaaagccgcctacgagcgtgcgcacgaactgtatttggcgttccggcatgaaatcgccgttgctatggaagacagcgaagagcatatcgaaggcaccagtgccggcggcatgcctgttcgcatcaagtgtctgcacgccttgctggcgcaaacgctggtgatgggtgagggcgccaatccgatcggagacatggcattggaggcgattcgtcatgaattcgaccccaatgtatgccgttgcacggtggaaaacgaagactgaaccatattcagacagaaagaagaagcaatgaaatccgttactgttgccggcattgattgcggtacgaactcgattcgtctgaaggtctcccgagtcagcgaagacggcgttgaagatattgttccgcgtattcttcgtgtgattcgcctcggtcaggatgttgataagacgcatcgtttcgccgatgaggcattggaacgtgcctacgccgctgcccgcgaattcgccgaggtgctgaaaaagcatccggtggatggcgttcgtttcgttgccacttcggccactcgtgatgctgagaaccgtgaggaattcgaagacactatcgagcagatcctcggcgtgcgtccggaagtcattcccggtacggaagaggctgatctaagcttccttggtgccacgagcgtggttcgtcgcgacgtcgaagctccgtatctggtggttgatttgggtggcggctctacggaattggtgcttggcggcgatggcgtaagccatccgaacacgcaggtgcaggccgcgttctccatgaacattggctcggtgcgtatgaccgaacgccacttgaagaacgatccgcctaccgaagcgcagattcaagaggccattgccgacatcgacgagcatatcgatgaagcgttcaaaacggttcctgcaggcaaaacccgcactatcatcggcgtgtctggcacagtgactaccatgaccgctctggccatgggattgaccgaatacgaccattccgcggtggatggtgccagctgctcgctggaagacgcttatgcggtcgataacaagttccttacgatgccgcgcgaagagcgcctgacctacaaaaccattcacccgggtcgtgttgacgtggtcggcggcggtgcactggtgtggaatcgtgtgctcgccaaagtcagcgaagcggcctatgccgaccatggtcagcatatcgactccttcatggccagcgagcacggtttgcttgatggcattgtgttggattacggcacgcgattgcttgccgaacgttaacgtggcataatgacttgggcgtcggcttgttcgatgccttgccgccatggcgaaactggtatacgcaaccgacttaaaatcggtctcttcggattgcgggttcgattcccgctggcggcaccgaatgacgttgtgaaatattgctggatagcacgtacgaaacaatccgttattacactggcggcattgataaccccaagtagccgactggaacggaaaaagtatgacatcgaaagatatcaagccagtaatcgaacagcccgatacggaaattccgctgatgctctcccaagcgattatcgtcgcaggagttttggctgtgggcgaactggcttgttctccgctgtatttctcgttgttgaaggcgtcgttggcattgattccatgggctatggaagcggtgttcatggcagtggcgttcacgttcgttgtgggctttgcgttgctgtggtgcgccgaatcgtttacgatcaaaatgcgtgaacggtttcgaccgttcgcatatgcgattgttggacttatcggttacggcgtgtggagtctgctggtgttctccgccaccatcaattccgtgcttgccatggtgggggagagtgtgctcaccaatggccagattggtgcgattgcgttgaatggcgcagcgcttggtttcgtcgccttcctgttcgccaagttacttgacgttaaactcggcaatcgtaaaaccacggccattatcatgctggtggtggaagttacggccgccatcattggtttgatcattatgattctcatgttccgtgcattgtatgcagcctgagcaaggcacctgagaagcaaggcgacgattggtatgttcagtattctcgaaatgttcaagataggcgttggaccaagttcctcacatactgttggtccgatggtggcggcatgcaaatttgtcgaatcacttgaacatacgggaacgcttggccgtgtgagccgtgtgcgtacggtactgtatggatctcttgcgttgacgggtttggggcacggtaccgatcgcgcgactgtggcaggtctggaaggtaacatgccgcaaaccgtcgatacggaccatgtgaacatcattcgtcatgaatgcgagtcgagtggggaactgctgctggccggtaagcatcgcatcgatttcgactatgcgcatgatgtggtgatggacgtgtggcatcgcttggccgcgcaccctaatggcatgcgtttccaagcatttgaccagcagaacaatcttgttgacgaacaggtctggtattccatcggtggaggcttcgtacggcaaggcaatgccgaggatctgatgatcggcattcatgagcgtccgccgatcggaacgtctttcgccgatcagcagagtgattcctcacttgatgacggctcggatgtgccatatccattcacgtcatgcgacgatctcattgcattatgcgagaagcaccatatgagtatcgccgacattgtgtgggccaacgaaacggccatgcagtcggcggtgcaggttcgcagcgaactggataacgtgtggcgggtgatgcgtcgttgcgtacagcacggatgccatacgtcgcagaccgtgttgcccggcggtttgaatgcgccccgcagggcaccgaaaatgtatgcaaggcttgcctcgaacagtgatgtgcttgcgcgagacaagaaacgcgcggatgcggtgctcgaatcgtcggatgcggcatgggtggatttgttcgctttggcggtgtcggaggaaaacgccggcggtgggcgaatcgtcaccgcaccgaccaacggtgctgcaggaatcattccggcagtgcttcactattactggcatttcgttgaccatgcgaacgaagagggtgttattaccttcctgctcactgcaggcgcggtaggatacctgtttaaacgcaatgcctccatttccggtgcggaagtcggatgccagggagaagtcggtacggcatgttcgatggctgcggccggtttgtgcgcggtgatgggcggtactccacagcaagtggagaacgctgcggaaatcggcatcgagcataatctggggctgacctgtgatcccgtgggaggtttagtacagattccatgcatcgaacgcaacgccatggctgcgaacactgccatcaacgcggttcgtatggccatgctgggagatggaacgcatatcgtgaccctcgatcaggccattaaaaccatgaaagacacgggcgaagacatgatgtccaagtataaagaaacctcaaaaggtggtttggcggtcaatgtcgttgaatgctagcggtggttggtgctagtctaggtggcattgtgcttttcaaggaggttcaccatggcatctcaaatgcccgttgtcaatgttgagttcggcgatcgcccgaccatcgaattcccgtctgagaccgctccggcaggtctgaaggttgtggagctgctcgagggcaatggcccgatggttcgccgcggcgacaccgtcaccgttaactatcacggtgtggtctggggcaaagacaccccgttcgattccagcttcgaccgtcaccagccggccagcttcggcatcggtgtcggccaggtcatcaagggttgggaccagaccgttccggggcacaacgtcggttcccgcttggtggtatccattccgccggagtatggctatggttcccgtggcgttccgcaggccggcatcggcggcgaagacaccctggtgttcgtgatcgacatcatctccacccgctgaaactaagcggcatagagtaatttccaaggtcaaggaggcaacatggccgaagaaaaaacgcttctgctgacgcaggaagcttatgacaagatgaaggaagagctcgcttggcgcgaaggcgagtatcgcgacgaaatcctttccaaggtttccgcggcacgcgccgagggcgatttgagcgaaaacggcggctatcaggccgctcgtgaggctcagcgagtaaatcagggccgcatcgaggaactgaccgtcaagctgcgcaacgcgaagattctgaccgcgcccaaggccggcgaagtcggcgacggttctttggtgacgctggatgtcaacggacgtgaaatggtctacgtgcttggcacgcgtgacctgtccatcgccacggactacagcatcatcagcccggaatccccgatcggcgcggccatcaacggcgctcacgagggagacacggtgtcgtatacggctccgaacggacgtgagatttccgtgaccatcaaggaagccaagccgctcgcctgagtgatgttcgtcataagctgaatctgatattccagcgatataaatacaaggctggttcacgaatacaacggatgaaccagccttttcgtatatttcgtcaaactgcaatcagatatgatctgaacttacggccatagctgcacgatcaccatgtagatcgccaccatatggcatgcgtaaccggcaacggtgccgcagtggaaaatctcatggaagccgaacaccttcggccatggatcgggcttacgtagcgcgtatacgatggctccggcgatatagcaggctccgcctgcggccaacagcaccacaaccgccggaccggcatatggcgaaatccagaacaatcccatgaatgccactccggaaacaccgaaaataatatacacaatcacgtaaagccagcgtggggcgctgatccagatgacgtgaatgatgagcgccacggtagtgcagatccacatgcccgcgatgattgaattgcgccagaacggttcgagtgcaaaggagaccggcgtataagtgcctgcgatcagcaggaagatattcatatggtcgatgcgtcgtagcacatccgtgacgcgaggtgaccaatcgcccaaatggtagcaggcggaattgccgaacaataccagcgaacacgtcatgaacacggcgcaggcccacttcaaaccggtaccgtgtgccaggcagatcagcacgatgccggccgccaatgccagaggagtggccacggcatgaatccagccgcgcatcgccggcttggggcgaccatgcacgtcaagacgaatcttacgttcgatctccgtcggagtgatgccttctattttcgcggcacgagcttcgcccttggctatagccattttcgccttgccgtcggccttcttgcggatgttctcggccttgttgcgtgccttcacgcgaataatatcggccttggcttgaagggcctgttcgcgtgcctcggcgatgatcgctcgtttttcctcgatctctacgtctgtgggtttcgccatctgtgtgcctccactgtaagttacggaaccgtaacctacgttaccgtaactcatggatatgtcaatattgcttttcctgcaatatgcgtcgtgtcgtgcaaaacctctggtgtgatgcgtatgatggagcgcatggctgatttctcacatatcttgacgacccgtcccgatttcgatgacgaagatcgtgaatggctgcatcatctggtcgccgactggcaggtgatcgccgacctgagttttgctgatctgctgctcattctgcaaaatggcgagggcaaatacattattgccgaacagtgtcgtccatccacggtgatgagcctgagggccgacgatgtggtcggcgacgttgtcgaggaggaaatgagcgctgaattggatgccgcgatggcttccgaatcggtgttccgttccacggtgctccgcactgtgggcgagtccacggtgtgcaatgtgtatgcgccggtgcgtcataatggcaagacgctgggcttggtggtacgtgagacgaatatggccacccgggagtcgaacggacgttacgaatccgaaagcatcagcgcaggtaagcagctgtatgagatgattcctcgcggtcagttcccatatcgtaatccgattatgaaccagcgtcacaatgcgcgtgtggcggacggcttcatcgtgctcaccgtcgaaggtatcgtgcgatatgcttcgccgaatgccatcagctgcttccgacgtttgggatcggtcagcaccatgcagggggagtatctgagcgaaatcggcaccaaattgctgcgcgagaacgatcccgtgctggaaaccttgcctctggtgctcagtggcaaagccgccgtcgattccgaactcgatgccaacaagtccgcggtgtccatgcgttcgctgccgttgatggatgccaatggccgcgttggcgctgttgtgctatgtcgcgacgtgactgagcttcgccgtcgtgaaaaggaactgcagaccaaggatgcgacgatttccgaaatccaccatcgcgtcaagaacaaccttcaggcggtttccgcattgctgcgactgcaggcacgtaagaccaagtccgaagaggtcaagaaagagctgaaagaggcgcagcgtcgtgtacaaaccatcgccatggtccatgaaggcttgagccagaccgccgatgaaatcgtcgattacgacaaggtcatttccagcctgttgaagatggcggtggatttggccaccatgcgtgaccagcatatcgacatcgacttcatcggcagattcggcatgatgccggcgcaggatgccacgccgttgtcattggtgctgaccgagctgatcaccaattccgtggaacatggcttcgaaggtcgcaaagaaggtcatatcacgatttccgtgggacgcggcggcaacaacctcaatgttgtggtcgaagacgatggcacgggcttggccaatgaggagcatgatggtatggcacgttcctccggatccggtttgggaacgcagatcatcagcacgttcgtcaacaacgatttcggaggcacggtccgttgggagccccgtcgtggcggtggcacccgagtagtgctcgatatgaagctgcgtgcggcgcaggaacgataggaaagatacgaaaatgtccggttgaccaggggaagtcaaccggacattttcgttgtaagtcgctattcgcagagcgtatgcaatgatggatctttgaaaatttcagatctgcatctgcatggcttgggagcggcgggcacgcatggcacggcgcttgagcgcacgacgttcgtcttcgctcaaaccgccccaaacaccgtaatcctgattggtgtcaagcgcgcacttcaggcacgcgtcaatcaccttgcaggtgcggcagacggccttggcctcttcgatctgctgataggcggcgcctgtattgccgaccgggaaaaacagctccggatccttgtcgcggcatgcggccttggcgcgccagtcaaaagcactgctcatataatcgccttcctcttgccatgtacggcatgtaagtccgttactcagataaccacgaatcgcgcgacttttcaagagtcttcgcgaaaagaatcccacgaatcgttaaaaaccttggaattccacgcactgaatagggcatgctttggcctgttgcatgagcacgccacgacctgggagggtatagtcgtcggctgcgaacccgtccagaattgcgccgggaatgccgagcatcagatcgttggaacgttctccgcaggggaacgccacacgagtcggacatcggtccagcagtgcggaaataggtttttccaccgcggcaatcactgtgatattgggattgaccaacgcctcacgcaattcgttcgcttcaggcgcagaggaaaagggattaagcgcttcgtccgcatcatccacaatccagatggttcgcttatgcgacggtaagggtttgccgtcatccgtcaccatgccatgttcggttttgcgtgtgaaacgaatattggcgcaacccgtgtcatatagccagcgtgcgcaatgcaacagtagattggttttgccgctgccgtaggcaccgatgatggcgatattctgttggctcacgtcaagaatggcggtatacaccaatacgccatcgtcggcaagcgcaaagggaacgttatgccatgactggtttgatgggatggaaagatcggattgcgttgcatgttgcgtgagaggctcggaaaacaggagatcggggcgtttgcaggcgtggaatcgtgcggccgttccaatattacggacaagtcggttgacatcgcggaccgcgctgcataggaaaggtgtggtgtgttgtccgtcattgcaataggctgcaccgggaatgctgggaggaatcagcgctgcgtcacgtatgccgatcaattcgttcgactgcatttggtctgtaacccgtaagcatatgctcagcgagatattggctttcatgtcggcatggacttggcccatgggatattgcgtgcagacgatcagatgcatgccaagggaacggccaagtgacgcaagacgattcagccgttgcatatagtcgggcagacggtctcgaagcgcatggaattcatcgatgaccacaaccagtcgtgccggaggccggaccaattggtcgaatctggaaacacgttcggcgctgaccagagcctcacgacgcaccaattcctgttcaatggcattcaacgcgcgaatcgcgtggaacaaatcaagatcgcagacattgccaacggtgtggggaagatgttccaaagcgttgaatgtcgatcctcctttgaaatccaaaaacacaaaatgcagatcatcagggctgtattgcatggcgagcgacaagcaccaactgatgagcaattccgattttcccgaacccgtggtgcctgctaccatggcatgcggtcctgatcgttgcagatccgtgcgaaacaagccatgctccgtgactcctatagggcaggatgatgtggaggaaagccatgttcgtgtgatggtgcgccaaggcagcgcgtcctcgtccagagcgtagaatcgctcgaaacacatatggggcattgcggcgaacggcgaatggctgttttgccttgcggtctccaccacctttgcataggtggtggagaccggttcgtcatgctgctgcttctgattggaacgcaacgccatggatgccagagacaacgcgctgctgatgagtccaggagcaagcatggccacatatagccattgccgttgcgcgctcattatgacaagcatgacgagctgtgccagcacaggtgcggaccaactgatgagcatcagccggtcttcattgaatccatcggtatgcttgcgtttgttcttgcccttcatacccgccatagtgggcaatgcggatgagcgggtgcaagctgaaaccagggttgtggtcggaggatgagttatccacatcctccgaccggaatatcagccctgctgttcggcaagcgtgcctacagtgccagcccgatgggtccccttagccaattcggagaacaattcgaggttcttctcctcatccaacagcacgcttgagccgacaccatcaacgtagtagtcgggatcggtccaataaacgcttcccgaaatgccttgatccccagaagcgcttttgaacgccaaagccatgcgcatcagcgatgaggtcgaagctttctcatccacggtcacggagcttaacgccgcttccgcgacttttttgaccttgccgaagttcagaagcgtatccttggatgcgccctttttcactatggcgttgatgacctggcgctgacgggccgcacgcccgaaatcgccttgcgcgtcggcgtaacgcatacgagagaacgcaagcgcggtggtgccgtcggcggtatggcagccggcagtccagttcaactgggagtacggatcgcttacatcctggtcgtagcataattcgacgcctcctaaagcgtcgaccactttgaccaggccgccgaactgcaccattgccacgtggttgattttttgcccggtgatgtcttcgacttcgttaaccagttgtttgccgttgtacagttgggcgacggcgttgattttcatgtaactctggtcgatttccaccaaggaatcacgcggaatggaaatcagtgaggaaggtccggatttcggtttggtgagtaccagaatggtgtctgttctgaaaccggtcacgtcgccagcgtcaccaacggtgccttcgcgttcgtcggaaccgaggatcagccagctttcgccagcggtatcggctttgttcgtcaaccaagactgtttgttgagctgtccatccacccaattccatgcggagaatatcgacagtcccaaggcgagaatcacagcaaggaaaaacgcgagaatgacccgccccatatgtcgttttctgtgggggagcacggctttcgcagtggattggaatcctgttgtgctattgccggacaaaggttgtctgggcgtgttctgtcgcgttgttcgtggcatgccagtgggtatggaggaggatcctcgtacctgctgagacgcacggtgattgttcggagctgaagcaggagcaaacgatgcaggagacgatgatgccgacttacgtggtctgctggtggagtttgcggcaggacggaaactctgtggaacgctggaaccggatggagttacggatgatggttgcgctgtacgcctgctggcgtgcggggcacttgagcgcgctggctgtgcggcaggcgaaaaacttggaattgacggagagccggattgagaaggaattgtggatttgtgaggctgtgattccgtcttcttccgtcctgcggacgggatgaagctcggtggtgcgggcatggggtccttgccgccgttctcttcactcatacaaatatcctccaaaaagaaatccgttcctacaccatttacaccgtgcaggaacggattcggtgaaagcggtctagttctttgcgggaacggcacaaaccgtcgcgttgaggtaacggtcggcaagcccgatgtactgcccggtaagagcgtcatgaatggaaccatcttcagggtcgaccgtgccgccggtgttcggatcgatcagcgtgccatcggcctgcgtgatcagaccagtgaccggatcgggtgttggcgcggcttcctgggaacccgtgttgtcagtgcccgtattatccgtattgtcagtgccatccgtcgaattatcggaagaaccgtcggaattgcctgcggtattggcatccgtgttcgcgtcggattcgtcggaaccataaatcggcttgtccgcgcgcatcttctcccatagcgtctccgcctcatcggtccagaccgaacgattcgggtccgacggcgcggatactaccggaacggtctgcgaatacaggctggacagattgaaatccttgaggctcatggcaagacctgcaagcgctgcggtatcggccatgccttgcgagatatagagtgattgcaaggctgatttcgctagctggtagagctgtgcggtgtcagtaaagaggttcttgctgagcgcttcgttcatcaactgtttgatgaggtattgctgtctggttgttcgtgatgtgtcggatccgtctcccagaccatggcgggttcgtgcgtactgcgttgcctggtgtccgtccagatggtgcaggcccttggtgagttgcaggctggtgtaggggtcgtcgacgtcctgtgggatgcacaggtcgactccgcctacggcattgatcattttgaccagtcctgcgaaatccacgacgatgaagttttgaatgttcagtccggtgaggctgttcactgcattcagggtgcagcttgcggctgaagcgagatcgccgccggtctggtatgcgttcgcgaaaatcgagttgaacatcacattgtattgcgcgggaatcgtgccgttggtcgtttcgcactgcggtatgtccactagggagtcgcgcggaatggaaacgagattgattttggtgcggtccgcggaaatctgcgccaccattgtggtgtcggcctgatggttgcctaccacgtcgtcgaagttgcctccgacggactggttctcttcgccatcgcgggaatcctgcccgataagtacgaattcgatgggtttgccggagttgggatcgatgatcgaggtgttggcgtcaagtgagccttgtccgatgatttcgaccgaatggtctttgatgatgccattcacatccagccatgttgcggccgctgcggttcccgagaacaccagcatcgccgcgatgaccgaagcgactatcgtcctcgcacgatgctgcactcgatagccaaggctgtgacgcggctttgcgtctcgcagtccattgacgttaggaagcttatcgccggctggtgatgtggtcacggtatcgccttcctgtttatacaaaagatcacgccatatctcaacgcgttctagaacataccactactctgtcatgggattatagagatgttccccgattttcacggattctgcttcaggcccccgtcgttcttggaggtaccatgtaccatatttttctcgaattatagtgattgacacggcggaaaacttgacaaaaagaaattgcatgtgtgtaatttaacacgactaaaagtgcgcatacgtatagcaggggaggacgcatgtggggcgtgatcgacgagtcctccgataatccgcttgcggaactgtggggtctgttcaaaagcgatgatgatgtttcctggcagcatagggctttatgttctcagactgatccggaagcgttctttcctgaaaagggcggatcaaccagggatgccaagcgagtgtgcgcccagtgcgaggttcgtgagcaatgcctgaaatgggccatcgagcatgatgagcgtttcggcatttggggtggcatgagcgaacgtgagcgccgtcggtataagaaggaacacaaggaacgggcataacgcacggcacaccctgtgcgtacacttgaaattatgaattctaacgccagcagcgatatccagggaattgtgaccgatctgctcaacagcaggccgtactcccatcggcaggatgccgattcatccgtggctgcggtgattaccgcgcaaagcgatctgcgttttttctcatccacttttgccgcggtgctcgcacagcgtgtgcttccaggcactattatcgttgcggattgcaccaatcaggttgagcagcctatgcagatgacgtttagcgttatcccgtcgcctgccggtgtgcttacggaagttcccgaaagcaagaccatacgtgtcattctcgtaggagtgaagggtgcctcttcattcatgaatgccgtggctcgtgcaatgcaacagatcgatcttgacgaccgggtcggtgctctgtggacattgcatgacgattccaggccggccgatgagtcatgccttgaggtgttgctcgatgcttggaaaaacacgccgactgcgtctttgcttggcgcgaaacagttggattggcaggcggaaagcctgcataacgtcggtttgtatgcggggcaccacaatgtcacgtctctggtggtggacggtgagccggatcaggaacagtatgatggccggcaggatgtgttggctgtgtcgctttccggcgcgctggttccattggccaccttgcgtacttggaagggtgccgatccatggttcggcacgttcgccgaatccacggacctgtgcaggcgcatctgcctgggcggtggccgtgtggtggtggtcccgcaggcgcgaatcgcccataggagggcaagatttgaaggcgtgcgttccaaaaacggccaacctgttgaagatgaggaaggccgcgtcgatccgtaccttgcggtacgcgaggcgaatacgaaatacgcgtatacggacgtgcatcgttcttggtggccgctgctgtggatctggtcgatactgaaggcgttgggactggccgtgctgtgcctgacgcgcaaacagccataccatgcctgttgcgaattggccctgccttggcgttcgttgctccacttgccgggcgcatggagggcccgtgcccgattgcgtgagcagagtagggtctccttgaaggcattggccgcattgcagacgactcgtcagcagatcggccaatggaacgatcgcaagcgtgcgtttcttgaccagcgtggcactgtgatcctcagccctcttgccaaggcgcatctgcgtaaaaggctcatgcgcaggtgggggcttgccatcgcatcggcggtgatcgcgttcgcatggatcgtcttcctatattggaatgtgcttcggagcgtgttctccggcgcgtcgatatattctcaaacgttgctgccgaccgatgccagtttcagccagttggtgcatgccgccaccacgtcgtgggcgtataccgcgggaacgggaatcagcgccccgagcgcgccttggctgctggtgctcatggtggtttccgtattcacggctggccatgttgcgaccgcagtcgccgtggtgttcttcttgtccgctcctttgatggtgctgtcgttctgggctttggctggaatctttactcggtccgacacggtgcgttgcgtgatcgcgttggcatggttcgccatcgcattgtcgatgaacgtgtacagcgatgccgacgtgacgatgatgacggtcatggtgtttcttcctgcggccttcgcgttttctttccgagccgtaggcatgtaccgtacggaagatctggtcaatccgcaggcttccgtgcaggccgcggcgcttgcggcattgtgctttattcccgtcgtcgcggccgaaccgcaattgctgctgccgctgatgttgtcgttccttgtgttcctgatgcttgtacgctcccatagaacgacgctgctgctgattccgctgccggccgcttccgtatgcgcgcccacattggtcaacacggtacgtttcgcaggagcaggtacgtggcgtcagatttttggcagtgtgatattgccgtcgtctgcgcatgatgggcatccgatgatcgcaaatctttcggatattgtttcccgtgcgttcggcgttgccgtatccggcgagatttggcagtatgtggctgctgcaatgttggcattgattgtgcttcttgccgcggtatcgctgttcctgccattcgtgcttcgcgtgtcgcgtatgatgtgggtcgtggcgatcgcgggtcttgccacgtcgctgctttccgccgcggttgtggttgcggtcgatgcggatggcgccgtggccggttccgtgcttcccggcgtttcattcacgatgatgggactgctgtcttgcgtgtgcatggtcgcaggcggtgcggtgcaacgtttcgtcatgctgtggcagaggcccaccggcgatgtcgaagttgagaggaatggcgcttctactggcattattgccgggcgtgcggcacgaatcgtgctggtcatgctgattgcggcgtcggttgtggcgagtgccggttttgattatgtcgccagagaccataacacggtttcgaccagtgattccggtttgccgattgttgcttccgactatcttgcgcaggatgaggcgaggcgtgtgctcgcagtacgcgcggatagtgccggttccatcagctacaatgtgatgcgcacccgccgaggtgatttgatcgacagctctccggcacagcgtgtcgaagtggcgttcggacgttccgatgatgcgaacaaggccatcgccaaggattgcgcgcagctgttgtcgaacgctgattccgacgccgtcgccgatttgagcgagttgggattcggaggcatctatgtggtgcgctccggcgaagacaaggcgcaaaaggagataaccgatcagttgagttccaatatcagcgcttccgatggcacgcagaatgtcgtaagcactgatgcgggaacatactatcgtctcaccatccaagatacggccaagcagcatatcgaccgcaagggatatcgacaggctgaatcgagtgtgtggcgtcaggcatggctgtggtgcatgggtattgttctcgcagcgtattgcttggttgcgcttccgcgcatgaggcgtcacggtcaggaggaagcatgagcaaacattcccgttccaaaacggtttggcgtgtaattctggccatagtgtcggtgttggtcattgtcgcactggcgaccgtggccgtaatctaccgcccgacttggattcatgcggattcgccggtaacgcagcgttcatccgtatcccgcaccgtcagtccgcgtcagctggaaacatattgtccagcacgaatgacgatagctgatactgatgtgtatggagacagcgaatatcaagcgtccaacggcaatatcatgtcgtcggcgcgttatgcgtccttcggttcggtgttccgctcttccgtagggcttctcggagctgatgaagccacttcgtcattggtgttgaacaaggatgatgccggatcggatgatgatattttcatggcgtccggcacggtcgatgacggagcccaattgcagaatacccgattgctgtcggcttccgatggaacgggagcggcctcttcggtgatgtcttgggctactgagggagatttgaaaggcgtttccgctgcttcctgcgtcgttccggctttgaagcagtcgctgatggtgtcgggcaccaaaacaggcatgacccagcagctggtcgtggccaatccgtcggctaaggccacgtcggtgaacatcaaggtttggggatccgacaagtcgggtgctttggcattgtctaccggttcgacgttgacggttggcgcgggcaaggaatctgtgctgaaccttgccgcagcagcttccgggcaggatgctttgtacgttaccgtgtccagcgtggacacgcccgttgcggccgtggtgcgcaccatagccatggatggtctggttgcaaaaggatcggattatgcggttcccaatactgttgccgcaaaaacattggcgattgacggactcacggaaggcgatgccgtcaacctgtatgtgtatccgtctcggcaggccgacgtcaccgtatcttggacggatgaccaaggtctgaagaaaaccaatcagcagacgctcgaatcgaatcgcgtttcggtcatcgacctgggttcggttcccaagtcggcgaccggacttaccatcagcgccagcgagccggtatccgtcgccgcgaagatcaccaatgatggcgatgatgaccaggctgatttcgccttggtcaacgcttcagtgccgatgagcgtctccgccatggccgtgcccgaccatgccacggctcaagtgggcatcaccaacatatcgggcgatgagcgcacggcaacattgacgtcctataacagtgtcggagatactgttgaccagcgcgagattgctctccaatccggcgcttcgacaacggttgatctggcggatatcaacgatggagacgttgccgccgtaagctttgccgatccggaccaatcaatggtgtggaacatccgtatcagccaaaaagacgtatcggatgcgaaactggccggagtgtcgattatcggcgcaacggatctgaaggaagcccgcgagcaggtgctggccaaccagaacatgaccgtcgtgcgttgatcacataccccaatcggggtcgatctcttcgggacggcgtccatacagttccgccaagcgcaacaccacttcgtcgcggatggcgaattgcaggtccatacggcttcgcgcatgcgattgcaaaggcatacggtacagcacgacgcgcggcggaatgccatgttccgcggggaaagactgcgagcccaagtgcgcagtggcctcccaaggtgccgggtcggatggcggaacgtcctcgaccgcaaactgtaccggtgccaccagttcgggccatgcatcgttgagcctacggatctgagccaccagcatgtcgtcgaacataccgcttcttgtacgataacgtggaagtctggtaccgaacatgggagtgcgggtcccacgaccatgacggtttctatacactgttgattcccaaggcaattgatacatggcttctaccatatcagggccttgcgcgaatcatgcgatagcatattgttcattgcatcgacacaggaggaaacgatcatgacggatatttccgtgccctgttggaacgacgtggatatcgaggaattgtgcaatggagtacgccttatcgccttcgatctcgacaacacgttggcaaggtcgaaaaagccaatgaaggacgacatggccgaatgcttctccgcattgacatcgttgattgatgtcgcggtgatcaccggtggcaagtatgcattgctgaaaagtcaggtggtggaacggttgacaggtcaagccaatcggtcgcatctgcatcttatgccgaccagcggcacccgatattaccgttggggcggatcggattgggcgccggtcttcgcccatgacctcagcgcggatgatcgtgcgaaagcttacgaatcgttggaacgcaatgcgcgcgaacagggtatctggctcacgcacgtttggggtgaacgtatcgaggatcgtggcagccagatcacattctccgcattagggcagcttgcgcccatcgaagccaaggaggcgtgggatccaaccaacgagaagaagaatcgtctggcacgagcggttgccgccgatctaccgcatttggaggtacggccgggcggcgccagcagcgtcgatatctccgaaaaaaacgtcgacaagtcgttcgctgttcgagaattggccgatattctcggcattacggtggcgcagattgtttttgtgggagaccgtatggatccggacggtaacgattatcccgcggcaaaggcaggcaccagggcggtgaaggttacctgtccgaacgataccgtgaaattgtgcggtggaatcatcgccagtctatcgcgatagaacctgttgggaggtttcgcatgaactcaatggcgagggcatgctcgatggtggttaatctgctgtttccccggggctgcgccgggtgcgacaaaccggatgaagtgctatgcgaagcttgcagggcattgttttcccagccgaccgcacagtcgtttgacggtgtggcgatgcaacgctggttcgcatgcggatggtaccgtggcacggtcagaaaggcggttctcgcgtggaaggatcacggcgacgaggaatgtgaccgtgcgttcgccgatgcgatatgcgcccttgcaaaagcgtctggcgttattgacttcgttcgtgataggcatggttcatgccatgatgttgttgtggttcccgcgccttcgtctcccgcttcaatacgtcgtcgcggacgtaaacatatgatgccgatcgccaaacatctggcaggttttctacgggaggaaacaggctgcgaggtgacggtgcgtgacgcgttggagaacaggggggtcaaagggaaatcagtgcagaccagcggtgcggcgcaacggtcgcaacgtttgaaggggcatgtttcggtgcgtccttcggtttccttgcgcaatacgatggtgattctggtggatgatattgtcacgaccggtgcgaccatgcgcagttgcgtcgaaacgatgcggaaggagggtgccacggtcgtgaccgtgcttgctttggctcacactccggcgggaacgcagaaggttggcccaacgcaagcatggtcacgcacgcaagtgcagtgacgtgagaaatcctctattcgtcatccgtaacatggtatttcggcagaatgatttcaaaatcggctccacgcgggtcatcgacgaccctcaccgaaccaccgtgcaactgggcggcccaacgtgcgatggacaatcccaagccggttccgcccgattcggtgcccggacctgtttttcctttgacgaaacggcggaaaatgtcggaacgcgcctcttgtggaatctgcgatccgaaattgacgacattggtgacgatggtgccgaaatccttgttttcgtgtgcttcgataagcaccgtggtattgtccgcggaatgcttgagcgcgttcgcgatgatattggtgaacagttggcgcaggcggtcctgatcgcctgccatctcgatatcgtcgggcacatgcatttcgatgtcatgcgcatgcccggcatcggcgatttccaaaggttccacggtttcgtcaagaaaatcggcgaaattgaacatttcgatttgcaggcttgccgcgccggcttccatgcgggaaagatcaagaaggaacgcgatcagatcggacaggcggtgcgtctgattgaggatgctttccagatttgatggcgtagggtcgatcacgccatccgccatgttttcgaccatggcttgaagcgctgatacgggcgtgcgtaattcgtggcttacgttggctaccatgtcccggcgcatctggtcggcatgctgaagctcttccgccatttcgttgaaggtgagggcgagctggccgacttcatcgcgactattggagtcgacatggacgcgcacggtgtaatcgccttccgccatcgcttcggcggcgtcgcgcatttggcgcaggggagaggtgagtcctctggagaagaaatatgtgattcctaaagccacggcgagggtaatgggcatggcgatccatacgctgagccctactttgagcaggaaccacgccatgatgaacgcaatggcggtggagatggtgatcagaacgctcaattcaattttgagcgatgagaacaaaccaataggacgttcggtttccaatggattcaccgaacgccctggttttgtatcggtagtacgcataccaccgaattttagcgcattagtcttggacttctggcggttcgaacgcgtaaccgacgccatgcacggtacgaatggtcttcgaaccgagcttatggcgcaatgccttgacgtgcgaatcgacggtgcgagtgccggaagcatccacccaatcccacacttcctcgagcagtttctcgcgagtgagcacggacttcggcttgcgggccagcgtggccagcaaatcgaattccgtaggggtcaggtgcacctgcttgccattgacggtgacgatacgttgcgcgggatcgatgaccaaggagccgaaatcgagaagcttctcgttttcggagtttttggcgatgaccttggcacgatctacacggcgcagcaacgccttgcaacgggcgatgagttcgcgcatggagaacggcttggtcatgtagtcatcggctccggcaccgaggccgatgaccttatcggcctcgtcgtctcgtgccgtcaggatcagcactggcacagggcgctccgccacgatgcgtttcgtggcctcaagaccatccatcacgggcaacatgatgtccatgatgaccagatccggacgcaacgtagtcgcggcctgaaccgcactggcgccgtcggatgccacgcgcgccgtccagccttccgctgtgatgcgctgcgcgatggcagtggccagtgtcggctcgtcttcgaccaccagaacggtgcgtggagccgttgtgggttgtgctgatgagttgagcatagctttccgcctttctcagagttccggcttcaagaatactgcgcccagtgccggaacggtgattttcgcggaccaatcacgtgaatggtattcgccttcgatcgcttcgaccgtgccattgtgaatgccggaaccgccgtagatctcatcatccgtggtcagcacttcggtccatttgccgcccttggtgagcggtacctgatagtcggtccatgcctcgccggagaagttcaccacaaccaccatttgctctccgtccttgccgatacgcacgaagctgagcgtgttgtgatcggcgtcatcgctggtgagccactggaagccggccgggtcgaagtcttggctccaaagtgcaggggaagccttgtacagcgtgttcaaatccgcgacaagcttttgcacaccctggtggtccggccattcaagcgcggcccaatccacggaaccatcatgatcccactcgccgtactgggcgatctcattgcccatgaaggtgaggttcttgcccgggtgggcccactggtaggcgaacagcgcgcggacaccggcatacttctgccaatcattgcccggcatcttgccgaacatggatcccttgccgtacacaacctcatcgtggctgatcggcagcacataatgctccgaataggcgtacaccatggagaacgtgatctcgttgtggtgccacttgcggttaatcggctcctcatgcagatactgcagggtgtcgtgcatccaacccatgttccacttgaggccgaatcccaaaccaccggcgtcggtcggcgcggtgatgcctgggtaagccgtggattcctcggcgatcatcatgatgcccggattgttcttgtatgccgtggcgttggcttccttgaggaagtcgatggcttcgagattctcgcggccgccgtagatgttcggatgccactggccggcctcacggctgtagtccaggtacagcatcgaggagaccgcgtccacacgaagcgcgtcgatatggaactcatccagccagaagcaggcgttggccaccaggaagttacggacctcgcgacgtccgaaattgaacacgtacgtgccccaatccgggtgctcgccacgagtcggatccggatcctcatacaacggcgtgccgtcgaagcggcccagtgcgaacgcatccttcgggaagtgggccggaacccaatccatgatcacaccgatgccggcctcgtgcaatttctcaacaagatacttgaaatcgtcggggccacccaaacgcgaatcgatcgcgtagtagccggtcacctgataaccccaagatcctgcgaacggatgttccgccaacggcatgaactccacgtgcgtgaagccttccttctgcacgtagggaaccagcttgtcggcaagctcacggtagtcgttcacgtccttgcgccagctggaggcgttcacctcatagatgctgaccggtccgttatgcgggtcgctggccgcgcgttcggccatccaatcggcatcatcccattcatgggtggattcgaccacgatggatccggtgcgcggcggaatctcgtgggagcgctccatcggatcggccttcatggtccattcgttattggcgttgaggatttcatacttgtagatttcgccggcctcaatgcctgggatgaacagttcccaaatgccggaagaaccaagttcgcgcatggcgtgggtacgtccgttccagccattgaaatcgccgaccacgcgcacggcatgcgcgtttggcgcccatacggtgaacgcggtgccaaccacctgctcgccatctacgccttcagaagaacccatcggatcgtcatagcggagcacatgtgcgccaagtgcctcccacaggcgctcgtgacggccttcgccgaatagatacatgtccatctcgccgatggtcggcagataacgatagggatcgtcagacaccacaacggaaccgtcttcatactccgtgcgaatacggtaatctggcacgccgtacccctcttctgctgcggcggcgggaacgagtgccatgaagacgccattgtattcatggattgcgagcgtttgaccttgttcagtgataatcgtcacggattttgccaacggacgcaagactcggatcgtgacgacatccgcatgcttgccggaaccgaggtgcccgccgagcacctcgtgaggattgtagaacgtaccgttgcttactgcatccagtgtgccctggggaacaggaacagcaacgacatcttcattgatcttggattctgtagccatggcaaaagtgtaagcatgaaacggaagaaaagtggcccgtgtcgcgcctatttttccgtttttcaagtgtttttggccaagtccacccctgatggcacaataattcgggttttgtgtaagcttttcacggaggattcatgggttacaaggtcggcgacatggtcgtctatccacgtcacggcgctgcgaaggtggaggccatcaccgaacggacagtcaagggaatcacccgcgaatatctgcagctgtcggtgctttcgtctgacggtctggtcatcaacgttcctgttgataatgccaaaaaggttggtgtgcgagatatcgtcgacgccaacgaagtggccaaggtgttcgagattctgcgcactccgatcattgagaaggagatgaactggtctcgtcgctacaagctgaatgtcgagaagatcgccaccggcgatgtcaataaaattgcggaagtggtgcgtgaccttgcgcagcgtgatgttgacgaacatggtctgtcggctggtgagaagcgcatgcttaccaaggcccgtagcattctgacttccgagatttcgctgtccgaacaccttgatgaagccgaggcccagcgtttgctggacgtgaaccttgggtatgagccggcccagcccggcgatgaggagcatcataccgaggctcccgaggaggctgccatggatacgctggcccgagttgaggccgaaagcaagaagtccaagaagaggtaaggcgtttcatgcgtatcggtcagggttttgacgctcatcgattcgcatctcacgatgcaggcaagccgttatggcttgcctgtttgcgttgggagggcgatggcatcgagggcgattcggatggcgatgtcgccgctcatgcgttgattgacgcattgctttccgcggccggtcttggtgatatcggcaccttgttcggtgtcggctcgcagtccgatggcgcgggcaagcatggcgccgaaatgttgcggaccacggtcgattatctgaacgaacgtggtatgaagccagtgagtgccagcgtggtcgtgatcgccaatcggccgaaaatcggaaaacacagggaagaagccgaacgagcgttgtctgaagccataggttgtgaggtgtccatgaccgccaccacaacggatggcatgggattcactggttcgggcgaaggcgtcgccgcgattgccgatgctttggtggaacctgttgatccatcgactcgtcaggcagtctgatttcgcccgctgacggctttccgatacttctttctgctactttcttttgaaggattcaatagccttcgcaaccgcccaaaacaacgtcgaaattgtcacgatgatgaagctcgggggagcggggaacatggcggaaatcacgagccctccccaaatcgaaatcaggcagatcaccgtggcgacgaccatcgccttgaatggtgagcgggcgatgatgttggcggtggcggcgggggtgatcgccaacgcgaagatcagcaatgtgccgactgcgggaacggcaatggtaatgacgccggccataattgtcataaagcaaatgttcatgaaaccgacgggcacgccttttgcctgtgccacctgctcgtcaagcgaactgaacaatagcgggcggtagatcactgccagaacagccaaaagcagcacgtcgaaaatcgcgaaaccaatgatctgaccgtcggtgatcgtcagaatcgagccgaacagaatcgactgcatctgctgcgaagccgagcttgacatgcgtgcgaaaaagagaccaaggccggtggcgaaagcgagtacggttccagtggcgatctcacgctgtgaagccttcttgccaagcgcgccgatcaccagtgctccgccgagagcgaacacgccaagacctgcggaaacaggcaggccgagcaatacggctccggtggcacctggcagtccgatatgtgccaaggcgtgggctgcgaatgtggaatgtctggcgatggtgaaataacccatcacgccggctgccaatgcgatgcacaggccggcgagaaacgcgttcgtcatgaatggggcgttgagcgtggaaacccaatccgggtcgaaagcgaatacggtaccgtccatgctcagtcctcctgcgtggtgtggctgtgatggtgaaattgcgcgatttcttctggagcatgcgcatcgatgctcatgttttcagactcgtcctcgcttggcgtcacgaacatatctccttgcggagtggtgaccacctgtacggtcgtgccatataaatgcgtgagtagatgggaatccagcacctcgttcatgcctgcatagtgtggatgtccgtcaagcagatagacggctccagtgaggatgggcagaagcatattaaggtcgtgcgccaccacttggatggtcatgccgagttcgcggttgagtttggcgagtacgtgcacagtggcgcgttgactcgccagatcaaggttggcgagaggctcgtccagcatcagcagtttcgggtcatccacgagcgcctgcgcgatggcgaccctttggcgcagtccgcccgaaagttcggataggcgataattcgctttgtcttgtaactcgacgaagtccatggccttgcgggctttctcgcgaagtgttttggtgacgggatgaatgccgaatcgagttcccgtcaagccgagaagcaccgactgttccgcggtgatgttcgattcgatgtcggatgcgtagctttgcggcacgtagccgatgcgccggtttgcggagcctgcaggctgtccgagtaccttgatgctgccgtgcgcggttggaatcaatcccagctcggccttcatcatggtggttttgcccgcgccgttggtaccgacgattgcggttaccgagccttgcggaatgctgaacgtgccgtgttgccagatgacgtgaccgcctcgtttgacgcaggcgtcgtcgaattcaatgcaggcaggtgtctcgtcgtgcatggcttctccttgatttgaatgcacgtacatactcgcaaatagtgttgacaatcattctcaataaggattgtcgttgaaaccgtcgtaacgatcagacgagaggctttgcgtaaaaagcaaaacgtcaggcaaacaaaaaagaccatcccgcattcagttggacgcaggatggtcttggcaaaagcgattaccgatcgattgttcggcaatcgcttttgccgaacaatcatttcaccggatttggttgcggcgcatcgttcgatccgttcgttgtctgatcgttgtcttgcgtcgaggaatctgcggttgattccaaggaatccgcgttttccgacgtgctgtcggaacttgttgcatcctgatcgtcagcatcgaattgttcatcgaacatatcggtcaacgacaggataagagcgcggatccacgatgtcaggctggtgtaatcggagggcatctgttcgctgatatcaagcacgggaacgtcggatttgtaagcaatgccggtcagcgtgttcgtggcgtcgcttgtggattgtgtgtcgttgatcagcacctcgactttatgcttttccagcaattcctgaaattcctgaagatcggtgggggttggctcggaattcgtgctggacgattgcagatacccctccggcgtgttgtcggtgaaccccatgtcgctgagcagatagtaggccaccggttcggtggcggcgtaggagacgttcttatgcgagtcgctgaacgccttcatgtccttttctattttcttctcccgcctgttccacgcggtgagtttgttgttgaaatatttcttttgcgcgggcatgatgcggctatatgtgtcggccaattccttggccatggcgtttcgggcgtcactggagaaccataaatgcggattgtctccctcgacggcgcccaccatttgtgctgcggaaacggaaaccatggtcttactgaggttcttggtggcccaagtgtcatagccggcaccattggacactacgacctgtgcctgctgaagtttgtcgatatcgtcggttttcggctcgaaatcatgcgcattgacatcggttgaagagagaaccgacgtgaccttcacatggacgccaccgatctgctcggcaagagaaccccattgattgaccgaggcgaccacttcgattggagtgatctgttcggttggggtttcggagtcggcggaggcgtcattctcctgcgaagttgaccctccggaacatgctgccgtgccgaacgccacgcaaagcgcgattcccgcagcgaaagcgcgtaacaaagaacgtttgtgcaagcgcatgtcgattgccctcttcctgaaccgccctaatcgtgttcatctcataaatacgtgtgcgacttacgactgaaaccaagatagcctacgatacatgcaaatgccaatacaacaatgagacaacgaaaaggggagtggccggcatggcggtgaaaatcgatggaaagatggtgtccgcgcagatcaaagcgaatctcgccgagcgagtcgcagcgctgaaagagcagggggttaaccccggtcttggaactatcctggttggttccgatgccggatccgtcaaatatgttgccggaaagcatgccgattgcgctgaaatcggtgtgaactccattaagaaggagttgcctgccgacgcaacattcgaacaaatcgccgaagtcgtacaggagcttaacgccgatcctgcctgcaccggctacatcgtgcagttgccgttgccgaagggcatcgacgagaacgccatcatcgatctgatcgaccccaagaaagacgccgatggtatgcacccatataatcttggcgaactcgtgttgcatgcgcgcggcgagatcactactccgctgccatgcactccgcgaggcgtgatcgaactgctcaaagcctacgacattgacctggacggcaaagaggtctgcgtgctcggccgaggcatcaccatcggccgcactattggtctcatgctgactcgcaaggcggtgaatgccacggtcacgctgtgccataccggcaccaaggacgtgcgcaagcatatgcgtgaggccgatatcatcgttgcggccatgggctccgccggtttcgtcaagccggaagatatcaaggaaggcgcggtgttggtcgatgtcggtgtttctcgcgtgttcgacgagggggtcggccgttatcgcgtgaagggcgatgtcgataaagcctgttatgagaaggccttggcatacacgccgaatccaggcggtgtaggccctatgacccgcgccatgctgctggaaaacgtggtcgagatggccgagcgtcagctgtaattgcgctctgtgtgtgaaaatatgaagtaatttcgggcgtgtcgcgggttgcggcacgccttttttgtgcatggtcccatgtaaacttatgccttgcgtgtgttatatcgcacgcacataattgaagaccgattttatccacccactatttgtaagaaaccaaattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcacgacgaggtcctgctcgacatcggctacaagactgagggtgtcatcccctcccgtgagctttccatcaagaaggacgttgatccggacgaagtcgtcgaggtcggcgacaccattgaggcccttgtcgtcactaaggaagacaaggaaggccgtctgattctgtccaagaagcgtgcacagtacgagcgcgcttggggagacatcgagaagatcaaggaagccgatggcgttgtcgaaggcaccgtcatcgaagctgtcaagggtggcctcatcgtcgacatcggtctgcgcggcttcctgccggcatccttggtcgaaatgcgtcgcgtccgcgacctgtccccgtacattggccagaccatcaaggccaagatcctcgagctcgacaagaaccgcaacaatgtggtgctctcccgtcgtcagtacctcgaagagacccagtccgaagtgcgcgaaaccttcctgtcccagctcaagaagggccagattcgcgaaggcgtcgtgtcctccatcgtcaacttcggtgcattcgttgatctgggcggcgttgacggcctgatccacgtttccgagctgtcttggaagcacatcgaccacccgtccgaggttgtcaaggtcggcgacaaggttaccgtcgaggtgctcgacgttgacctcgatcgtgagcgcatctccctgtctctcaaggctacccaggaagatccgtggcagcgcttcgctcgcacccacgttcctggccagatcgtcaagggcaaggtcaccaagatcgtccagttcggtgtcttcatctccgtcgaagacggcatcgaaggcctcgtgcacatctccgagctggccaaccgccacgtggagaacccggagaccgtcgtcaagccgggcgaagaagtcttcgtcaaggtgattgacgttgatctcgatcgtcgccgcatctccctgtccctcaagcaggccaacgactccgtcgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcataaggaatttgtggccaaggagctcgagaacgctgaagcttccgccgctgaagatggccaggctccgaaggaagagaaggtcgaagaggtgtcttccaactactcctccgagaacacttccgccggcaccctcgccgactccgaccagctcgccgctctgcgcgaccagctgctcggcaagtgattgtatcctgagctaggatccaatccagctcaggctagattttagaaaagaccccgttcctgattcaggttcggggtcttttcgtatgtgcatggcaagcgcgcatgcgaagcgcattacaatggcggttgtggtgattcgaataggattgaccggcggcatagcagctggcaaaagcacggtatccgcaagactgcgtgagcttggtgcagtacttgtcgattatgatctgcttgcgcgtcaagtggtggaaccaggcagcatcggccttcagcgtatagtggaatgtttcggctccgatgctttgaccgatcgaggcgagctcaatcgagcgtggatggcagagcatgtgttttccggcgctgatgcggaacgaaaacgcaagatgctggacgaaatcgagcatccactgatttatgaacttgcagtgcaactcgaacatgaggctgttgaagttgattgccaagcagtagtggtgcatgacataccgttactcgccgaagtaattgacagcattccttttgaattcgaccatatcgtaactgttgaagcgcctgaacaggtgagggtcagcagaatgatgtcaacgcgaggcatgagcgaaagccaggcatggaatcgtgtgaaccatcaatccagcgtggaacagcgtcttgccattgccgatgagatcatcgattccacacagtcattggaacaaatgttcgagcatattgatatgctaatgcaacaatggcgcacggaagcgaggtaggtatgggattcaatattgaacgcacgaacaagccgtttgtggtcaaatcgccatataagccgagcggcgaccagcctaaagcgattgaagagcttgcggaacgcattgaaaacggtgagaacgatgtggtgctcatgggcgctaccggaactggcaaaactgccaccacggcatggcttattgaacgtctgcaacgcccgacgttgatcatcgaaccgaataaaacgttggcagcgcagctgtgcgccgagttccgtgaactcatgccagacaatgcggtgagctatttcgtttcgtactacgactactaccagccggaagcctatattccgcaaaccgatacgtatatcgaaaaggattccaacatcaatgacgacgtggaacggcttcgccatgcggccacggcgaacctgctgacgcgtcgtgattgcgtggtcgtggcaacggtttcctgtatttacggccttggtacgccggaagaatatgccgggcgtatgctgtttctcgaggaaggccagcagatcgaccgtgacgacttgctgcgcactttcgtcgccatgcagtacaagcgcaacgatatcgccttcaccagaggtactttccgtgtgcgcggcgataccgtcgaaatcattcccgtatatgaggaactggccatccgtattgaattcttcggtgatgaaatcgaccgtatttcaaccctgcatccacttaccggagatgtgatcgggcgtcaatcgcaagtccatattttccccgcatcgcactatgtggcagggccgcaacgtatggagcgagcgttgtctaccattcagcaggaacttgatcaacgtaccgctgaactacgcaaacaaggcaaggaacttgaggcgcagcgtcttaccatgcgtaccacatacgatttggagatgctttcccaggtcggcgtatgttccggagtggaaaactactcaagacatttcgatggccgtgagccgggcacgccgccgcatacgttattggatttcttccctgacgatttcctactcgtcattgacgaatcgcatgttaccgtgccgcagatcggcgccatgtacgaaggcgatgccagtcgcaaacgcacgttggtcgaacatggcttccgtctgccttcggcgatggacaaccgaccgctcaaatggccggaattccttgagcgcgtcggccagacggtctacctttccgccactcctggcgattatgagcttggcttgagtgacggtgtggtcgaacagattattcgaccgacaggattggtcgatccgcaaatcgatgtgcgcccggttgacgggcagatcgatgatctgcttgctgaaatcaaggatcgtgtggcacgtaacgaacgcgcgttggtgaccacgctgaccaagaagatggctgaggatcttactgattatctgctggagcgtggcatcaaagtcgaatacctgcactccgatgtggacaccctgcgacgtgtcgaattgttgcgtgaattgcgtgagggcaagatcgatgtcatcgtcggcatcaatctattgcgtgagggtcttgatttgccggaagtatcgttggttgcgatccttgacgcagacaaggaaggtttcctgcgttcctatcgttccctcatccagacgattggtcgtgccgcgagaaatgtgtccggcaccgtcatcatgtatgcggatgacatcaccgaagccatgcacaaggccatcgacgagaccaatcgccgtcgtgatatccagattgcctacaataaggaacatggcatcgatccgaagccgctcatcaagaagatctccgatgtcaacgacatgcttgccaaggaggacgtcgacacccagacattgctcggtaccggctaccgtaatgaaggcaaagccggcaactcgcatcttggcgtgcctgctaccagcaaggaggaatctgacagacggcatgaggagattctcaaggccggattgcccgcgcaggatctagctgatctcattcgacaactgtccgagcagatgcgtgccgccgccgaacaactgcaattcgagcttgcggctcgtttgcgtgacgagatccgcgacctgaaaaaggaacttcggcagatgacggaggcgagcaaatagttccgaccggtcatacggcatccgtaccatagtggattatggctgaaacaccacttgtttttgaaatcgccacgttcgcggtgcttgccgtcttcttcgtggttgacttgtttatcatcggacgtaagccccatgtgccctccaccaaggaatgcgtgcagcatatcgcgttctttgtagtcatggcgttgatcttcggcggacttatgtggttcttcgcaggttcgaagccggccatcgaattttattcgggctggcttacggaatattcgctgagtattgacaatctattcgtcttcgtcatcattatgtcgaattttgcggtgccaaaacagctgcagaaattcgtgctgtccatcggcatcacgatcgcattggtgttgcgcggcgtgttcatcctcatcggcgcggccattatctcccgcttcacctgggtgttcttcctgttcggcgcatttcttatcgtcaccgccatcaagttggtcactgggggagacgaagatgaggaatatcatgagaatggcttgattcgtgcattgcgcaaggtgatcaagatcaccgatgagtatgacggagaaaagttgcgtaccgtcaaaaacggtgccaagtattggactccgatgctgatcgtctttctgaccatcggcaccaccgatgtgatgtttgcctttgactccattcctgcgattttcggtttgacgaaggatccgttcattgtgttcacgtccaatgtgttcgcattgctcggcttgcagcagctgtacttcctgcttggcgagctgctcgacaagctggtgtatctgcctcttggactttccgtggtgctgggcttcattggagtcaagctcattatggaggcattgcacggcaattcgttgccgttcatcaatggcggtcaaccgatcgcttgggtgcctgaagtgcctacatggctgtctttggcggtgatcgttgtggcgattggtggtgccgcattggccagcgtactgaagatgcgtgccatcgaagcaaaggaaaagtgacgatttgagaaaccgcatggaaacatgcggtttctttttatcaaaaaaatgtgagcgctcacaacacgcctcgtttcagggtggaagtgagcgctttttgctagtagactggtcggttggaaacagggtcgtcagatccaaaatcaatatcaacaagaataggcaggcattcatgcgtaaagccaagatcgtagataccatcggtccagctaccgagtccctggaaggcatcaccagccttgtcgaagcaggtatggacgtcgctcgtctgaaccgctcccacggcactccggaagaccacctcaaggtctacaacaacctccgcgccgccgccaaggccaccggccgcaacgtcgcagccctggttgatctgcagggtccgaagatccgttgcggttggttcaagaagaacgccgacggtgaagacaaggtccagctgaccgaaggccaggagttcgtcatcaccaccgacgacatcgagggcgacgagcatatcacttccaccacgttcaagggcctgccgggcgattgccatgctggcgatccgattctcatcgatgacggcaaggttcgtcttgaggtcaccaaggtcgaaggcaacaacgtgtacaccaaggtcgtcgttgccgggccggtttccagccacaagggcatcaacttgccgggcgttgccgtgtctctgccggctttgaccgagaaggatgaagccgatctgcgttgggctatccgcactggcgccgacatcatcgccatgtccttcgtgcgtttcgccaccgacatcgaccgcgcccacgagatcatggacgaggaaggccgtcgcatcccggtcgtcgcaaagatcgagaagccgcaggctcttgagaaccttgaagagatcgtcaaggccttcgacggtatcatggttgctcgtggcgacatggccgttgagtgcccgctcgaagaggtgccgctggctaccaagcgctgcatcgagctcgctcgccagtacgccaagccggtcatcgtggccaccgaagtgctcggctccatggtcaactccccggtcccgacccgtgcagaggcatccgactgcgccaacgccatccttgacggcgccgacgctaccatgacctccaatgagaccgccgtcggcaagtacccggcagtcaccgtgagcaccatgagccgtatctcctccttcgccaccgagcacggtttcgaccgtatcccggagctgaagaacctggatatgtcttccaccggcgccgtgtcttccgcagctgtggatctggctgacaagctgaacgccaaggccatcgttgcctacacccagaccggttccaccgtgcaccgcgtgtcccgcgaacgcccggccaccccgatctacggcatcaccaacaacgagcacacctatcactggctggctctgtcttggggtaccgagtccttcctgctcgatgaggattaccacgacaagtcccgcaaggacctgatgatcttcaccgataagatcctgaaggatgctggcaaggtcaccgatggcgacaagatcgttgtgctgagctccgcccagggcgagcaccagccgggccgcaccgattccatctacgtccacaccgttggagcttgcgactgagatgtgtttcggtcagtgactggctgattagcgaataggagggctttcgtccgtttggatggaagccctcttattgttttcggatgatgttgatttgttgccgatttacagattgcgataggttgcgatcaaagtgttgcacatggtgcgaaacgccgaccgctcaaggactttgcgaaatcatttttctgtgttaagataatcaagttgtgcgaaagcccctgtatcccaattggtagaggagacagcctcaaaatctgtacagtgtgggttcgagtcccaccgggggcaccggattaatgaacagccgcggttggaaatttccaaccgcggcttttgtcatacgttccccgtacgcagggccagttggtaccgtcttctttgattcagatggcgagccggtcgccggtgttgccggcgcgccgccggtaacaccgaggatgtgcgaacttctcccagatgctgtaagactgcgacggccccggcattgttgctggattggcatggtcttcgacgtgcgcctcttgtctgcgatgtctttcgtttattcttataagtgaggtttttgtttcgcttcgctgtccaagcgacacggaactgaaagtttcaataaaggaagacatctgtcgcaggcttctgccggttgtccggcgtgagacagaaagctaatgatccgagagccgatcgaagcgctctggtagcgattccacgccaatggcgtggatgtgtcccgccgtggatttaggtctctcttacttacgaggatgcccagacacatccacttttttggcgccggatgtgcggcagttccgacggatgcttgacattcgggggaggttccatcgcgggaacgcgtggtttgtttggctcaattaagcagctttcgggagttcggagcctgtcaaggccactgtgcacagattcactccgaactatggcatcgtcgctacggtgacattcaccgataatcctgaagtattccatattgaatttctgcaaggcattcagtggctccctccggttttacttcaatcaatcacaatgccaaaatgccctactgcggaggattctttcaaggaggatttgaataggcagattgagagttggcatgacgattggattactgcaggcgaaccgtggggctaatccggccaaacgcaaatgctgtatgtctgggtcgccgatacggtgagtcggcagccagaacaatatatggtttatatattgcgtgaaaatatgtaggttttgtgattgcggttacgattgcgggcgggtagtcgtttccctgtccgcaatcgtaaccgcaatcgtcgtatcgatatgtcggagtgttactcggacttgcagtcagcgtcctcaacagcagcgtcctccgccagctgttgcatgagctgttcgtcgcgctcgcggataatgcgttgtccgtcttcgccttgccattcgtagaaaccacggccggtttttgtgccaaggttcccatcctgcactttccaagccagcagaaggctcggttcggtgccgttatccatgtctttgaacaggtaggtgctgatgttgtagaacgtgtccagtccgcccaaatcggcgctggccacggggccgacgagattccagcgtcgtcccaaactgtaacgaaccacagtgtcgacggtttccgcgtcggcgatgccttcattgatgatgttgaacgcctcgcgcaacagcgccagttgcatacggttgcccacgaatcccaaagattcctttttgattttcgcaggctttttgccgatgcttgccatcaaatcgaaggtcgtatcaaccacttccggcgcagtgtctttgccgggcaccacttcgactagcggcatcagatgcgcaggattccagaaatgagccaccacaaagcgttccgggtgcttcagcacagattggattgcggttgggcccaatccggaagtgtttgtcgcaaagatcgcatcgaccggcgcgtactgctcaatctgctgccatacggattgcttgacatcaagcttttcaacaatggattcgataatgaaatccgcgtcggagacaccattttcatagtcggtgtatgtcgaaatgcgggagagcacatcgtcaacggtatcttcggcgcgcagcaacccggcttgggcgaattcctcggcatcggcgcggatatgttccatgccacgcttaagaagctcttcgctgcagtccaccaatttcaccgggtatccggcgaccgcaaattgcaacgctgtggcatgccccatggtgcctgagccgatattggcgaccgttcgtatggattccaaggtttttggttctatggtttgtaccgtggcatctgtcatcgcaacctcgcaatcctcgtatggcgcttccatgcttccactacgagcgagcctagtcgccaatctgggaattatatgaaagcgccatgttcggtgtcgatgccttgcggtcggcgtgctttactgacagtgctttactgacggtgccttactttcagtgccttaccgacagcgtctgctgcaaaatatgtgattcatgcgggggaacgacgaccgcgcaatcgcgattgttgaccgcttccacgcagacgaagccgcgccattcgccctcatccaaatcgccgatggcgtttccggcttgttctcccggattccacaccacggtctgcgccgcaccctgcttggaaacaacgacggtgcgtttcagcacaggatcgcgcagctcaagcgtgtgagccgaatagtagatgcggtcaaccatgccttggaaggtcacaggttcattaccttggctgcaacggggatcgccgtccaatacggtatcgagataatcggtgccctccagcccgcacacctgcgactgttcggcgtcgccgacctgcagatacgtatgcagtgcctcttcgtaagacaatggctcgtctccatcgttatatacggtaagcgacatcgtcaactcacagccgacttcaatggtgtaaacggcatgaaattgaggattcggtccagaaacaaactgggaaagtatatctgcgttgatctcgctggaatccaatgtatagcgcaacaaggcatcggaagaaccttccttgtcataatgccagaagctattgcgggcaaaaccatgcttgggcttcttcgaagccacatgcccgccttcgaaaccggaattgaaccaagggaaaataatcggaacaccgccgcggatggcagttccttccttaagatgaatcgcctttggccgccaaaccacagcctgttcgccggcaggtgcccaggaaagcacatgcgcaccgtaatcgctgactgatgccgttgcgtcttcgttgacaatatctctgatagtgaaagtgctactcatacgaccagtataaacaagacgacgttgaagcgggattgtggaaagaaggactttgcaggattgcggaatttcttggatttttcggctttgcacgtgaaggaaaaagaggattgcggcaacacgcgcttgtaggcttctgctagtatcatccatgaaagtacaaggaagatagccggttcgttccaacttgcgtgatggagggtgaatcaaggctgtgaaaagctgaagatttccagaatccgaacgattgcaagtaacggcatcgaatcagtccaggaccaggttggggtttgtgagaccggctttgggtgtgacagtggaaagagaccgacatgtctgcagaaaagaccacggaaccggacgaagtgctcaccgacgatgaacttcaggctgccgcagcgcctgagcagtccatcgaggaagatgacaaacctcgcaagcgtaccgtcgtcgtggccgaagacgaatccgtgaaccgtatggatttggttgccatgctggaagatagtggctacgaggttgtgggcgaagccgctaacggtgaggaagcagtcgaattgacccgcaagttccgtccaagcgtggtatgcatggacgtcaagatgcctcgtatggatggcatcgaagcggcgggcatcatctgtgatgagaatatcgctccggtcgttatgcttacggcattctcccagtccgatctggtcaagaaggccacgggtgcaggtgccatggcatacgtcaccaagccgtatgaggaatccaagctgcttccggctctggaagtggccatgggccgtttcgccgaaatcaacgatctgctcgacaatgtggagcgcagcgaatccaagctgcacgaaaccgaagagcagctgaagaaggcggaagagcagctgaagaaggctgaggaaaccctcgaggaacgtaagcttgtcgaccgtgccaagggcctgctgatggataaggctgacttctccgagcagggcgcgttccgttggattcagaagacctccatggaccagcgcatcccgaagaagcgtctggctatggccatcatcgccaagtacggtgatcagaagtcggaagcagaggatgagcgctaacacagcaactgtggaaggcactacgcgcgggacgctattggtcgttgacggccattccttggcgttccgcgctttttttgccttgcccgtagagaatttcagtacatccgcaggtcaggcgaccaacgccgtctggggcttcgccaccatgctgtcgcaggtgatcgacgcggaacatccggatcatcttgccgtcgctttcgatgtcaaaggcggtaccttccgcaatacgatgctgccgcagtacaaaggcacgcgagatgcggctccagaagatctattgacccagctgccgttgattcaacggatgctgacggcccttggcgtcacattcatcgaaaaacctggatacgagggcgatgatgtgatcggcacgttggcaagcatgggagacaaagcaggctatcgcacgctggtgctatccggcgatcgtgacgcgttccagctcatcaacgacaacatcacagtgttgtatccggggcatcatttcaaagatttgaagcacatgactcccgacgcggtggtggagaaataccacgtcacgccggagcaatatccggatcttgccgcgcttcgtggcgaaaccgccgacaacatccccggcgttcccggcgtgggcgatggattcgcggccaaatggatcaacctgtatggcggacttgaccagattatcgagcatgccgacgaaatcggcggcaaaaaaggcgaggcgttgcgggccaatatcgatcaggtcaaactgaatcgttccgtgaatgccttggtgcgtgaccttgaccttggcgtgtccatcgaggatttgactttcggtcaggtggacgccaaccagctcaaccaactgttcaccagacttgaattcggcatacgcaccaaaaaccgtgtgctgagaacattcaatgcggggaagcccaccaacgatcccgtgcagcaagacgagtccggcaagctcgaaatacctcagtatgaaacggttgactcgccggaagcattggaagcatgggtacgagacaatctgccgatgccgaacgggcatctgcatgacgaacgtgaaatcgcgccgaagacgactccctccggcttcgccattgatcatacgaagcagtgtgcgcagtccgtggcgcattcgtgggtgttgcaggtggaaggcgaaagcaagccggggaacgcggcctatgcgtcgctgatgatcgctgcacatgataaagcgattcgtaccaatcgtgttgaccgtgacatggcgtcccagctgcaaacggtacttgacgaacaccaccaatccatggtggtgcatgggtataaggaacaatcccacctgctggaaagcgtcggtgtggcgttgccgaagccgctgttcgacaccaagcttgccgggtatctggtccatcccgatttccatgccgacacgctggaacaggcggcggcgcatttccttgacctgcatatcgaggaacagtccgagggtgcgacgcaaggcacgcttgatttcgacgagccggacgatagtgcgcagcggaatgacaaccagcttccgcgtcatactgcgattgttggtttgttagcgcgtaaactggcggattcattggatcagcgtgagcagttctcattgcttgaatctgtggagattccagtatcccgcgtgctgtacggcatggagcatgccggtgcgcaagtcgatatgaacaggctgatgagcatgcgcgaacagcttgccgccgacgcgaattacgcgcaggaaacggcatggcagtatgcgggcgagcgcgtgaatctgcaaagtcctaagcagttgcagaagattctgtttgaggatatgggtttgaagcctacgaagaagactaagactggttcgtatactacgaatgcggctgctttgcaggtgttgcgtgatcgttcgtgtggtaatgatagggcttgtcagtttcttgatgcgttgttgttgcatcgtgagaagaataagcttaagcagattgtgcagacgttgattgatgcgacgaacaggtctgatggtcgtattcatacgacgtttgagcagactgtggctgcgactggtcggttgagttcggttgatccgaatttgcagaatattccgaatcgtgatcctgctggtcgtgagattcgttcggcttttgtgcccggtgagggttttgagtcgttgttgagttcggattattctcaggtcgagttacgtatcatggccgacctttccggcgatgaggcgttgattgaggcgttccgttccggtagggacttccataagtatgtggcgagtttggtgtatggcgttcctgtggatgagattacgcctgatcagcgcagtcatgttaaggcgatgagctatggcttggcttatggattgagcacgtatgggctttcgcagcagcttggcattaagccgggtgaggccgagtcattgaagcggcagtattttgcgacgttcggcaaggtccatgagtatttggagtcgttggtttcttcggctcgtgaaaagggatatacggagacgatttatggtcgtcgtaggtattttccgggcttgaagtcgccgaatcgtgcggtgcgtgatgctgcggagcgtgccgcgttgaatgcgcctattcagggttctgctgcggacattatgaagattgccatgattcgggctgatgatgcgttgcgtgaggctggtcttgccagtcggattattttgcagattcatgatgaacttgtggtggaggttgcgccgggtgaggcggagcgtgtcactgcgttggtgaaggatgccatggagcatgcggtcgatatggcggttccgttggatgtttccacgggtattggttcggattggcagcttgccgcgcactgatacggtactgggtttcgtgtgtgttgcggatgtgcgtggtcgagcaatggcataaggaggaatgatggcaacgctgaagcaggttgtggatgtgctggaaacgttgtatccgcttcgctatgcggagcagtgggatgagcctggtcttatcgtgggtgatttgcgtcagcctgtgcgcggtatcgcttttgcggctgatccctctatggcggtggttgatcaggcgattgccggtggtgttgatttgctggtttgccatcatccgttgttcttccgttccgttcatgcggtgtcgggattgggtttccgtggtgagattgtgcgtaagctcaatcttgccggatgtgcgttgtgggtggggcatacgaatgccgatgcggcgtatcgtggcgtcggcatggctgcggctgacatgttcggtttggtggatcagcgtccgctggtgcccatcgatgatccggatgccgagcatccggtcggtttggggcgtgtggggcgtcttgccgaacctgtggcgttgcgtgatttcgccagtcgagtagctggcgcgctgccgtacaccgagcttggcgtgcaggtttgcggcgatctggacgttccggtcagcacggtggcggtgcttccgggttccggtgattccttgttcgatgaggtgcgtgcggccggtgccgacgtgtatgtgaccagtgatctgcggcatcatccggtgacggacgccatagagcaggcccgctatgaggcttccatgcgtgcttccggcgttgccatgggccatggtgacgggcgtgtgcgtccggcgttcgtcaacactccgcacagcgctatcgaatccatgtggttccagtatgcgatggaagacgttccccatgcggttgcggaagcgaccggcgacattcctgccgtgcgttggatttccatgaataccgatccatggaatatggtatttccttcgagcgggcaggaacggtgacgcgtcatgtgtgacgaggcggtagacggaacccaggtggacgtattgctggatgaatccagcgatggcgtggacatgtccggtatggtcacggtgcttgacagcaggcatgtgtatcagggtgcgattttcggcgtcgacgacctgcggatcgcattgccgatgcgtgacggagggcaaacggtgattcgccgtcaggtgatgcgtcacgcgccttgcgtggtcatgctggtgcatgattgcgcgaatgacctgtatctgatcgaacgggaataccgtatcggctgcgacgccttcgcctacggtctgccggctggactcatcgacgggggagaggacgtggaggaggccgcgctgcgggagcttcgtgaggaaaccggtgtggagcccgccgggcgtgacggtgtcgaattcgaccatgtggggcagttttactcgtccgaaggcatgaccgacgagcttgccaacatcatggtgcttcacctgcatgcatggcatcccgtcgaacgtcatttcgacggcgatgagcacgtcgaatcggcgtgggtctcctggcagcggctgcgcggcacccgtattacggcctccaattccatgatcgctattcttcacgagcaaattcgacgaaaccggcaaaatacaggcaagagttctttcgaatcgtaaaaataatcgccgaacaacacgaaattgcgatttgggggctgaaacgtgagatacttgaatcatgcaaatcagacccggatcgatgtatccactcggcgcaagctatgacggcgccggcgtgaattttgccctcttttcccaagtggcacaaaaagtcgagctttgccttttcgatgaggaagacaacgaaactcgaatcgaaatgaccgagcagaactcttatgtctggcacaactatctgcccggaatccaaccggggcaacgttacggctatcgcgtgtacgggccatacgacccgacgcaaggcctgcgctgcaacccgaacaaactgctgcttgacccctacgctaaagccatcgaaggcaacatcgacggcgatgagagcctctactcgtactggttcagaagccccgatgacgttaccagcatgaacacgctcgactcggccgcccataccatgaaagcggccgtggtgaacccctatttcgactggggcaacgaccagcatccgaacatctcatatcacgattccgtgatttacgaagcccacgtacgcggcatgaccaacctcaacatggacgtgccgccggacattcgcggaacctatgcgggtctggcgtacccctcggtaatcgaatacctgaagaagctgggcgtcacggccatcgagctcatgcccatccaccagttcgtcaatgacagcttccttcaggaaaaaggcctgagcaactactggggatacaacaccatcggcttcttcgccccgcacaacgcgtattccagctccggacagcgcggcgaacaggtcaacgaattcaaatccatggtcaaggcataccatcatgccggcatggaagtcatcctcgacgtggtgtacaaccacaccgccgaaggcaacaaccgtggaccgaccctcagcttcaagggcatcgacaacggcgcctactaccgtctggtcgacaacgaccgcagacactacttcgacaccacaggcaccggcaactcgctgctgatgcgctcgccgcacgccctgcagctcatcaccgacagcctgcgctactgggtcaccgaaatgcacgtcgacggattccgattcgatcttgccgccacattggcccgtcagttccaggaagtcgacaaactgtcggccttcttcgacatcgtcgaacaggatccggtgatctcccgcgtcaagctgatcgcggaaccgtgggatctcggctctggcggctatcaggtgggcggcttcccgtccagctggtccgaatggaacggccgctaccgcgattgcgtgcgcgacttctggcgctcgcagccgtccacgttgccggaattcgccagccgattcatgggcagttccgacctgtatcaggtcaatggccgccgaccggtcgcatccgtgaacttcatcaccgcgcacgacggcttcaccatgaacgatctggtgagctacaacgagaagcataatgaggccaacggcgaaggcaatcgcgacggcgaaagcaacaaccgttcttggaactgcggtgtcgaaggtcctacgaccatcaaggatgttaacgagcttcgtcaacagcagatgcgcaacatgttcgccacgttgctgctcagccaaggcattccgatgatctgcggcggcgacgaagtggcgcgcacccagcagggcaacaacaacgcctactgccaggacaatgcgatctcctggacgaactgggatctggacgaggatcaaaaggacctgctcgaattcgtatcgaagctgatccatttgaggcttgagcatcctgtgctgcatcgccgccgcttcttctccggtcgcgagcagggagacgacagcactgcgattccgcaggtcgaatggatggatcataccggctccattatggatatggacgactggtcaaacacacacgccttcactgtgatgatctatctgaacggttccgatattccggaaaccgactggtacggcaatcagatggtcgacaatgatttcattctgattttcaacgcgcattacgagccgatcatgttcaccctgcccgatgagcaatatggcaagaaatggcgcttaattgtcgacacgcataatccaaaggggccagaactcaattatgaggccggttttgcgattactgcgcaatcaagaagcttcctgctgttgatgagcgacaagaagccgtccaacaagcactacaacttctgacggcgcactcgcgttatgccgtcagaatccagtggggtggagtcgtcgccaatgcgatggctccaccccactggtatgtatatgttgaaatccggcggttgccggtcagccttgcatcagacttgtgcggcgagcctcgaaactgtgtcgggaacagtttcgctgacttccgcaagatcctcgacggagcgtggtctctcagattgcgccagtatcagctgcgtctgcacgcgatccgcttcgatggcggcgatttgacgcgagaaaatgatgaaccagccaaggaacatcatgccggccaacgcctccacattcgtcagcgtgttatgcccgctcagccattggaatccggcataagccccaatcgcaatcgcaagatcggaaaccacgtatacgacctttgagagttgcggggcaagccaaggcagggcaatcatcagcacgctcatcaaacatggtaggccgcgggcgaacacgttgtgcaaaatcggatgcggtgtgtaacggaacatgccgatacctacgaaagcgatgccggccaacgtcaacatgattgacagcagcagaatcctcgtacgaaaatgcttcggcgtctcattgatggcattggaatccagatactgcaattgcagacgatacgtggtgatgagctcggaaacggcgaaatagctgatgatcacaatgcagatgcccgcgagcgtcagcgtcgaattgaacatacgcgcggcgaacgtcgtacggtcgcccaattgagagaaattattgttgtaccagtacggatcgtcggacgtcaatcctgcgatactcacgccagacaccacgaaaaacggcagtagggaagcgatcgttttggcattcataagttccgcctgcacgaaagtgatatagcctacaacgcctgcgatagccgcgcataggatcggcagatagcctttcagcgtgcggatgcccatcatgttgttgacgatggacaacatcatgaacgatgtgacgaaaatggtcgaagcatacaccatggaaagcgcgaggatctcgaaaatacgacggaccggaatagcccaaccatgtttgagtgtcagcgaacgtgattttcgtgcgtaacccaaactgaatgaaacgactccgcatcctgccacgattcccgcgcagacggtgaacagacgctgcgtgacacgccagatggccggggcgaactgcatgtatgcgttcatgacgaaccaggcgataacggcgcatgtcacaaaggagatgatgcctgacgattcggcctgctggtgacgtcccatgccactctcccttccgaaatgctattgtaagcctgtcgttgtccaaccatacgctataatagaaactcgtgttcacttgatgcgattccgtgaggcggattcgcggggtgtgaacgtgaacgggctgtagcgcagtttggtagcgcgtctgctttgggagcagaatgtcgcaggttcaaatcctgtcagcccgaccaaaaccgttggaaacaaaggtgtttcagacggtttgaaaaatcctttccccggtttccggtacaaacacgacgatcgtgggaattcctcgtggcattttgtgatattcgcatagttctgtctgcctgggttttcaaacggaaatggtatggatggcatttgattgtcgagttcgagcaagatacgggtgctgtatggcgagattgaaacgttgttttccacgggttttggatacgataagccctatgaacgcatctcaagagaatctttggccggcgccgtttgccggcaagacgctcgacgccaccgttgtggtgccgggcagcaaatccctgtcgaaccgctatctcattcttgcggctctcgggcatcgtcccgtgcgactggtcggcctgttgcgttcgcgcgacaccgagctgatgatggacgcattgcgcgcgttgggagtgcgctgcgaaatcgatgagcaggtcgacaccacggttacggtggtgccgccatccgacggccggttccacggtggtacgaaggtgttctgcggtcttgcgggaacagtgatgcgctttgtgcctggtcttgccatgttcgcggatggtcctgtggatttcgacggtgacgagcaggcgtacgcgcgtccgatgaagcccgtgttggacggtcttgaacagttgggggcatgcatcgaataccacggcgaggaagggcgcctgccatttacaatcactccacctcaaacggtgagccagtgcgccgagccgagcgtagtcagcattgattcttcgggatcctcgcagtttatttcgggactattgctcatcggctctcgagtgccaggcggtttggaactgcatcacacgggggagaagacaccgagtttaccgcatattcgcatgactgtggccgatctgcaaggttccggcgtgcgcgccaacgcagacgaacacgcccgcgtatggaccgtgcagccgggagccgtgcagttgcccgaaaccgtgacggtagaacctgacctgtcgaatgccgccccgttcctcggcgccgcgctcatcgccggcggaaccgttcgcgtgcctcactggccggaatccaccacccagccgggcggcctgcttcccggatacttggaacatatgggcgctgaaatcagcttccccgtgatcgacggcgtccggtactgcgaagtgaccggcagcagccatatcaacggcttgggtgatttcgacctgactgcggccggcgagattgcgccatcgctggccgcaatcctggtcttcgccgacaagcctacgcgcatgctgggcatcggccacttgcgcggccacgagacgaaccgtctggaagcattggtcaacgaaatcaccagagtcgggggagaagcccgtgagctggccgacggtctggagatcgtgccagtgccggcaacgaatctcaagcccgccaaaatggaaacctacgcggaccatcgcatggcgacgttcgccgcaatgcttggtctgagcatcaacggcatccaagtcaagaacatcgcgaccaccgcgaaaacgcttcccgatttcgcgaatatgtggaccaacatgcttgcctagcaaggattgtcagagataatccgcaaataatccacgatattgaaaacggtacggaaatgtccttcctccgcaaaaacggaggaaggacattctacgtttgcacaggatcgtaatcattctgcggatgccgctatgtcaagccacgatggttcttagctttcctgacacggcttggccttgtccggcccaacatggcaaaggtagtggcgctcgcaaacgtcataatgcctacgaaaaacacggaaccaatggaaacctgacaccgtacgtaaagaggtaagcagcgacgaggcatccgacaccttgagaggtgttatctggctcgagcctagaaggcggaaagcatgatgaagcccccggaagtttcgcactttcgggggcttcatcatattgattgcgattttgcgttcagtaacgaatcagcttggaatcactcccactcacttgttcgaactgggagaggcattttgcgccccctctgagcaaaaatttttcaacttttttgaaaataaaaaaagccgcctgttttaaatttgaggtcaacagatggcgggtagaaattttcatatttatgatgtataatatgtgatattaaagattgataaatcagaattcgtaggtgcgattgatgaaaattattgaagttaaagaaaataaaaaacaaggctctgttagaccaaggttgactttttgacttgtattgtagttgctgagtagctacaatagtggtatgagaacgggcaaggtggcgcgtatagccgatagggtcaggaaggaactgggcgaactgacgccgcaggagcgcgaccttgctgtcaaggcgttacgcgccgccctgtacgaggggttcgcgttggacgcggcgacgagcgacccgaaccagatggaggcgtgcgtgcgctgcggcagcatccgcatcatccgcaaagggcgtggacgtgacggctcccagcgttggaagtgcatgaactgcaacaggacgttcggcgttcgcacgaaccgggtgatgggcatgagcaagctcaaagcgggcgtatggatgcggttcctcgaatgcttcgtggattgcctgagcttgcgcaagtgcgcccagcgttgcggagtatgcctgaagaccgcgttcctcatgcgccagcgcgtcatcgagtgcatccgccgatacacgcccgtactgcgttccgaggcaggcatgtccgtccagttggacgagacgtacttccgtgagagcttcaaaggcaaccacacgaagtccgccgtgttcgtcatgccccgcaaggcacacaagcgcaccaaggcattaaggaagcgcggtctgtcgaaggagcagatatgcgtggcgaccggagtggatgacgcaggccggtcgttcctgaccgtatgcgggcgcggcatcatctccaaggatcgcgccatgagcgcgttgaaagtccacatcggacgcggcaccgacgtgctgaccgacggtgcgcccgcctacgtgaaaccgctggccgaactgggcgcgaacctcacgcaagcctccgccgacggtcacgcgatcaacagggtgaacacgctgcacgcccgtttggaggatttcatgttcggcttccacggcgtgtccacgaagtacctgcaagcctacttggactggttccaatggctcgtcgcttttaccgatgggttcggcgagaccgacgacgaccgattgcttgcccgccagctcggcaacggcctgtaccgcatccgccgtcgcgactaccagcgtatgatgccgccgtacatggagtactggcaaaaagccgcatgacatcgtgcatacgatgtacagtcagaacatcgaaacataggacaaggaggcgcgtatggcgagcatacccaccacgaccatgaggatagaaccccagctcaaagaggaatccagccaagtgctcgaagacctgggactcaccctttccggcgcggtcaccatctttctcaaggccgtggtcagggaacaggggctcccgttcgaggtcaagaaggaaacctcgaatggcagataaggtcatccgcatcaaagacctccgtcctcaagacgtgcgtggcgaccgatatacgctgcatcgcggaaacgtactcgatgcgtatccggattgggaggcccctgacctgatagtcagcgatggggcctatggcgtgcgaggattccgaggtgataccgtgagtgcagatggactcgtggactggtatgcgccccatgtggcccaatggtcgaaacgggcgaaaccttcgacctcgctgtggttctggaacaccgaggtcggctgggccacggtgcatccgctgttggaggcgaacggctgggagtacgtgcaactggtcacttgggacaaggggctgtcgcatatcgcgggcaacgtgaacggcaacaccattcgacaattccccgtggtcaccgaggtttccgccctgtaccggcgcaagctgacgcttcctgcggaagacggcaacgtgcttggagtgcagcaatggctacgggctgaatggcaacgctcaggactgcccctctaccgtgcgaacgaggcgtgcggggtgaagaacgctgcaacccgcaagtatctcaccgctgactggctgtggtattggccgcccggagagatggtcgagcgcatggccgagtatacgaaggccaacggcaaacccacgaatcgcccctacttttccgtcgacgggcacaccgagatcaccgccgaacgatgggactccctccgcgccgtatggaatcacgtcaacgggttgaccaacgtgtggtcacgcccaccgcttcacgacggagaacgcctcaaggggaccctgcaacgcagcgcgccacgagtctacaaaccctccaaacaatcagcggcgcatctcaaccagaagcctctggatttcatggaccgtcagattcacgccgcatccaataagggggatgtggtctgggagccattcggcgggctggcgtccgcatccgtcgctgccgtgctcaccggtcgcatcgcctatacggcggaaatcgacgaggaattccagaacctggcccttggacgattggcggaagccgaagacgagtacgacacgaaaaacgcaaatgacacgatgaccctcgaaagaaggcaggcatgaccgattacgacggcaaggaccgacctgaacactacgagcttcccgacggggacgaacggaccgaactccgcaacggcatagtccgagcattgtatgcccttccaatgcacttcacatcgcccatcaacgtcgaaggcatcgaggtcaatgacctattctcaatcaatacactgctcggcggcaccatcgaggcccagaccgtcatgctgttgaactccctgcgcagtatatgggacccgcaaggcaaatgggcggacaaagaattccgacgctatcccgaatccttcccggacgtaaggcttgtaggctccaacaaggatgattcgccgctcatcggcatcgaactgaaagggtggtatctgctttccaaggaatccgagccatctctacgatacaaggcatcagccgacgcagtgactgaatgggacttaatctgctgtgttccttggggattgtccaacgttctcagcggcaagcccgtggtctacgaaccctacgtcgaacaggcgaaattcgcctccgacatgcgcacttactactggaatcatcgcagaggagacaactccaaacgagactgtggcatccatcatccggaaaccaccccgtatcccaaaccgggaacgcaatatgttgatgttcccaatcaagacggaggaggcaactttgggcgtatcgccagagtggatggtctcatggcgaattgggtggacgaatccatggacacgctcatggcgggtatcgaagcgaagtactgggtgtcgttcttcaagctattctcagaaggcaggccaaaagaggaaatcgaagcggaattgagcaacatcgctcgcaaggtgcgtcaggctggccggcccgaccacaaggcgtccatgctggaagagcagctactcgcacatttgagcgccatcgtcgatctgtccctgaagtagactgacatttacccgcttgtttgcttttcaacatagttaaacaagcgggtttttgtcatatatcctcttaggtcaaccttggtctaacagagccaaaaacaatatcttgatttgctcctattagcagatgagcaggaagatatggttgaccgttatcttgataacggcaagatgtatgtacttgatgataatggggtcaagtgtgagtgtgtcataaccgataaagaaaatgacatacttgaaatcaagaacattgcgacggttccagaatatcaagggaaaggttatgcaagagccttaattgagtttattgttaataattacagagagcaatatgccattctgcaagtgggaacgggcgatagcccactgacaataccattttatgaaaagtgtggttttgtccgttcgcatatcatatcaaatttctttatagataattatgaccacccaatctatgagagtggaatacagttggtagatatggtgtatttgcaaagaccgttataatttaaattcaagtttatggagagtcaccgttatgattagagaatttaaaagggatgatataaataaagttgcagatatatggttggatacaaatataaaggcacataattttatccccgccgaatactggaaaagcaatttcaaatcagcaaaagaagcgctgttactagcagaggtttatgtgtatgagtatgatacagaaatacagggttttatagggttaaatgatgaatatgttgagggcatttttgtttctggtgaaatgcaatcgcagggtataggtaaaattctgctgaattatgcaaaggataaaaggaataagttgcacttgaacgtataccaaaagaacgcacgggcaatatctttttataagagagaaggatttgagattcagcatagtggcttagatgaggctaccggagaaaaagattatgtaatgacatggcaacacaaatagaaattccagtttatcgaactaaaacataagaccgcttacatcgtgtaggcggtcttatgtcgtggcaagattatttgattttgagctttcttttcttggcagaaagcactttgcagagaacatcatcgacggcgtcggtgtatctgccttgttcaatcaatttgtttttttttagatttataaggaaagcaacaatttcgtttctttcttttgtacttaaatatatatggtattttttctgttttcatactatccacctcgctgttttatctgatttgatgatatattaaagagaaaattttatcaaatatgcaaaaaggcttctgcccaaaacagggcaaaagccttaaaaattatgcgatttttaggtttagttgcaagccaagggggactattccatctgttgcaaaatcggttgcccgaaaagtaccaagtcccgaaacccgcataaatactgggtttttcggcacatctaaaccaaggggaactactcccactcgcaaaatgaaacttaattctaaacgcttttgtttggggaatttgataccatttgatttttcctgatacctattatccttatcctatgggcttgccgaacttttgctatcatttggctatcaaggaaatggctatcaacggtaaaattagattggtttctctggtggtttacaactacattttaccacgaaagacagggaaatgcaataaccttcctcgctgtggtgtatcaagtgatcttactgaacatatggcgcaccttgtccaggcggctgtttggacggcggggctggatgactggcttgccgacagcggcctgataccctttcagttctgtaaggcatacgctctgcccgttggtgtaaaaggccagatcagtacggtatgcctgtatacagcgggcgggaatctcgccagtaaagacaacttcatccttttttacctggaccgtttcgatggtggcacagtatttcggtgcatcatgataagccctggaaagatattcccggggcgcatagagggtgaaggagagataaggttccagcagttgcgtccctgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgggagtggtgtaacagacagtccgatggatgcccaaaacgggttgggcggcacctcgatatggatggtgtggctggctgctttgagcggccgctccatataaatgacggtgggttcctttaccactgtttcaagcttgtatttttccgacagcaaagcggaaacaacctccaactgcacccggcccaaaaaagaaagaatgatctcatgggtgatggaatccacctcgcagcgcaaaagcgggtcagtatccgcaagttgcgtaagagcgtccagcagccgttctctttgcgctgccgttttcggcgcaatcgacgtccgcagcatggggagggggtcctcacgccaccttttacgagggagccgggttgggtcccctaatacatcgtttaacctcacgctgtcgctgggaaggataacaatttcacccggataagcggtgtctgtccgaacaatttcccctttggatggaatacgcatctctgtgattttcagcttttctctcccggccagggccaccgtatcccgcaggcgcagcgttccgctgtatagccgcagatagatgagccgctggtcacaatctgtatactccaccttgaaaacgctgccgcatagggcggcgctcccctgttccccaatcggttggaacagccctgtcaccgcatccatcaacggttgaatgccaaggccctttttggcgctgccataatagaccgggaacagggaggcgtcttgaacccgccgctgttcctcccgcacaagtttttcccggctgattggttctcctgcgatatacttttccaataatttatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttgactttacatctgtgccactggaaggaagtgactgccgcttgaatggtaatcccacgctgccgctccaaaagcatggtgtccgtcctcgttgtccctttttcgacgctccccggttctgaaatggctccgctggcatatagcaggctctccgtcaaggttgtctttccagcgtctacatgggcaagaatcccgatattgataatgttcatgtctatcctccatacaaggcccaaatgggcgcaaaaatccccagcggctaatacttttaccgctggggatcatgacttcggacaaacagaagtatgacggcttacatgagccgctgtccgtcacgatatttactaaaaaggcaaaagtattcttaaattgggtacaaaaactaagcccctgcaaggggcaatcatttttgcgcccattatcaaattttatttaagaataccttgccgcatatttggtagactcctcaaatcaggataatagtagtatatcatagtacgaatagtagtatatcatagtacgctctaaaaagcaagaaattattttacccgattccccaaataaatcaggagggcattcactggaacaccctccggttttggtgattatcgtgcgcctacccttgttttttgccttgcggcccgtttccgttccttttcggcctgttcctgctggtaagcggcctctaatattctgtccgcctgttccgtgccaatggcccgcctgacccgctcatagtctctgacctttccctttaggctgtctcgctcggcgcagacctcgtaaatcctttctgacaaggaactgtttttgctgacctcccggccatagtccgcttgcagccgctcaaatttggatttgaggtcacagtaggcccgatagacagaccgtagcaccttgacgatcttcgcccataagggcttggcctttttctcccggtaggccctggctgattccagcggccccgcttctggcaagacctgttccgggtcgctggaaaattcctccgccagcttctccatgcctttcagcatgggggccacatcgtttagtttggccttggcctgggccgctttcttttcggcagctgtcgcctccctgttccttcggtcaacctcggcctgggccagcacagccgcctcttgaagctgtgccaaccgctcctgttcacacttcaccttgaactgcgtgaccgtcagatgttcctcggaactgccacgctctccacgctccaaatccgtgtagccagcggagcgcatctgctgaaagaaatcatcctgcaagacgctgtacgactttctcagaacaggcttgccctttgctgttcgtaatggctccccggtggcctcgtctactgcgggctgggacgcccactttttgctcatgctgacctgcataacggtttccttgaccttgcccaccagggatttgtccttgcaccgctttgtccatcgtatctccttcttcaccaccgggatatagaccacatgaaggtggtagtggtacacatcctcccccagcgcctcggacatggcccggttgcgctcgtcagcgtgcatgaccgccgacaaaatatactgctctccacctacgattttgattgcggatttgtaagcgtcggtgtaaaattgttttgcgaagtcatagccgccgtgattgtagaagtaggcggagttcacatcaaagaccaactcaccgtatcgaaatgcgtccgccttaatgccacgggtggagatcacaccatcggcctccatttgggagaacatctcctgataccctgcagatggggccttgaaatggacattgagcggcgtccgctctggtacaatgtcctggttgacataggaatccttctcacgctcgttgtgctgctgggtgttgccgatcttggtttcggtcagcctcatatttcttgcgttggtacggtcaataccgtcgcctctcgccataggcaaaaatcctcctgtttcagatgtttggttgttgaaaatggacgggggttcgggggagtcacttcctgcgggaagtgtaataacccactatgacactttcgccccgttggtgcgaaagtgccgtgggctctcccgagggggtgcgggggctttgcccccggcaactgcggttgcctcccccagcagggccgccctttgaaaagggcaccctgcaccccgcctaaacttttccactcgccgttgggcaggtggaaaggctgtgcctttccaccacccggcaagtgtcctccgtgggccaaatgtcaaggggttcgggttgtattgccttgcggcaatctccacccgtaggtatgcccccttgacatttgaccccgctcccccgtgacagccgtgacgaccgtgacgatgttttagacaccgcccccgctctcaaaaaagccgtcacggtcgtcacgcttggggaggctccagcgtcaagctgatacttctcccggcgtgggtacgggtgttctcataatggatgtgatactctgccgccagtttcccggcccggacgttcagccgcatagccaaggcgttaggcttcatatccacttgcaggaccgctgccaactccgtggctgtaccgctccaggacggcctctccgccgtaataaaagcggctacggcctccagcaccgggtcggggggttctacccacaactccgtttccatccgctccagtgtccatgttaggtgttccttgtccttggtgagatagagccgctggtcttgctggtcacgtcctaccacatccagggtggcggtgtcgtctgtccgcttctccttctgaagaagaaaggccccatccgccgcccccgacaggccgttggtgccagagatcatatcaaacttgtcgtcggcctgctgtttgcgagtgtgatgtaccagcaggagacagacgccgcaagcgtcagcgaggcgtttcagctttcccaccacctcataatcgttggcgtagctgtatttatccccgccagcctcccggattttctggagggtgtcaatgataatcagcttggtgtcggggtgttcctgcacgaaccgctttagctgttcctccagcccagcgccaacctgtttggcacagatggaaaagaggaggtcgttggtgccgtccatgccgaacatccggtaaagccgctcctgcaagcggcggtgatcgtcctccagcgccagatagaggacagtccccttgtgaacgggatagtcccacagggggaggcccatgctgacgtggtaggcaagctgggccatcaggaacgacttgcccaccttgggtgctcccgcaaagaggtacgtccccggatagagcagaccgtcaatgacgggcggtctgctctgatagacgttctcgtacaactcgttcatggaaatcgtggggagatacgccgggtcattcatgcgctgcattttccgcagcagttccgcataatttttttcagggggattgttttctgtcgtttcctctgttatacttgcggtgggtgtttgtgaaatgggctgttccccgtctgcgccaacagacggaaccgggacagtccctttcgtttccttggaatccatcaatctatcaaacctccttcatgccgcccatgatagcggcgatcatctgaatggtgtccagcagttcatcgtccacgccagccccgtcctcggcccgccgcagttcgtccagaacggcggcaagctggtcacgcagggccttgtagaccttgggattaccctgtaccactacttcccggcacaggaggcgtcttgtgatgtagtcctgctttgtcaggccggagagccgcacagcggcctcgatctgttcatcttcctccggggacacccggaaggccacggtcttgttcctccagcgatttttgttgtctcggtttttcagtgacatggttacgttcccatcctttcaaagtccagcttgtccgccatctccgtctgccttgtaggaaacagatgggcgtagcggtaggtgatgtcgatactctcatgccccacccggtcagcgattgccagggcggtgaagcccatatcaatcagcagggaaatgtgtgaatgtcggaggtcgtgaatcctgatccgcttcactcccgccgctttcgcacctctgtccatttcatggtggagatagtgcttgctgacagagaaaatccgttcatttgccccggtgctgtaaaacatctttaagtagtcctccatctctccacagaggaatttgggcatcttaatgacacggttgctctttttcgtcttgggggtggtaatcacgtccttgcccttgagccgctgataggatttgctgatggacactgtacccgcctcaaagtcgaagtctgttggggtgagggccagcagttccccctcccggataccgcaccagtagagcatttcaaaggcgtagtaggagaggggcttgtccatcatggcgtcggcaaacttcaaatactcgtccttcgtccagaacagcatttcacgccgttcctccacacccatgttcccggccttggccgcaggattgacctggaggccgtagtagcggacagcatggttaaagagggcgctcaactgattgtggacggttttgagataggtgggggaatagggctttcctttggcgtctgtcaactcccggatcgcgttctgccaatccatcacatccttggcggtgatttccgacagtttccgctttccaaaatacggcaggattttcttctggataatgctctcttttgtcagccaggtgttcagcttcagcttgggcttcatgtccttttcatagagctgggcgaagctctcaaaggtcatgttcacatcggcctgcttctgcatcaggaactcccgctcccacgtctgggcctcctttttggtggcaaagccacgcttcaacttctgttggcgctctcccttccagtccgtatagcggaactggacgtaccaagtgccgttggccttgttcttaaacgccgccataggttaatcactcctttcactctgaccccttgtgccataaaatttttcgtggaagaatttgcggtcgatccggcctgaaatggtaatacagcccgtctttttcaactccgcattcatggaacgaatcagcttataggcataggggacagaaacccctaattcctccgctacctcgtccacccgcatgaacatggtgcttgccattgtgagctcacctcctttcatggctcgaaaactaagcctttatgcttaatctattataactaagcaaatttgctttgtcaagtggcttgcggaataatttttaacttttttgtttaagatactcttgactgttactaagcgaatatgttatactactttcgacagaaaccaccagataggagttggcatttatggcaataggagagcgcatccattttttccgcaccctccggggtatgacacagaagtatcttggtatggcggtgggctttccagagcgttccgccgatgttcgtctggcacagtacgaaacaggcacccggacgccgaaggccgacttgaccgctgccctggcgcatacattagatgtatcgccccaggcgttgagcgtcccggacatagacaactacataggtttggcccatacgctgttcgccttggaggatgtttacagtctgaaagtggtagaggcggatggacgtgcctgcctgcaagcagatatttttcagggaggccgtcaagccagtgagctgaacaaaatcttgattgcgtggcgggaacaggcggcgaagctggaggccggggagatcaccaaggaggactatgaccgctggcgctacaactacccgaagtacgacaccacccagcggtgggccaaagtcccctcgaaggaattaagcgatgctctgataaaaggattgaagaaacagagaaaagacaaataacaaaaaaggtcttgccgactggtgaaagtcagcaagacctttttcttaggatatggaggatttacccgcaaaccacccgttatacgggagtgaacaaagtaaatccggttttggtatctgctatcaatttgctatcaaatgccccgtttccgctttaagaccccagtgttttcaaggctttgctggttttgtcagttattcccactcgatggttgccggcggcttggaggtgcagtcgagcaccacacggttgatctgacggcattcattggtgatacgcgtcgaaatcgtggcaagcacatcgtacggaatgcgagaccagtctgcggtcatggcgtcttcggaggaaaccggacgaagcacgattggcgaaccgtaggtacgctcgtcgccctgcacacccacggaatgcacatcggcaaggagcacgaccgggcactgccagatatcgcggtcaagaccggccttggaaagctcctcgcgagcgatggcgtcggcctcgcgaagcagatccagacgctccttggtgatctcgccgatgatgcggatgccgaggcccgggccagggaacggctgacgccagacgatttcgtccggcaatccaagctcggtaccgatggcacgaacctcatccttgaacaaggtacgcagtggctcgacgagctggaacttgatgtcgtccggcaggccacccacattgtggtgcgacttgatgttggctgcgccgtcgccaccgccggattccacaacatccgggtagagggtgccctgaacaaggaacttgacttccttgccggaagcacccgcctcttcgatgacctggcgctgagccttctcgaacgtgcgaatgaacttttcgccgatgatcttgcgcttcttctccggctcgctcacacccttcagggcggtgaggaagtcttcggaggcgtccacggcgatgagcttgatgccggtcgcctcgacgaaatcatgcttgacctgctcggcctcgcccttgcgcagcagaccgtggtccacgaacacgcaggtgagctgatcgccgatggccttgtgcacgagagccgccgcgactgcggaatcaacgccgccggacaggccgcagatcacctgtgcgtcgccgaccttctcgcggatcttcgcgacctgatcctcgatgatgctggaggcatcccagttgttgccgagccctgcgcacttgtgcaggaaggtctcgatgagctgctggcccatcggggtgtgcttgacttcaggatgccactgcacgccgtacagtttgcgggattcgtcctgcatggcggcaacgggcgcgccctcggtatgcgccagcacttcaaagccctccggcgcggtcttgacggccacgccatggctcatccacgtgttctgatcggcgggggagccgtcgagcagaccttccgacttgtcgatgaaggtctcggtcttgccatattcgccaagggcggccttgtcgacattcgcgcccaaggcataggccatggcctggaagccgtagcagatgcccagtacgggaacgccggcctcgaacagtttcttgtccacacgcggcgcgcccggttcgaacaccgaagccggaccaccggaaaggatgatggcctgcggatccttggccagcatctcgtcgaccggcatggaatgcggcacaagctccgaataaacattggcttcacgcacgcgacgtgcgatcagctgggcgtactgggctccgaaatcaacaacgagcacaggacctgcagccataacactctcccttttgatatgaggtatgaagaagcaacaatactaactgttctattgtggcgacgcgagcagacattggaaacgctgtgaacagaaagtgaacaaacctcacaattgcttactacgcatggttcaacacgccgcatgcaagtattgcaaaacgaacgtgaaaaaggtgtgaggatggcttgatatcgttgatattgagccgtttatcaatctttttgatagcatgtgaagtattcacaaatctcccgataaaagctctcattttctaacagaaacgacacacttgcgcacacagtcgcaaaaaaacagcaaaaagtcgcacctcgctcgtaatatgctcaagtgattgggaatgaatcgttccgcggaaccgcaaggttttgcgagattcaggaccgaatgaaaataaacaatcgcacaacacagtgcaggagtacaggagtacacatgacgagtcctgttattggcaccccttggaagaagctgaacgctccggtttccgaggaagctatcgaaggcgtggataagtactggcgtgcagccaactacctctccatcggccagatctatctgcgtagcaacccgctgatgaaggagcctttcacccgcgaagacgtcaagcaccgtctggtcggtcactggggcaccaccccgggcctgaacttcctcatcggccacatcaaccgtctcatcgctgatcaccagcagaacactgtgatcatcatgggcccgggccacggcggcccggctggtaccgctcagtcctacctggacggcacctacactgagaccttcccgaagatcaccaaggacgaagctggtctgcagaagttcttccgccagttctcctacccgggcggcattccgtcccactacgctccggagactccgggctccatccacgaaggtggcgagctgggttacgccctgtctcacgcctacggtgctgtgatgaacaacccgagcctgttcgttccggccatcgtcggcgacggcgaagctgagaccggcccgctggccaccggctggcagtccaacaagctcgtcaacccgcgcaccgatggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgcagcccagaccgacgacatgactcgtccgttctacccgatgatcatcttccgcaccccgaagggctggacctgcccgaagttcatcgacggcaagaagaccgaaggctcctggcgttcccaccaggtcccgctggcttccgcccgcgataccgaggctcacttcgaagtcctcaagaactggctcgagtcctacaagccggaagaactgttcgacgagaacggtgccgtgaagccggaagtcaccgccttcatgccgaccggcgaactgcgcatcggtgccaacccgaatgccaacggtggtgtgatccgcgaagagctgaacctgccggccctcgaagactacgaggtcaaggaagtcgccgagtacggccacggctggggccagctcgaagccacccgtcgtctgggcgtctacactcgcgacatcatcaagaacaacccggactccttccgcatcttcggaccggacgagaccgcttccaaccgtctgcaggccgcttacgacgtcaccaacaagcagtgggacgccggctacctgtcctcccaggttgacgagcacatggctgtcaccggccaggtcactgagcagctctccgagcaccagatggaaggcttcctcgaggcctacctgctcaccggtcgtcacggcatctggagctcctacgagtccttcgtgcacgtgatcgactccatgctgaaccagcacgccaagtggctcgaggctaccgtccgcgagatcccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgctgtggctgagaagtgctacaagtccaccaacatgatcaacgcgatcattgctggtaagcagccggccgctacctggctgaccctggacgaagctcgcgctgagctcgagaagggcgctgccgagtgggagtgggcttccaccgccaagtccaacggcgaagcccagatcgtgctcgcctccgctggcgacgttccggctcaggagatcatggctgctgccgacaagctcaacgagctcggcatcaagttcaaggtcgtcaacgttgtggatctggtcaagctgcagtccaccaaggagaacgatcaggctatctccgacgctgacttcgctgacctgttcaccgaagacaagccggtcctgttcgcttaccactcctacgctcgcgacgtgcgtggtctgatctacgatcgcccgaaccacgacaacttcaacgtccacggctacgaggagcagggctccaccaccaccccgtacgacatggttcgcgtgaacaacatcgaccgctacgagctcgttgccgaagctctgcgcatgattgatgctgacaagtacgccgacaagatcaacgaactcgaagccttccgtcaggaagccttccagttcgcagtcgacaacggctacgatcacccggattacaccgattgggtctactccggcgtcaacaccaccaagcagggtgctgtctccgctaccgccgcaaccgctggcgataacgagtgagtctagcctctataggctgatcgcttgaagaaaaccccagaggattcgtcctctggggttttctgtttactcttcaccgtctgttcgcaacaccgtttcatgagatgcgtgtctgttaccgttcacgcattacaatggcacatggtgcgaaacagcgcagtcacacaccttaaaaacaacgaataggagcagacatcgtgagtctaaccagcgtcaccattatcagccctgaagcagcaaacggccgcaacgtcgtggcccttggcgtcaccaaggcattcgcagctgccaagaagacggccgtgttccgtccggcggtttgtcgcaaggaaaccttcaccgacgttcttcttgaagcaagcaactcggggctgagccgtgaacaatccgtcggtgtttgcccgaagcgtgcacgcaccgacaaggaaggctcccgggccgatatcgtggccgcctacacggaagccatcgaaaccgcccagcccgaagccgtggttgttgtcggaacggacaaatccgccatcaacgacccgtccatctttgcgttcaatgctgacgtagccgctgatctcaagtccgtcgtgcttcttgccgtatgcaccatcaaccgcactccagaacaggtcctgggcactgtcgaggcgtcgaagaccatcatcgagaatgcaggcagcaaggtcgccggcgtgttcatcaccggatgcaaagacgaacaggtggaacccctcaaggaggagttcgcagcttacgaggtgccggtgtggacgttacccgccgttgattttgacgaggaagacgccgtgaccaaagccacggaggcattcgaggcgaatgtcaacgccgaagagcttatcgccgctgtcgaggctccattcgaggcgccgaccacgccatacgcattccagtacagtctgctgggcaaggccaaggcggacaagaaaaccatcgtgcttccggaaggatccgaagaccgcatcatcaaggcggccgactatctgcttgagcgtgatatcgtcgatctgatcatcgtcggagacagggaaggcattctcgcccgcggcgaggagcttggtctcaaatcccttgaaaaggcgcagttccaggccaaggacgacgaggaagtgctcgctccgatggtcgccaagctgtgcgaactgcgcgccaagaagggcatgaccgaggaacaggctcgcaagcagctcgccgacgacagctacttcggcaccatgcttgtggtgctcggcaaggctgacggtctggtttccggatccatcaactccacggccaacaccgtacgtccggccctgcaggtcattaagaccaagccgggaacttccctcgtgtccggtgcgtttctcatgtgcttcaaggaccatgtcgcagtgttctccgattgcgccatcaacctgaacccgtccgctgagcagcttgcggaaatcgccatccagtccgccgaaacggcaaaggcgttcggcctcgatccgaaggtcggcatgctgtcgtattccacgctgggatccggcaagggaccggacgtcgatctcgtggaggaagcaaccgcactcgtgaaggagaaggctccggacctcgcggtcgtcggttccatccagttcgacgcggcttggtcgccgaccgttgcagccaccaaggccaagggcaacgatgtggctggccatgtcaatgtgttcgtgttcccggatctgtgcgcgggcaacatcgggtacaaggccgtccagcgttcctccggcgcggtggccgtcggtccggtgctgcagggcctgaaccgaccggtcaacgacctgagccgaggcgcaaccgtgcaggacatcatcaacacggttgccctgaccgccatcgaagcccagtaaaacgctattttgtagcaagcaaagagtaatctaaagtttggaaagtcgcgcaagcggcacatcgattaacacatggaggatgcccacaatggcgaaaaccgtccttgtcatcaattccggttccagctctatcaagtatcagctggttgatcttgaaaccggtgaaggtattgcttccggcctggtcgagaagatcggcgagccggttgacggccactacaagcacgagttcaacggcgagaagcatgagttggaagagccgatccacgatcacgagcagggtctgaagcgcgtgctcggcttcttcaacgagttcggcccgaagctggacgaggccggcatcgtggctgttggtcaccgcgtggtgcagggtggttccatcttcccgaacccggctctggtcaccgacaagaccatcaaccaggtcaaggacctcgccgtgctcgcgccgctgcacaacggtccggaagccaagggtgctgaagtcatgcgcgcgctcctgccggacgtcccgcagatcttcgtgttcgattcctccttcttcttccagctgccgaaggccgcaagcacctacgcgctgaacaaggaaatcgccgaccagtaccacatccgccgttacggcgcccacggcacctcccacgagttcatctcctccgtggtgccgagcgtcatcggtaagccggctgaaggcctcaagcagatcgtgctgcatatcggcaacggcgcttccgcctccgccgaagtttccggcaagccggtcgagacctccatgggcctgaccccgctcgaaggcctcatgatgggtggccgtaccggcgatatcgatccggccgtcgtcttccacctgatccgcaacgcccacatgaacgtggacgagctcgacgctctgttcaacaagcgttccggcatgatgggcatgaccggcttcggcgacctccgtgaggttcaccgtctggtcgccgaaggcaacgaggacgccaagctggctctcgatgtctacgtgcaccgcatcgtcggctacatcggcaactacaccgctcagatgggcggcgtagacgtgatcaccttcaccgcaggcgtcggcgagaacgatgacgtggtccgcaagatggtgtgcgacaagctcgccccgttcggcgtcaagctggacgaagagaagaacgccacccgttccaaggaaccgcgcatcatctccaccccggattccaagatcaccatctgcgtcattccgaccaacgaggagctggcaatcgcccgcaagtccgcggcaatcgcagaagcaggcgaagacacttacggcaacgtcttctccaagtgagcgaggagatcccgcagtcaaatgattgacgggaccgtatgaagaggaccgtacgttccattggaatcaaatccaatgccaatgggacgtacggtcctttctttttcgaataatccttatgtttcaccgcttttaaggtttcgatcgccgaacgtttccaatcgtcccagacaatgactttccatatctgttcatggtccgcataatgggggaggggctggtagtacgatacgaaacgttgtgcctaacgcgcatacgtcgcatgttgagagaagcggttgattgttgtggtaagacgtcgttttgtcggtctgaatggcctcaagggcatcgccttgatcgcgatagtgttgtatcactgcgaccagggcactctgcggggcggattcctaggtgttgacatattcttcaccatttcaggttttctgattttctcgtcgttgctgaatcatattgattccggcaagggaataggtttcaaggaatattacctcaagcgtctgcgcagaatatacccggcgttgattctgatgattcccgtcaccgtatcgttggcatggttcatcaaccaagacatgttggtggacattaacaaccagatagtgacggctatgctgggttgttacaactggtatgccatcggcagtggcgccagctatttctcgcagatgaatccagacatgttccgtcatctgtggttcatgtcggtgctgatgcagttctatctgttggctcctttgctgatctacctgcttcgaaaaattctggtacgttgggtgccggtggcggtacttgccggacttgccgtgtgcagtgcgctttccatgggattgcagtatcacccgggaaccgatccaaccagagtgtatttcggttcggacacacatgccatgggactttggctaggtgccatgctggcatggctgctgatgatcatacggcgtggcaacggtcgtccggaagaaacggcgatcatggaacgcgctcgtctggtctggagcaagatcggccctgcggcggcttttgtggcattactgattctgttatggatgatgcagcacgttgagcagggtcctgctgccttctatggagggattttcgcggcttcgctactttcagtggttctggtcgccggttccattcctttcggatcttggatgcaggatctgctggtgttcaaaccatttgatgtggccggccgatattcatacggcatttacctgtggcattggcctttatggttgttcaccaaggcgatgttcccccagtggggtgctcggcatctgggatggatgctgctaatcacactcgctcttaccgcatgttgtaccgccatgtcgtggaagttggtagaacagcccgtcgcccgtggcggatttatcgccatgattcgcccgctgccagaaaacggaatgtgggatgtaaccagatgctggattacgatcgccgtggtattgagtacatgcttgatgtccggatacgcggtagccaacgcaccaaagcagaccagtgtggaacgcgcgttggaagagaatgcgaaaatgctgaaagagcagcagggcatgcacctcgacttcgataggaagcatccgccagcgcccaagaaacccgcatacaccatgcctgacgggcagcagatggtcgcattcggtgactcggtgatgcttgcctccagtaaaggtttgcaatccgtttttcccggaatcactgttgatgcggaaacctcacgttcgatgaccaaggcattgggacttatagaccaagccaaaagccagccggaaggattgcgccaatgggtgctggtcggcttggctacgaattcagcggtgaccgatggccaactcaatgacatactgaacgacattggaccggatcatgtgcttgtgctgattaatgcgcatgcccccgtgtcttgggtccccggaacgaacgacgcgttgagcaacttcgcggctgcccattccgacaacgttgttctcgttgactgggacgctacgatttcggcgcatcctgatgagcttgccggagatggtattcaccctggcatgtccaatacgctgtacgcccaggctgtcaaggatgcaattgcgaactggatcaagcaagggcactgaaacatccttcttgcgaatcgcggcaaagcagttttgcgatgaatatgaggaatccccctgactcgtttgagcagggggattcctcataaccttttaggatctgaacggactcagtcttcctgatgctgcggagccgacagaaaatgctcttcactcggcagcagagcattcaacagcacggccacaacgaacgccacggcgatgcaattggatgcgaagatggactggaacagcggcgggaagttgacgaaaatgtcgccgacctgcgtgaaaccgataccgatggtgagactcaacgccgcaatggtgatgttgcgctgcgtatagccggcctcggaaatcatctggaagccagacaggatgatgttaccgaacatcatgatggtgcagccaccaagcacggcctgcggcagggaattgaacacttccgccacggcaggcacgaagctggctatcaccagaatcagaccaccggaaagaatcaccttacggttgacgaccttggtcatggcgaccaagccgatattctgtgcgaacgacgtcaacggcaagcagccgaacaggccggagacggaggagatgagaccgtcgcctgcaatggcgcccgcagtctccttatcggtaggctgacggtcgagaccaaccttggtgagcgcagcggtatcacccagcacctcaacggaagacacgacatacagcagggcgaaggagatgatcgcgcccggatcgaattcaagctggaacggcatgaaatgcggcacggacacaacctgcagattcgcgaaaccagagaaatcgaccttgcccatgaaaatcgcgacaacatagccgacaaccaagccgaacagcacggaaagctgcttggcagtacccttcatcagcagctggaacgccaagcaggcgaccagcgaaatcagaccgagcgtgagattctgccagcttccgaaatcctcagcgccggaaccgccgccgaaactggtggcaccaacggaaagcagtgagaaaccaatcgacgtaaccacaatcgcggatacgatcggcggcacgaagcgacgccaatacttggccgtcaaaccaagcacaacctccaacaggccaccaagcacaaccgcgccggcgaccgcgccgtagccttggttctgggcgatcgacatggcagcagccacataggtgaaggaaatgccagtgaccatcggcaggcgggagccgatcagccacacgccatacagctgaaggcaggtgcccagacctgccaccagcagaccggcctgaataatcgtggcagactgctcggcactcatgttggcggcggaagccaccaagaaaatcggagccagattggccacgaacatcgccatgacatgctgcaggccgaacgggatgcccttccagaacgaaacaggcgcgtccaagctgctaagcgcttcaaaggaaacgcccttcttctcgttcgtgttgtctttcttcttctcttctctcacaatgaatcctctctcattcatgctgcgatgagtaacaggttgtaatggtttctgatgcgcgcccgtgagatgcgacgatcaggagcggaattcgatggtaccggtttccggatccatcgactccacgattgccagggaatcaacgtcgtatcccgctgcgcgcagctcatcgccgccgccctggaaacccttctccaccgcgatgccgatgccctcgaccgtcgctccggcatcatggcacagattgatcaggcccttcagagccttgccgttggccaggaagtcatcaagcaacagcacatggtcgccctcgttgagatacctcttggacacgatgacggggaattccttctgcttggtgaaggagtagacggtggtggtgtactggtcgccatcgagattgatggactgcgccttcttggcgaacaccacaggcgcattgccgaaatgacgcgcggcaacacaggcgataccaatgccggaagcttcaatggtcaggatcttgttgatggttttaccggcaaaatgttccgcccaagcggcacccatgtggtcgaacaattcgacatcgcactggtggttgaggaaagcatccactttcagcacattacctggcttgacggtaccctgcaggcgaatgcgctcttcgagctccttcatgaatccccttagattgttggccgcataaggcggcgttgatgttgacatacggtgaaccgcatataaacgttcagcatacgcgcgtcaattgaccatgcgagtgttgcgctgacctgcatgtgtgatagatatgaatttcgcagtaatcgacttcgaatcttcatggaaagaggaaccggtggagcagaatatgggaccagtcctgtgcgatccgcaaagtctgatcaaggacctcaatccgcagcaaatggaagcggtgaagtactacggacaagccctgctcatcggagctggtgccggatccggtaagacccgcgtgctcaccagacgcatcgcatggctgctggcacatggtttttgggcgagcagcattctcgccatcacctttacgaacaaggccgcggccgaaatgcgcgaacgccttgcgtccctcgtagggcctgaagccgaacacatgtggatctccactttccattccgcgtgcgtgcgcatcctccgacgtgacggcaaggaaatcggtcttacctcaggattttccatttatgacacggctgattgcgaacgcttggtcaagctcatcagcggcgatttgaacatcgatacgaagcggtatacgccgcgcatgctattgggcaagatctcggattgcaagaattcgttgatttcatggcaggaccagctgaaaagcgtgaactgcgactacaagccaggccagcgcggatatcaggtttcggccggcgacgtcgacgagctggtcgccgtgatgtatgcggagtaccagtaccgtctggccatggcgaatgccgtggattttgacgatctgatcatgcgcaccgtcgaattgttccagcgttgcccacaggtgagcgaatattaccggcataagttccgttatattttcgtggacgagtatcaggacaccaaccatgcgcaatatgtgctcgtacgtgagctttccggcattgattcgggagaacagcccgatccacatatgcgaggagcaggccgtgtcggaccgtcttggattacggtggtgggcgattccgaccagtcgatttatgcgttccgaggcgcggatattcgtaatattcaggatttcgagcaggatttccctaacgcgaaaaccatcatgctcgaacagaattatcgttcgacgcagaccattctcgacgcagccaatgcggtgatcgcaagaaatgaaaatcgtaagccgaaaaaactgtggacggcacttggcgaaggcgacaaaatcgtcggatacgcggccgacaacgcgcaacaggaagccggatggatcgccaacgaaatcgcacgaatccacaacgaggaaggcgtggcgtatcgcgacatcgccatcatgtatcgagccaacgcgcaatcacgctcgctcgaagaggccatgatcaatgccaacctgccgtatcagctcgtcggcggcaccaaattctacgaacgcagggaaatcaaggatgcgctcgcgtatttgcaggccatcgtgaatcctgcggacaatgtgaacgttcgacgtatcctcaatgtgccgaagcgcggactgggcgttcgtgcggaaggactcgttgcctcgtatgctgatgcccatggcaccacttttttcgaagcgattgaacatatggaacagatcgaaggcatgtccacgcgcacgacgaaaccgttgagtgcgttccgagacatgatgcatgagcttgcggcttttgcgaaggaccatgacacgaagccatccgaagtggttgccgaagtgcttgccaagagtgggattttggaagagctgcagcgctccgaggatccgcaggacgcttcccgcgtcgataatctttcccagctgcaatcagtggcggcggaattcgagcagaacacgccagacgccacattggcgggatttttggaaaccaccgcgttggtggccgattccgaccaattgccaggggagaacgaagattccggcaaggtgacgatgatgaccctgcataccgcaaagggtctggaatacccgtatgtgttcctgaccggcatggagcaaggcacattcccacaccagcgtgccatggaagacaccagcgaactggcagaggagcgccgtctcgcctacgtgggcatcactcgcgcgaagcgacgcctgtatgtgacacgcgcggccgtacgcgcgcaatgggggcaagccagcgacatgatgcccagtcagttcctcgatgagattccagacgaactgattgattggaaaagacgcgaagccggcgtcgaacgcatgcgtgccagctggcaggatgacgacgacgagttcggcggctgggacgatgatgacgatttcggatcgatgtcattcggcggttcctcgtatggaaagtcggattatggttcctcatacggttccggctcgcggtggtctcgttcctcatacggatcgtcttcatatggggcagggcgctcgcagtacggcggcccggctacgcagggctcatcatcctcgtatggttccacatctcggcgctcgtgcggaggatcgggaaccggttcctcatatggctcgtatggttcgtatggctccggcaagtcaggagggaaatcgggcaaggtcaccacgcgacgtgtcaagccgaaaaacaagcctgtggatttaaccaaatcctcatccgcaagcccggccggtagccataatgatctgaacattgcagacgtgcatgtcggcgacaagcttacgcatgatcatttcgggttgggtacggtcattgaaacgcaggacaagggcatgaattcggtcattaccgttgattttggcaatggtgaggtcaagcgtctgctgttgcgtatggcacccattgaaatgctatgacggagatgaagaacggatgaaatctcctctgtagcacgaaaaggaggaaaaaacaagactttctttttcaaagagaccctgcaataatcggcggtgtttgtctttttttgagaggaagctatgaataagaaactgtacgcaggcatttcgcagatcgtgctcggcatcttgatcgccatcgcgccgcagaccttcgctcacgtatgcgcggtcaaagaaacgccgatggcatgtcattacacggctcaggccgcgctcggcatcggcatcgtgatcgtggcgcttggcattgtcggcctgttcgtatccgatcagacccgcgccggtcttgacctcgccaatgcggtgctcggcgtgctgaccatcgccgtgccgaccgtgctcatcggcgtgtgcaagggtgccatgatgcgctgccatatggtcaccttgccgacgctgatcgtgctcggcgtgctgctggctgtacttgcggcaatcgcggcatatctcgatctcaagccggcgaagcgcgcctgacccaatatgacgcaacacatcacccttggcgggttgcccctggtcaatctcaaacgcaaaccgtttcgtaccgcggcgctcaccatcgttgtcgccatgcttaccgtggccttctatggtggttcactgctgtccatgaaccttgaagccggcttgaacagcatgcaggaacgtatgggcgccgatctcatggtcacgccgcaaaacaccaaaaacgaagccgaagcgttgctgaccaacggatcggcaagcacgttctacttcaccaacgagatcaccgacgaagtggcaaaagccgacggcatcgacgaaatcacggaacaaacatatatctcatcgttggccgccgcatgctgcgacgagaaagtccagatcatcggattcaaccccgataccgacttcgtgatcaccccttggatcgcatcgcagttcgacggcacgctccagcgcggccagatcgttgcaggagccagcatcagcgtgtcgggcaacaacacggtcaaactctatgggcacgaattccccgtggcggcgcaactcgccaataccggcacgtcgctcgacaattccgtgttcgtgaacatgcagaccgttcccgacgtggtcggatattccgccaaggtggggcatgccgccattccggaagaatatgccgacaaagccgtttccgccgtgctcatcaaggtcaaggacggttactccgcccagcaggtcgcttcgaacatcaccaaaacaacaggaatcaaaagcctcggatacgtgtatccggggggcatcacagccacaacgaaatccaatctgaacgtgatcattcgctacgtgacccttttcgtcgcggtgttctgggtcatggggctgatcgtgctgcttgctgtgttctcgtccgccatgaacgaacgcaaacgtgaattcgccgcgtatcgcattcttggtgccaatcgttccactttggtcggcatcatcgtgaaggaatcggccatgatcggagctttgggcggtgtgataggcattgcggtcgcgtcgctggcgattttcccgttcagcacgcttatcggacggcagctgcagttgccgtatctgcaaaccaacatgtggaatgtgttggcattgatcgcagtgagtttcgtgttcgcggtgcttaccggactgctcgcctccgtgacgacggcggtgaaactttccgctcccgaaacctatctgactttgagagaaggtgaatgatggcggaaaacacggttctcgaagtacaagagctcactcgcgagttcacccgtcgcggcaaaccgttcgcagccgtggaccatgtggatttcaggctgggccaaggcgagttcgtggcgatcgtcggccgttcgggcaatggcaaaagcacattgttgaatctcatcaccggactgctgaaacccacatcgggctctatcgacttggacggcaatgacgtgacgcggttgaacgacaaacaaatgtcagtcgtacgcaatcggatcgtcggattcgtcacgcaaagccagacattgctgccgaatctcacggcactcgacaatgtgattcttccttccgtgctgtgcaacggcaaaacggcgcagcgcgatgttgagatacctgcggattcgtctgatgcgaaatcagtggaagaaaccgtatccgacgcatcttccgaacagacggttgacgacggacttccggacgtcatcgcggcggctccggtatcgaaaacacacaacgatcccgttcaggaccatgccatggaacgtgcgcacgcattgctgcgccgactgcaggtcgacgatttggcggaatgctacccgaaagagctttccggcggcgaaatgagacgcgtcagcatagcgcgagctctgatgaatggtccgaaacttctgatagcggacgaacccaccggagatctggatgccgaaagcactgccatcgtcatgcggctgctgcaggaagtggcgcacgacggcaccgcagtgttgatggtcacccatgatccggatgccttgacgtatgtggatcgaatctatcgcatggacaggggagtgctggctgaagcatagcggcgccatgatggcatgacatgccgaagagggcgaaacgacgagctcgtcccgccctcatgtgtattattaacgattggtgtgcgcccgcaagggagcataccgtctggagtcttagcccatcagtgggtcggcgaccgatacgagctgtttacggcacgtgttcaagtcgttcgtgcgcatgcacgaagaagcactggagaggctggctcagcgcatatcggaaaccggtgtgcgctccgttcagacaacgacagaacaaacaaaggattaaaccaatgacgaacgttcagcgttctcgccgtcaggtgcgcctttcccgcgccctcggcatcgctctgacccctaaggctcagcgcatcttcgaaaagcgtccgtacgctccgggtgagcacggccgcacccgccgtcgcactgagtccgattacgcagtgcgtctgcgcgaaaagcagcgtcttcgcgctcagtatggcatctctgagaagcagcttcgcgccgcttacgagaagggcacccacaccgccggccagaccggtaacgccatgctgatcgatctcgagacccgtctcgacgccctggttctgcgtgcaggcttcgcccgcaccaccgctcaggcacgtcagttcgtggttcaccgccacatcctcgttgacggcaacatcgtcgaccgcccgtcctaccgcgtcaagcctggccagaccattcaggtcaaggccaagagccagaccatggttccgttccagattgcggccgaaggcactcaccgcgatgtgctgccgccggttccgggctatctggacgtcaacctgccttccctgaaggccaccctgactcgcaagcctgaagccgaggaaatcccggtgcaggtcaacatccagtacgtggtcgaattctacgcccgctgatctggatctacatactgtaagaacatacagtataaggacatacagcaagagcctcgcaatcgtcaggattgcgaggctcttcgctatctcaagcgcatgtgcggcctttttaagcaacgggaagccttcagtcgccgatgatgccgcctactatgccgctcacaatcgtcataacaagtgagccaagcacagaccatgcgaatccgtcaatagtgacgcccacagagaaaaacgacagcgccaaccatgacgcaagctgcatgaacagccaattgatcaccagtgcgaccagtccgaacgaaataatcgagaacggcaacgctatgacatggataatcggctttatggaagcattgataagcgccatgaacaaggcgaacgccgcgatgccaagcacagggggctcgccaatggcgtgcatgccgggcagaaccgcaaccataacgcccgccgcgacggtaagaattagccaacgtgaaataaaatgacccataacaacatcgtatagcacggatttgctcaaaccgtgagggtagcatggaacccatgttgcttcatcttcatcttgtccgacacgggcagacgtttttcaaccgatataacaggttgcagggctggtctaattctccattgacggaatccggcatcgccgacgcagacaaagccgcaaacaaactgaaggagtttgatttcgccgcggcatattgctccgacaccacgcgtgcgcaaatgacagcccagcgcatcctcgacgtgaatgaggccgcaggacacacccgcccccaactggtcagtgacatgcatttccgcgaacagttctacggctatttcgaaggccaggatatgggcgtggcgtggaccgccgcgggagggccgcacggtgcgaagaactacaacgacatcgtcgcaaagttcggtcttggtgcgacccgcgacttccttaaggaagcggatccattccacgatgccgagtccgacgtggaatattggtcgagagtcgaggagggattcgcgctgatcgcttcgaatcctgcgctgagggacagtgatgacgtgttgcagatttcccacggcaacacgctgctgagccttatgcaccgtttcgcgccggaaggctatgacctcagcgaacgccctgcgaacggatcggtcaccacgctcgatttcgacaccagtaagcctatcgctgaagcggtaaccgtcgtatcgtataaccagtgaccggcggacgaaacttgccttaggtctgggctttttactactgttatgcgcgtgttgtgttcgcgggcaaccgtgggactgaaaagaggtacaagatgggtgttggagaaatcgccggtctgattgcggcaatcgctttcgcgattcttgccggtttcatgatctacccgttgattcgtctcggcaaactgttcgaccagctcgccgagacagtcaaagaaacgggagatcatgcgattcctgcgcttgatgagagtgtgaccacggtgcagcaggtcaacaagtcgctggaagacgtcaacaagatttccgcagcggcttccacaaccgccaataatgtcagcgccctgaccgatctgtatggatccttcttgggcaagccggttatcaaggttgcttccgctgcatatgccctgaaaaccaccgcgcagtccttcatgaacaagaagaacgtcaacagcaataacaagggggagtgatgttcaagcgtctcttctggatctccattggtgtgggcatcggtgcggtggcagtgaccaaagcacaggcgtacgtcaaggccaacacccctgatgcggctcgacaatttctgttcgggccggatcaagatcatgtcgccgtgcgcacccttgaaggtctgttcaatgagttcaacgaaacgcgtcgagcccgcgaggctgaacttaataccaaatacgcggataagatcagctgatcttattcccgtaacgtacgttcggacaacaatcacgaattcgtttgaaaggcaccaggcctttcagcaaaaaaggagcttaatctcatatgcgcacttctgaaatcgcgaagcgctatcttgattatttcgaaaagcacggccatcttatcgtgccttcggcatcgctgatctctccaaacccgaccaccctgttcaccatcgcaggcatggtcccgttcatcccgtacctcatgggcgagcagactccgccgaagagccgcatggcatccaatcagaagtgcgtgcgtaccttggatatcgacgaggtcggcaaaaccacccgtcacggcacgttcttccagatgctgggcaatttctcctttggtgattacttcaaggaagaagccatccactatgcgtatgagctgctgaccaccccgcaagacaagggcggctacggcttcgatccggagaagctgtggatgaccaccttcaccgacgacgaggaagcccgttcaatgtggaagaacgagggcgttgaccccgaacacatccagatcatgggcatggaggacaacttctggaccaccggcggccctggccctggcggtccgtgctccgagatctacgtggatcgcggacctgaatacggtgtggaaggcggcccgatcgccgatgagaaccgttacatcgaaatctgggatctcgtgttcgaaaactacgaggtcgacaacgtcaagtccaagaccgacctgcacatcgttggcgagctcgagaacaagaacatcgataccggtgccggcttggagcgtcttgcctatctgatgcagggtaagcagaacatctatgagaccgacgaggtcttcccggtcatcgaagccgcccagaagctgtccggccgcacgtatggcgatgacgaagccatggatgtgcgtttccgcatcgtggctgaccatgtgcgttccgcattgatgatcatgtccgatggcgtacgtccgtccaacaacggtcgcggctacgtgctgcgccgactgcttcgccgcacagtcaaggccatgcgcgagctcggcgtgaccgatccggtcatgccgaccctgctgccgacctccaaggcagctatggagccgagctatccggaactcaacgacaccttccacgatgtgtccgaagccgcatatggtgaagaggacgcgttccgtcgcacgctggaatccggcaccgagattttcgacctcgctgtggccaaggccaaggaatccggatccgacgccgtttccggcgaagatgcgttcaagctgcacgacacctacggcttcccgattgagatcaccctcgaaatggccgccgatcagggcgtcaaggtcgatgaggcgaagttccgcgagctcatggccgagcagaagagccgtgcccgtgcagatgccctgaagaagcgtcacaatgtggatctgtcggtctatgacgatttcaagaagacgctggtccagcccatcgacttccttggttacaccgacatgtccgcccgcgccaaggtgctgggcatcatgcaggaaggcaagggctccgtccccgcagtcaccggtccggccaccatcgaagtcattctcgaccgcactccgttctatgcgcaggccggtggccagctcgccgatcagggcgagatcctttccgacgatggtgctgtgctcgaagtcgacgatgtgcagaagccgatcaaggacctcatcgtgcaccagtgccgcctgaccgaaggcacgttggttgtcggcgccgaagtcaacgccaacatcgaccttgaccgacgcggtgccatcgcccgcgcgcataccgcgacccacatggtgcacaaggcgctgcgtgaggagcttggcccgcaggccacccagcgcggctctgaagacgcgccgaaccgtttgcgtttcgacttccagtggtccagcgccccgagcaaggatgcgatgaactccgtcgaggcgcgtgtcaacgagaagctgcgcgaaaaccttgccgtcaccacgcaggagatgaagttcgacgacgccatcgccttgggtgccatgcacctgttcggcgagaagtatggcgacgtcgtgcgcgtggtctccatcggcgaagatggatggagccgtgagctttgtggtggtacccatatcgaccatgtgggcaagatcggtgccatcaacatcatgtccgaagcctccatcggctccggcgtgcgtcgtgtcgatgcggttgtgggcgaaagcgcttatgagttcaacgctcgcgagcatgcgctggtctcacagctttccgacatggtcaatgcccgtccggacgagcttgccgaccgtgtgaacgcactgcttgccaggctcaaggaatccgaccgtcgtcttgcgaccatgtacgaatcccagcttgcggcttccgtgcctgctttggtttccgaaaccaaggcatcccaggctccggtcaaggtggcagcgaagaatgtcgagcacttcggctctttcgacgcgctgcgcaagaccgtgctggatgtgcgcggacagcttggtgaggaattcccggttgtggtggctctcgccggtgtgaacgaggaaggcaagcctatggttgccgtggccactaacgaggctgcacgcaagcagggtatcaaggccggcgatttggttcgtggcgcttccaagatccttggcggtggtggcggcggcaagccggacttcgcccagggtggcggcgcggatgccaccaagatcaatgaggcgcttgaggctttggccgatcaggccatgaagggctgaaccaccaagcatggtttggcttggcattgatttaggtgatgccagggttggactcgcactgtctgatcctggcatcactcttgcacaccccgcaggcaatattcaggtctacggggattcgttccgtgcattggacgaggtcgtggacgtcatcgaagacgaatcggtcgaccatgtggtagtcggattgccgttgctactaagcggagaagaaggcaaaagcgcgaaaaaagcacggcgatggactgttaatcttgagaagagactgcgtgtcgcagtagatgatgagaactatgcgctaaaggaagtgccgtccatcgaattggtggatgagcgtctaactacggtgactgcacatcatcagctattcgatgcgcaggtcggtggacgaaagcaccgtccgatggtcgaccagcagtctgcagtggtgatattgcagacggccatcgaccgaagagagagaccagaggagagaggcctgtgactgataatctcgacgattttttctccgataacgcgcaatgggtgaattcgtcggatgatgcatccttcgtttcggcaatgcctccgcaaccaccgaaatcacgtaaggacatgcgtcgtcaccgtgagcagaagcgtcgtcgccgctatatcaccattatcgccgctctggtggtgatcgtgctgatcggtgtcggcggattcttcggcgtgcgcgcgctgaaacattggaaggccgtgaacgaagcgaattctcaaagccaaatcgaggattacacgggcccaggcgataaaggcgtgacgtttgtcgtggaatccgggcagggagccgcggaaatcgcggacaaccttgttaaagctaaaatcgtcaaatccgcagccgccttcacttccgcagtaagcggagctggcgccacgttgtatccgggatcatacgcattgaggacgcatatgagggcgtccgatgtggtcaaggtgctttctgaccaaagccaggccggcggttttgccgaagtgcgtgcgggtgaacgtgtgtcggacgtcatcgaaaatgcggcgagtgtgtccggcttggatgtttcacagttccaagccgtgatggacggtggcggtgctggaatccttcctgacgaggccggcggcaaattcgagggatggcttgaaccaggcagctacaatgtgcaaaacaagtcagcggaagacatcatcaaggaaatggtcgacgcgcgagtgagcaaactcgattccttgggcgtacctacaggcagcgaacgtgagcgcatcctgaatatcgcatccatcgcggaggcggaagtcggcagcgaaaaatactacggccaggtggcaagagtgattctcaaccgtcttgacgccgatatggctctcggcatggataccacggtcgcctacggtcttggtatttccgcaagccagttgaccgatgaccagttgggcgatgacagcaacgcgtacaacaccagaatccacaagggactgccgcccacgccaatcagcaaccctggagatggcgcgatcacagcagccgtcaatcctccggacggcaagtggctgtactttgtcaccacaaacctgcagaccggcgaaacgaaattcgtggaaaccgaagatgagttctggcagattcgcgacgagtacaagaacaacaacgagaacgcgaactgatctcagaataaaacgccaatcgcaatgcctatcgccccagctgccacaagcgctggggcgaacggcgttttaccggcatatgcggtatgcttctgcggatcgaaacgtgtccacaaaacgagccataacaagccgaccacaccaatcgcaagccaccaaaacaccacggcgaacagaccgaacatgccgactgccaatcccatcagcaaggtggcggtgacatcgccaaaacccaatgaaccaggtttcaccaaagcgagcgcgcattgcagtacggccgacagtacggcgaagagtattgcctgcaatgccaggtacagagtgttgatggaaagtgcgtatatgaggtttacgatgatttgcgctgtgcatccggtggcgatccaggcgcgtggaatgcggcgtgaacggatgtcttcaacgctgatggccagtccacaaagcagacttggcaggcaaatcatataccacataccgttaagatagtccactagttgcattcgtgagaaaaggagttggcatgttgcgttggcagacagcaggcgagtcgcatggtgaggcgcttgtcgccatgattgagggattgcccgcgggcgttcatatcaccacggaggatattgttggcgcgttggcgcgtcgtcgtcttgggtatggtcgtggcgcgcgtatgaagttcgagcaggacaaggttcgtatgctgactggtgtgcgttttggtgagacgattggttctccggtggccattgagatcgccaacaccgagtggccgaagtggactgaggtgatgagtgcggatccgcttgatcatgagcttgctcgtgagggccgcaatgccccgttgtctcgcccgcgtccggggcatgcggatttgactggcatgcgtaagtatggttttgatgatgctcgtccggtgttggagcgttcttccgcgcgtgagacggcttcgcgtgtggcgttgggtgaggttgccaagcagttcttggagcaggcgttcggtattcgtaccgtttcgcatgtgctttccattggtggcgcaggtattaccgatccgcagcaggccacgcttcccaaaccggaggatcttgaggcgttggacgcttctccggtgcgcactcttgacaagaatgcggaagagcggatgattgcccgtattgacgaggcgaaggagaacgccgatacgttgggcggtgtgatcgaggttgtggtgtacggcgttcccgcaggcgtgggcacgtatgttgaatcggatcgtcgtcttgatgctgctcttgccagtgcggtgatgggtattcaggccatcaagggcgtggagatcggtgatggtttccttgaggccatgcgtccgggttctcaggctcatgacgaaatggtggtgggcgatgacggccgtattgcgcgtctaagcaaccgtgcgggcggtatcgagggtggcatgtcgaatgggcagccgatcgtcgtacgtgcggcgatgaagccgattccttccattccgaaggcgttgcgtaccgtcgatgtgaccacgggcgagccggcgcaggccattaaccagcgttccgacaatactgcggttccggcggcggctgttgttgccgaggcgatggtgcgtttgaccatcgcgcagtatgtgcttgagaagtttggcggcgattgcgttgccgaaaccaagcgtaacgccgagcagtacgttgcctcatggcctgagcatatgaggtgattcgtctatgagtggtatgcgtaggcctgtcgccgtgatcatcggcatgatgggggcgggcaagactcgtgtcggcaaggaagtggcgcagatgatgaatctgccgttcgccgatgcggacaatgagattgagcatgatgccggaatgcggattcccgagtacttcgaaaagtatggggaaccggaattccggaggctggaaagcgacgtcgtgcttgatatgctcgaggatttcgacggtatcttttccttgggcgggggagcgccgatgacgccttccattcaggaaggattggcgcagtatatcgcggacggcggcaaggtcgtgtatcttatggccgatcctgaggaagccatggagcgggcaaatcgcggtggaggccgtccgatgcttaatggcgatgccaatgagcgttggaagaagctctacaaggaacgtgacccggtgttcaggagcgtggcgaacgtgcatgtgggcacgcgtggccagtctccccaagccgcggcgagaaagctgatggaaatgattgatcaacgtatagtccatgtcaccggttccaccatcgaaccatacgatgttcgtatcggagagggtgtgatgggccagcttgcgcaggtgttgggaagcaagcctgccaaagtggcgcttatccacacccagccggtgcagcgtcattcggaccgtgcgcgtactttgttgcgtcaggcgggctatgatgcgtacgatattgtgattcccgacgcggaggccggcaagaccattgaagtggccaatggtatctggcagcgtttgggggatgagggtttcactcgttctgacgcgatcgtcggccttggtggtggcgcggcaaccgatttggcggggtttgtggctgccacatggatgcgtggcattcgctacgtgaactgcccgacgtcgttgctggccatggttgacgcttcgaccggcggtaaaaccggcatcaatacccctcaggggaagaacctggtcggctctttctatacgcctgccggagtgcttgccgatctgaaatcgcttgcgtcactgccgaacgacatcttcatcgaaggattgggcgaggtcgccaagtccggtttcatcatggacccggagattctgcagatcctcgaggaccatgccggtgaattgcgtgccttcgacgggtcgacgttcttggattccggcctgaaggatgtggtcgcggagctgatcgaacataccgtgagcgtgaaggcctaccatgtgtccgccgaccttaaagaggcgggattgcgcgaattcctcaactatgggcatacgctcggtcatgccatcgagaagcttgagcatttccgctggcgtcatggtaatgcggtggcggtcggttgcgtgtatgcggccgaactgtcgcatcttctggggtacatcgatcaggatctcgtggactatcatcgttcgttgttgggatctctggggctgcctacgtcctggaacaatggcacatgggatgatgtgctcgcattgatgcaccgggataagaaggctcgcggcaataagcttcgtttcgtggtgcttgagggcgtcggccatccgattcatcttgaggatccgcctgcggacgccgttgaagaggcgttccgtcgtattcagcagtaaacaaggtagggaagtggaatatgactaaagtagtggtcgtcaatgggccgaatcttggccgtcttggcgtgcgtcagcctgacgtgtatggcaagcaggatcttgaaaccctgcgtaccctgtgcgcgcagtggggcagcgagcttggtcttgacgtggaagtgcgtcaaagcgatgacgaagccgagatgatcggctggatgcaccaggccgccgacgagaagaccccggtcgtgatgaatccggcggctttcacccattactcctacggtctggccgatgccgcgcatatggtgatcgatgagggattgccgctgatggaggttcacatctccaatccatccgcacgcgacgaatttcgcaagcgttccgtgatctcgccagtagcgacgggcactatcaccggtatggggttctatggctacaagctggcgttggatgcggtggcgcatctgttggaatcgaagtgatgattttccgatttccccttgagatagtctcggaggaactatgaatgccggatgctcttgatgggcatccggtttttacatagcattgcattcgtttgcagaaaaagctgcaacaatcgcaaatatgattgccgttttgcgcaacacaatgaattgttgctgaaagcattttctttcgcttgtccttcttttccgtatattgcaatcggtcacgctgtttcattgcgatgcgcagcatctactgtacgatgaaccccgatctagggtgcaaacgtatgcacattcatcgcagagtgtgtcttagatgatccgcaggtaacgcggatgaccatggcgcatacgttgtcgaagggcggaacctgccatgggggccggaattcgatctcaacgatgagaacggagaacaatggtcgttcagcgaatgaatcggccggctagccgtgcggtggccataggcgtcgccgccgccatggcgtgcgccaccttggtggcggtaccgcatatggctcaggctcagcccgaggcgcaaacgaatgcgaagaaagacgtgcaggtcatcgccttccagcagacatggaacacggtcgccaaggaatgcacgagcacatacggtccggaaggcgtggcatacgtcgaggtgtcgccgccgcaggaatccatccaaggcacgcaatggtggacgtcctaccagccggtaagctacaagctcgattccaagctcggcacggaagccgaattcaaaaacatgatcaagcagtgcaatgccgtcggcgttgacatcatcgcctacgttgtgctgaaccagaccaccggtgccgacgtggccgacggcaagcagaccggcgtcgcaggaaccgaatacaacggttcgaccggcgactacccgggatttgccaccgaacagtatccggaaggcatcacggcctccgacttccacagctgctccaagaacatctccaactacgccaaccagcaggaagtccaggaatgccgcctgagctccatgtgggacttcgactccgagagcgaaaaggtccaggatattcaatctgactatcttgccgccctgtggaatgctggtgttcgcggcttccgtatggatgccgtcaagcacatccacacggacagcatgagggccatcaaggagaagttcgcaaagaagatcggcgtgaatgccgacagcatctactggatccaggaggtcatcgggaactcctccgaagccgcgggcatccagccgagcaactacgtgcaaaacggcacggtgaccgaattcggcttcaagtccgaaatgaaccagaccttcaaagacaagatcgcaaacctcaagggacttaatgagcggttgagcaaggatctcgcctccgaagacgccaacgtgttcgtcaccaactgggacaccgcgcgcaacgagggcgccctgacctacaaggacggtgccaagtatcagctggccaacgcattcatgcttgcctacgactacggcacgccgcgtctgctttccgactacaagtgggatgagaacgacaacggcgcaccgggagccaccgccacatccgttccggacgtgaatatggacgaggtctgttccaccaacagctccgactggaactgcgagcagcgctggacctccacccgaggcatgatcgccttccgcaactacgtcaacggcaccaaggtcgccgactggcaggatgacggcggcgacaacatcgccttctcccgcggggataagggcttcatcgccatcaacaacggcaagaccgacaaggacgcctcctacacgacatcgctcgccgacggcgaatactgcaacgtgtacgccaccatggactgctcccagactgtaagcgtcaagaacggcaaggtcgagaccacggtaccggcgcattccgccatcgcactgtatgcaggcgccaccaaggacagccacccggcatccagcgtggccaacgacccgtccgatcctgacgtgaaccaggaaggggacgagaccctgcccgacgacagaagcgtcaccatctactacaagcccgccgattccagctggaagagcccgaaggtccactacggtcttggcgatgactggaaccagccggaagccgacatgaccctcgacgagcaggggtactatcgcgccaccatcgacaccaggggcaagaagatcgacttcgtgtttcacgataccggcaccgaccagtgggagaacccgaagggcggcggcaactaccacgccaacgcgggcatcacgcacgtgggtgtggccgatcaggccgcgaccgtgggtaatccggaatccgtcaacggccagacccgactcgtcgtgcactacaagccagccagcgattccgataatcgcggcgtgtacgtgtggggcacagacgctggcggctcgagcctctcggcagtcaaccatcccttcaccggagctgactgctggggcaaggtggctacgttgaccttcggcggcaagtttgacaagttcggcttcatcgtcaccaccgcagactggaacaagtacggtggcgaccgtagcgccacggtgaacgccgacggcacagccgaagtgtggatcgacggcaccaaatatgaggatcaaggcgaatcgaccaccgtcgaaaccctcgactccgctccgagcgactacgaatgcaaggccaacaccgttaccgtgaaggtccactacaaccgtgatgacggcctgtactacaacgccgaagacacctcggtcaccgttccccagtgggacatctggacctgggcttccaattggaacggcggagccgccaccttcaccacccacgatgactggggcgaggtcgcggaatactccttcaccaactacacctactacaacgtcgacggagcctccgacatcggcatgctgcgccgttacggaaaggatgcgtggaaggccaaggatccggatgacgccgattacaagatcccgtcaaacgccttggtgttcaacgaatcggacggcaccgcatcggccgaagtgtggctgatgggcggcgacgccaccgtgtattcctcacgtccatcgttgggagcgtccatgaagtctgttgaaatctccgacgtcaacaagctgaccgcaagactgtccaaaaaggtcacttcggatgagcttgaaggcaaggtctccgtcactgacgccgacggcaaggctgtagatgtcaagaacatcaagaccgacggcaccaaggtgatcatcaccacggccaaggatcttgacatgcgaggcaagtacaccgtcgaagtcaagggcttcggttcgcaggacgccatcgcgggctcggtggtgcgtacggatgccttcgacaagaagtacgcctatgacggcgacgatctgggcgccacttacacgagcgcgaagaccggattcaaggtgtgggctccaaccgccaccaaggttgagcttgtcacctaccagtccgacgatgtgaatgccgaagtcgacaagaccgtcgacatggcctctgaagacaagggtgtgtggagcgccctggtgaagaaccttgctagcggcacggcctactcctacaagctcaccttcgcggacggcacggtgaacgtctccgccgacccgtacgcgaccgctgcggtcgccaacggcgaacgttccgtggtgctctccagcgaagacatgggctccgcaggcgaccgcatgccggaattcggcaagaccactgacgccaccatcgccgaaatgaacatccgcgacttctccatcaacccgaattccggaatctccgccgacaagcggggcaagtatctgggtgttgtggaatccggaacgaagacggcgaacggcgccacctccggtcttgactatctcaagcagttgggcgtcagccacgtgcagatcatgccgatgtacgactacggttccgttgatgagatcggcgatctgagctacaacgcgcaaggtgcgcagaactggggctacgatccggagaactacaacgtgccggaaggctcgtattcctccgatccatccgaccccgcctctcgcgtcaccgaaatgaagcagatggtcaagggactgcacgagaacgacattcgcgtgatcatggatgtggtgtacaaccacgtctacaatgccgccaaccactcgttcaacaagaccgttcccggctactacttccgttatgatgacaacggttccctggtcaacaactccggctgcggcaacgatacggcctccgagcgcaagatgatgcgcaagtacatcgtcgattcggtgacgtattgggcgaagaactacaacgtcgacggcttccgattcgatctcatgggtctgatcgacaccgaaacgatgaaggaagtgcgtgcagcgctcgacgagatcgacccgtccatcatcatcctcggcgaaggctgggatatgaacaccaccatggacgagggcgagatgaccatccagccgaacgcgtaccaagtcgcgtccgacggcacgaacaacggcatcgcgttcttcaacgattccgtgcgtgacggcttgaagggatccgtgttctccgacaccgacaccggtttcgtttccggcaaggccgaccaggagagcctgatcgcccacaacgtgctcggctgccagtacgacgagaacgcgaccacgacctgctggaacggcaacgcgcaggatcactacgccgatgccggacaggtggtcaactatgccgaaatccacgacaacatgaccctgtacgacaagctcaggaagtccgtcccgacggatgacgacgccacgaccgtggcacgtgccaagcttgccgactccgtcgtgtatctgtcggaaggcatccccgcgatccagctcggccaagagttcctgcgcaccaagggcggagacggcaacagctacaacacgggcgacgcggtgaacgccatcgattgggaccgcaccacccagtacgccgattccgtcgactacgtcaagggcctgatcaagctgcgcaagcagatcaacgcgctgcgtctgaccgactacaacgacatcaacgccaacgtgacgatgctcaagtccgctgacggcgtcgtggcctaccaggccgagcagtccgacggcacctacgtggtgatcttcaacgccaacgcagacaagaccgcgatcgaaggcttggcaaacggctcctaccaagtgcttgcagccgacggcaaggtctactccgatgatgctatcgccaatgtcgatctcgccgaaggggcctcgtacgaagcgggcgcactgtctgccactgtgctgaaactcgacagcagcaccaagcccgataccgacagcgcgcctgtcatcaagggtctggtggcttccgacagcgtgactctgggatcaaagttcgatccgatgtccggcgtcagcgcatgggatgaggttgacggcgatctgaccgacaagatcacggtcgaaggttcggtcgatacctctaaggaaggcgaatacacgctcgtgtactcggtgaccaacagcaggggcaagaccgccaccttcacgcgcacggtaaccgtgcgcaaacccgcggtccagccagcttccgacaagaagagcgatgctgtgcaaagcccgaatactggttccgccatcaccggtttcgcactggccgcggtggctcttgccatcgcatccgtgttcgcgttcgcggcctcccgcagaaaggaggactgatctcataagccaatgattgactgaatgtatctcctattcctgctaggcggggccatcaaggcaatgatggccccgcctttttgtattgaaggaaacacgccgcgtctcatgccgctgatagactgaagttccatggttagaagacaacatggcaattctcaagagcacgttaccaagcatattttcgtcaccggtggcgtcgtttcctctctcggcaaaggcctgacagcctcctccctcggccgcctgcttcgtagccgcggcatcaaggttttgcagcagaagctcgatccgtacatcaacgtggatccgggcacgatgaatccattccagcatggtgaagtctatgtcaccgaagacggtgccgaaaccgatctcgacatcggccactatgagcgtttccttgacgtgtacctgagccagaaggcaaacgtcaccaccggccagatctaccaggaagtgctgcgcaaggaacgcgccggcgaataccttggacaatgcgtgcaggtcatcccgcacatcaccaacgaaatcaagtcccgcatgcgtgcgcaggcgtccgatgacgtcgacgtgatcatcaccgaaatcggtggcaccgtcggcgacatcgaatcccagccgttcctggaggccgcgcgtgaggtccgccgcgatctgggcgccgagaactgcatgttcgtgcacgtctccttggtaccgtacattgccgccgcccatgagctcaagaccaagccgacccagcactccgtcatgatgctgcgtcagctgggcatctccccggacgcgctggtgcttcgttccgaccgcccgctgaaccagtccatcaaggacaagatctccctgatgtgcgacgtggattccgaaggcgtggtcaactgtgtggacgccccgagcatctatgacgtgccgaagaccctgttcgacgaaggcctcgacgcctatgtcgtgcgcgagctcggcctgccgttccacgatgtcgattgggacgagtgggaggacctgctggagcgtgtgcaccacccgaagcatgaggtgaacatcgccatcgtcggcaagtacatcgatttgccggatgcctacctgtccgtcactgaagccatcaaggccggtggtttcgccaactatgccaaggtgaacgtcaagtgggtcgccgccgataagtgcgagaccgaggagggcgcggccgccgcgctcgaccaggtcgacggcatcgtcgttcccggaggcttcggcatccgtggcatcgacggcaagatcggtgccctgaagttcgcccgtgagaacaagctgccggccctcggcctgtgcctcggcctgcagtccatggtcatcgaatacgcccgccacgtcctcggcttggaggacgcgaactccaccgagttcgagcccgattgcgcgaccccagtcatcgcaaccatggaggagcagaaagacatcgtcgccggcaatggtgacatgggacacaccatgcgtcttggctcctatccggctgagcttgaagaaggttccatcgtcgcggaactgtacggcaccacgcatgtcactgaacgtcatcgtcaccgttacgaagtgaacgtggcatataaggaccgtctgcgtgaagcgggtctgcgcatttccggccagagtccggacggcgaactcaccgagttcgtcgagcttcctcgcgaggtgcacccgttctatgtgtccactcaggctcatcctgagttcaagtcccgcccgaccaagccgcacccgctgttcgcaggtctggtcaaggccgctctggaccaccagcaggagcgctaaatcgacgaattgtgattaacgtcggataacccgatatgcaacatggtcatgagtccaaaggagttcatggccatgttgcataataagggcttggccttgaattatcaacaagacgtattcgtaatgaaaaacctttacgagggagcatgagcttgaacgatatggattctccggaaagcggcaacggtaagttcgccttcccgaacatgggcgatgaaccaaaagtcatctcgcaggtgagcttggattcgtttgccgaaacggccgattccattgatgatggtgcagcgttgactgtgaatgccagcaagaagcgccacctgttgtggctgtggattgttcttgcggtgatgcttcttctcggtgccgtggccggcggcggatactggttcttccagtcacatgcgttgccaggtgtcacgctctggggcaagtccatgacaggacaatcccgagatcatatcatccaagagatttccgatacggcggaatcattaacggttcccgtttcctatgagggaacgagcaagaaagtcacgttgaaggatcttggcgtcgccattgacgcggaatccatcgccgaaaatgtgatgaacgcgaaacgtgacgattccttctttcagaagtatgcattctggacccgtgaggatgtcgacgtcgagtctttcgatgattctcgagtcagcgcccagacggtaggtgacatgttgggagtgcagtccgtgtccgccaccaacccgtcgctacagctcaacgcggatggtaccgctttcgatgtgacgccaggtcagcaggggactggtatcgatgtgacggatatcgtcaaagaagccaagaacgtgcttgagtcctttggcaagcagaccgctcaaatggtgactcttaaaaataaggttactgatcccgccatcacggatgaccaagccaacgaggccaaggcttctgctgacgcgtggatagcgaagccggtggctatcaagatcggcgaccataaagtggcggaattcggtgcgcagtccattgcatcggccatcacgcttggaccggatagtgagaagctcggcgataatcaaacccgaaatggctctttgattatcgatggtgacaaattgcagcaatactataacgattccatcaaatcgaacttccatgctgatcgagttgacggtgatgtcatcgttaatagtgtcggtgatgtgctgcaaaccaatgtagctgggcatgatggtataaccgttactgatggtagcgacaccaatgttggccgtgatgccgctgaggcgtttgccaagggttctgattcagtaagtattcaaggcacttgcgacccacagaatgagaaaaaaaccacgcgtaccgtggtagtcagcttgtcttcgcataccgttacagccattgaaaatgggcagaccgtccgtgtcatgcatatgtctgccggtcagggcaatgattatcagacgggccagtgccagccgagcggcgacttgtgcacgccaacctactgcgatccgaactcctacgacaactgcacgcctgacggtgacttcaaagtgtggctcaagtaccagtcccaagatatgagcggcacccttaccctatcggatggaaacaccgagaagtgggatgtcaaggatgttggattcgtcaactatttctcgaaaacaggttgcgcgattcatcgcatcgccactcaaagtgcgtttaacgacagcagtattcaggctatggggaagaacacgtcccatggttgcgtcggcgtcggctgggatcaggctgaatggttctacaattggtgcctgatgggaacgacggttcacgttcaggcctgatatgcgggctaacggcagaaagacgcaaaggcggaagactgaatgttcggtttccgcctttacgctatgtaagataaatcacgacaaatcattgccgaatagcgaaaggggcgctagtgtttagccccacgttctgttaggttgtcataggtacaaacgagtgattggaggcagcgtacggtggcagagaaccaagcgcccaacgccgcggctgacgtggagatgagccagtatgtggctgatcgcacgcgagtgaatgaagacaagatcaagcaggatgacgagatcatccagcagttcggcgactatacgtacggatggcatgacacggatttcgccggagaagcggcaaaaaaaggcattgacgagaatgtcgtgcgcgctatttccgcagataagaacgagccggaatggatgctggaaaagcgattggaaggctatcgcgatttcatcaaccgtccgatgcctcaatggggtgtcgatctgaaggatttcgacgccgacgatttcaagtattacgtcaagccgatcgacaagcaggccacgacttgggaggaattgcctgacgagatccgtgcgacgtatgacaagctcggtattcccgaagcggaaaaaagccgtcttgtctccggcatcgcggcacagtacgaatccgaggtcatctacaactcaatccagaaggatcttgaagaccaaggcgtgattttcgtcgacaccgacaccgcggtgcagaagtatccggaaatcgtcaagaagtatttcggcaagtgcattccgagcaacgataacaaattctcggcattgaacaccgccgcatggtcgggcggatcgttcgtctacgtgccgaagggtgtgcatgtcgatattccgttgcaggcatacttccgtatcaatacgccgaatatgggtcagttcgagcgcacgttgatcattgccgacgagggatcgtacgtgcattatgtggaaggctgcaccgcaccgatctactcgaccgattcgttgcattccggcgtggtggagattttcgtcgagccgcatgcccgcgtgcgctacaccaccgtgcagaactggtcgaacaacgtttacaatctggtgacgcagcgtgcctacgtgcgtgaaggcggcaccatggaatgggtcgatggcaacattggttccaaggcaaccatgaagtatccggcctgcattctcgccgagccgtatgcgaaggccagcaccatgtcgctcggcttcgcaggcaagggccagtatcaggataccggtgcgaagatgatccatcttgccccgcataccagctccaccattgtggcgaagtcgatttcccgcggcggtggacgttccgcataccgtggtctcgtcaaaatcgtcaagggtgccgaaggatcgtccaactcgacggtatgcgatgcactgcttgtcgatgagttcagccgctccgacacctacccgcatgtggacgtgcgcgaagatgacgtttccatggcacatgaggctacggtttccaaggtttccgaagaccagctgttctacctgatgagccgcggtctttccgaagaggaggccatgggcatgatcgtgcgaggcttcgtggagcctatcagccgtgagctgccgatggaatacgcgcttgaactgaaccgactggtggaattgcagatggaaggatcggtgggctgattaccatggcacaaactcaggaaatcaatattcccgttgcggatccgaacgatccgtatgcgaatccggcagccatgccctcttcggcggatcgctcgccgcggtcatttgatgtggacgcatttgaagtgcccgaccgcaagcaggatgattggcgttatacccctgtggaacgtgtcgaagagttcttcaacgcgttcacgccgtcgaacgaaacccagattgccgtcactatgatcgacggcacggctctcactgaaggcgtgacctatagcgagggcaagccgggagacgccgatacgggcatcgtttccaagccctgcgatcgtgtgtccgcagtggaatggaactccgcctcccgtgccggaattctgcgtatcgacggtgaaatcagccagccgatactcgttaagattcatggtgccggaacggatctggacgcattccacctggtgatcattgccgccgatcgcgcccacgctgacgttgtggtagagcatgacggcgatgcacgtatcgccgaaggtgtggagattctcacaggtagggactcccatgtgtccaccacgttcattcaagagtggaacaagggctccaagcatgtgggcaaccagcgtatccacttgggggagggtgcgtccctgcgccattccgtggtcacgcttggcggcgatgtcgttcggattcgtatggatcaggattttggcggcgatcaaggcgatctcaacatgcttggcatctactttgtggatccgggcgagcatatcgaacatcgcaccatgattgtgcacaaccatcccgagtgcaagagtcgtgtggtatataaaggcgctcttgacggcaagggcgcgcactccacatgggtcggcaacgcgctgattgctccgaccgcgccgggtaccgactcgtatgagctcaaccgcaatttggtacttactccgggcgcgatcgccgattccgaaccgaatctggaaatcgaaaacggcaacatcatcggagccggacatgcctcttccgtcgggcgctttgacgatgaggagctgttctatctgcagtctcgcggcattccggaaaccgaagcccgcaaacttgtggtgcgaggcttttttggcgaactcgtcgaggaaatcggcattcccgcaatcagcgaacatctcatgaacgttatcgacaagcgcctggcacgcggcgagaacgacgcgatcgcccaggtgttggaagagaagtagaacgtaggagcgaaaaccatgtcaactcttgaaatcaaagatctgtacgcgcacgtcgaaaccaaggacggcatcaagccgatcctcaaaggcgtgaacctgaccgtcaactccggtgaaacccatgccatcatggggccgaacggatccggcaaatccacgctggcctacacgctggcgggccaccccaagtacgtggtcgattccggacaggtgctgctcgacggcgaagacatcctcaagatgaccccggacgagcgagccaaggcaggcatcttcctagccatgcagtatccggtcgaagtgccgggcgtgtcgatgaccaacttcctgcgcaccgcaaaaaccgaagtcgacggcaaggctccggccatccgcacgtggaccaaggaactgtccgaggcgatgaagcgcctgaagatggatccgaagttcgccacacgttccgtgaacgagggtttctccggcggcgagaagaagcgtgccgaagtgctgcagctcgaactgctcaagccgaagttcgccatcctcgacgaaaccgactccggccttgacgttgacgcgttgcgcattgtctccgaaggtgtgaaccgcgccaaggaagccaaccagttcggtattctcatggtcacgcactacacgcgaatcctcaagtacatcaagccggacatcgtgcatgtgttcgcagccggtcacttcgtcaagaccggcggccctgaactggccgatgagctcgaggaatccggctatgacgcatacctgccggaaggatccgattccgaaagcgcgctggcatgaccgattttgcagcgattcgcaaggaatttccgatccttgatcaggagatccacggccatccgctcgtgtatttggattccgcggcgacttctcagaagccgcaatgcgtgatcgacgccgaaagcgatttttaccgcaccatcaacgccggcgtgcatcgtggagcgcatgagcttgccgcacgcagcaccatggcgttcgaagaggcacgtgccaaagtcgcacgtcttgtcggcgccaactccgctgaaggcgaagaggagatcgttgtcacctccggcgccaccgcaggactgaatctgctagccaccgcattcggcaacgcatcgctgggacgtgggggagaagcggcacgacgtttcgctgtgaagccgggagacgaaatcgtcgtatccaaggccgaacaccactccgtgctattgccgttccaggagcttgccgtgcgtaccggagcgacattgaaatggttcgatctggacagtgaaggtcgcatcctttccaacactgcggacgaggtgatcaccgaacgcacaaagatcgtggccgtcacccatgtgggcaacaccaccggtgccatcaccgacatcgcgccgatggtgaaacgtgcgcacgaggtaggcgcggtggttgtgctcgacgcatgccagtccgtaccgcacctgaagatcgacctccacgctttggacgttgacttcgcggcatggagcgcgcataagatgtacggcccgaccggtgtcggcttcctctacggcaagcgcgacatgttggaggcgttgccaccggcgaatttcggtggatccatggtggaacttgcctggatggatcaggaagcccaatacatggctcctcctgcgcgtttcgaggcgggcacgcagccggtcgcgcaggtcgttgcggccggtgtcgcggccgaatggctgatgaatatcggcatggagaatctcgaagcccacgagcgcgttatcgcaggcgaactcctcaagatggggcagatcgacggcgtgcgcattctcggaccgcagaccaacgagcagcgcatcggcacggtggcttttgaaatcgacggcgtgcatccgcatgatgttggccagttcatcgatgcgcagggcatcgccattcgtgtcggacatcattgcgcgcagccggtccaccgtcacttcggcgtgtacgcatccaaccgcgcatccagtggcatctacaattccgtcgaagacgcgcaggcattggttgaggcgttgaagaaggtccgtccgttttttggagttgagtaacgcatatgagtgattttgcaatgtctggcgacgatctcgagcagatgtaccaagaggtcattctcgaagcctcgaagaatccgcatggcaaggagcatttcgctccggatctggcttccgaaaacgcctcccaggcgggaaagaccacggttcaggcaacccacgagtattgcactcccggcgagtcccaccagttcaatccgacctgcggagacgaggccaccgtgcatgtggaggtttccgaccaggagccgcacgttatcgaacgactggtgtgggacggtcacggctgctccatttcacaggccagcctttcggtgatggtggatctggtggaaggcaaaaccgtggatgaggccatggaattggccggaacgttccataagctcatggaatcacgcggcaaaggcttggacgatgaatccgccgaggaatcgttggaagacggcatcgtgttccaaggagtgtccaagtatccaatgcgtatcaagtgcgcgctgctcggatgggaaggcatgaaggactccgtggccaaggcattggccgcgaaagcctgacaagtattgttctatggtggaaagcaggatgtttcccgtgcttcgtgcgccgcgttctacaacgggcgaaacacgtgagacaaactccagccaacgcgataggctactcaacggaacatattcgaatcatatatggagcgacaatgagcgataccttggtacctgaaccgcaagcctcgattttcgattccgtggccaaggcattgggcaatgacgaggccgcggcgcgtcgcgtcatgcttaacccaaatctcgccaaaggattcaaggacggcaaaccagtggaaatcgaacacgaagacaccaagcaggacgcttgtggctgcggcaatcaggctggagcatgcggttgttccgaagaacaggatgacggcatcgcgttgaaggctattgacgacattggtcgagctactgcggccgacgtgaaggaagcgttgcatcaggtcattgatcctgagcttggcattgatgtgattgatttgggattggtgtatggcattgagatcgatgagcttggtcgtgccattatcacgatgacattgaccactccggcatgcccgttgactgatctgatcgaagacgagtgcgcgagcacgcttgccggcctcgtcgaggaattccgcatcgactggacgtggcaaccgcgttggagcatggaaaagatcacgccggaaggtcgcgagcagttggctgcgctcggcttcaatttcgacaatctgccaaaatactgacagaaaatctgtgatatatcaacctgatattgctgatatgttgattccgcagcgaaactgcatgttcgttgcggaattttttgtaaaacagattttgatgatatttgattggatatcatcatcaagaaaaaatggcacagaaaaagcgtgctcccgacgccgggaagcacgcttttgttctgtgtgcggcagaacgtcagtcgtcgaccacggtacccttcggcaccacggtgatgccttccggcgtgacggtgaagccacgggccagatcatgttcggtatcgataccgacggtcgaattctcggtaagcacaacattcttgtcgaggatcgccttgtagacgcgtgctcgacgattgatggtcacgccgtcgaacagaatcgaatcgacgacctgggaccacgagtggatacgcacgttcggcgaaagcacggaatgatgcacttcaccgcccgatacgatgacgccaggggagacgatcgagtcggtggcgtgtccgagacggtcgcgaccggcatggacgaacttcgctggcggcagattgccggacagcgtgtaaatcggccattcggtgttgtacaggttgaattccggcacatacgagatcagatccatatgcgcatcgtagaactgcttcagagtacccacgtcgcgccagtaggcatgatcggtcggcgtcgctcccggaatctcgttggagttgaagtcgtacacgccagcctcgttacgggccgcgaagtacggtgcgatatcgccgcccatatcatgcttggtgtcttcggccttctcgtcaagcgccaaagcttcgaacagggcgtcggtgttggccacgtagttgcccatggaagcaagaatggagttcggatcatctggcaggccggtcgtggtctgcggcttctcctggaagctcttgatcatattcgggtgctccggatcaacctcgatcacgccgaactggttggactggctgatcggctggcgaatacccgccaccgtgaactccgcgccggattcgatatgctgctgcaccatctgctggaaatccatgcggtagacgtggtcggcgccgacgatcaccacaatatccggctgcacgtcctcgatgatgttgatggtctggtagatggcgtcggcagagccgagataccagtgcttgccaagtcgctgctgagccggaacaggggagacgtagttgccgagcaacggcgaaaaacgccacaccgtggaaatatgacggtcaagcgaatgggacttgtactgggtgagcaccacggtctgcatatagcctgaattgaccaaattgctcagcgggaaatcaatcagacggaacacgccgccgaacgggacggcgggctttgcccggtctctggtcaaaggcatcagacgagtgccttcgcctcctgcaagcacgatggaaagaattttcggattctttgccatgagaactcctctcctagagcgtcgttacgacaccgcacacattggtcggtctgcatcatcgcaaaccacttacgcactcaataattgcatattttctgcaacatgcaaggagtttgcatcgcgagtcttgaaaatttgctgactgtttcagtgaacagctgttgaatagaaggccacggcgctcgatgcggcgacgttaagactgtccactccgtggctcatgggaatcttgaccgtcaggtcggcgcgggagatggtgtgatgcgacagaccgtcgccttcggtgccgaaaatcagcgccaatttgtcgatatggtccttttcgccgttgtcgttgttcaaacgacgaacaagctcctccagcgaaatggaatcgtcttcaagggccatcgcaacggtggtgaacccaagatcgcgcaattcctgcatgccggtgaatggccagtagtgtttatcatctccgccgatacgagtccacggaatctgaaacaccgtgcccatcgacacgcgggcggcgcgtcgatacaacggatcgccgcaggagggcgtcaccaacactgcatcgacgttcaacgcggcggctgatcgcatgagggctccgacattggtgtggtcaacgatgttttccatgaccgcgatgcgtcgtgcgccgcgacacacctcctcgacgctgggcagtggccagcgtttcatcgcggccagggcgccacgatgcaagcggtagccggtcagctgcttgagctgttcaggggatgccacgtacacgggaatgtcggtgccccaacgttggtcgatgcgtgcgaaggtttccgacatgcctccgatccacggttcttcgacaagcagggaaatcggttcccggtcggcggtcagcgcgcgatcgatgactttcggcgattccgcgatgaacaggcccttgctgggttcaagcttgttgcgaagctggatttccgtgagattcgtgtatgccgacacgcgctcgtcgtcaatggaatcaagatggatgaactgcatgtgatcgatctttcgccgaatagctttcagatacaagaaaaccccttgtttccaaggggtttgctggtgtccggagcgggacttgaacccgcacgcctgtataaataggcactagcacctcaagctagcgcgtctaccattccgccacccggacaggtgcgttgctcagcggcaacaaacgaaaactatagcagatgctcggtgtgatgcaagtctcggcgtgtcgcgcggaattacgccattggtatccgaggtgctggtaggctctgaaactatgactgatgcccttttcctgcttgatacggaacatgatgatgtgccggtgaacagtgacgaattgaacgccggatggaaattgacgttgccccagtcggtgcgtcgacatgccattcaggccatgcgtctgaaagacggtgacgaattgcagctttccgacggtaaagggctacgtatccacgcggtgttgcgcgatgcgcaacaaggaatcgcggaagtgtcgagcttcggcaaagaaccgcagcctaccaccaaactcgctttgatccaagcgctggcgaaaacaggacacgatgagcaggccatcgacaccgcaacgcagatcggtgtggatgaggtgattccatggcaggctgatcgttccatcgccaaatggaaggcggggcgcaccgataagaagtggcggcaagtgcttgatgccgccactgaacaatcccgacgctcctggacgccggaattgggggagtgcgtgaccagcaagcagttgattgccatttgcaagcgtgcctgtgtgcacggcgacatggtgattgtgctgcaccaggatgctaccaaaacttggagccagctggaggaagcgatcgcggtgctttccgacaaatgcttgcaggacgggcgccagcgcaccgtgtacgtggtggtcggcccggaaggcggcatcagcgatgctgaaatcgaatccttcaccaatgcgggagctgaagcatgcgtgcttggaagcaatattctgcgagcgtcgacagctggtcccgtcgcgttatcgctgctcgcacgggcgttgggacgattcatctgacgccacacgccggcgaaatgcggcggattatcccggttgcgcaatagcatgggtaccgaaggacaaccagcattaaggagcattatgagcgacaaggattgcctgttctgcaagatcatcgcaggagaaattccaagcgaaaaagtgtatgaggacgataccacctacgcattcaaggacatcaatccgaaagccaaagtacatgtgctcgtggtgcctcgcaagcattatgcgaacgtgaccgagcttgcggcggccgatccccagcagctcgcccacatggctcaggtcgcgcaaaatatcgccgaccaggaattccacggtgccttccgcctgatcttcaacaccggaattgatgctggccagacggtactccacgtgcatgctcacgtgctgaccggcgaaaagcttgacgaataatcttccctttccccatatatcgacgtcagaagaggttttgtggccactactacacgtaccatcgcgattccgcagcagcttgacccggtgaccgtgctcggaccggtcgacgaggtccttcgggaagtggaacgtgcgttccccgacttgaccattatcgtcagaggcaaccgcatcgcgatcatgtcacgttccagcaaatccgaatcccaagccgcacaggccgagcatgtgatcgaaaacatcatccaagccgcatatacggctccgatggacgccgatacggtgcgacgcatgctcgatcaaaacgtgttgaaaaatcctgtgcgtgctactcgcccgggccatggacgtgtagtggaggaactacggctggccgatcggcaacaggagcatacctccaatcgcgagaatcatgcggaccgacgcaaaccgcatgtgcccggagtgatcacctttgcgctcggcaagccggtgcgtgccaaaacggctggtcagatcacatatgtcaatgccatcgaatcacataccatcacatttgccatcggaccggcaggcaccggcaaaacataccttgcagtggcgaaagcggtacgcgcattccaagataggcaggtgcgccgcattatcctgaccagaccagccgtcgaggcgggagaaagccttggttttcttcctggcacattgaacgaaaaagtcgatccatatctgcgtccgctatatgatgcgctttctgacatgctcggggcggaccagctcaagcgctacatggatgacggcaccatcgaagtcgcaccgctcgcatatatgcgtggacgcacgctcaacgatgcattcgtgatcctcgatgaggcgcagaacaccaccgaacaacaaatgaagatgttcctgacccgactaggcttcaatacgaaaatgattatcaccggcgacgtgacgcaggtcgatctgacagtaccgaaatccgggctcgccaccatcgaacgcatccttgacggcattgacgacatcgcattcgcccacctcaaaccggaagacgtagtgcgacacgcgcttgtcggcaaaatcgtcgcagcgtacgaccgacacgcggccattgccggcgaccacagcagacacgccacgggcaaaaccacatccaggcaaacaagcgagcaaatcgaaaggaacgctgaatgagcgtcgaggtaaccaacgaaaccgtctggcaaattgacggcaaggtgttctccgatcttggcatatgggtgatggaccaaatgcgggtcagcacgcaatccgacctgaccatcatgttcgtagaccccgatcccatcgcccaactgcacatgcgttggatgaatcttgaaggccccaccgacgtgatgagcttccccatggacgagctgcgcccaggagacggccgaactgtgatggaaggcgtgcttggagatatcgtgatttgcccgtgggtggctgcgcagcaggcgctcgcggccggacataacaccatggaggaaatgatgctgctgacgattcatggcatcctccacctactcggatacgaccatgccaccccagaacaggagcgtcagatgttcggtctgcagcgacagctgctactcaccttcttcgcgcttcgccagggagcggggacgcaggccatccttccgccggatacgccggacgcgctcgccgaatgggataggcagcatggcacgggacggcagatcgccaaataatgattgacgttgccggtagcatatcgtccggcatgatgggggctgaattatgcaggcaacaatgattgcgatgatcgtggtgctcgccgtggtggcgctgctgttggtctggctgtcgctttcaatggccgcgactgaaggcgctgtgggacgtgtgaccagggcgagcctgaataaccttattctcgaaattcaaacggatgccgagctttcgcaattcatacgcgacaagaaaatcaggcgcattcataaggttcagcggttggtggccgatcgctatgccaccgccggatcgtgcgcgttcttccgcatctgctgcaatgtggttgatggtgtgctcgtgacggtgattgcgggcatgttggacgctccactatgggccgaattacttgccggatttgtttttgccatcgtcattgcggtgatttcgctgttggtgcgtccgcgtagtgccggggcatccaagccagtcgacattatgctgcagcatgtggatgctgtttccattgcggttctattaaccccattcgcaaaaatcggggggcaaaaaggcgcgaagcgtcgcggcagtgatctttccgacgacgaggagctcgaaaaaatccagatcgaacaaggacgggcaaccattgaccgtctggtcgaagccaacgatttcgatcctgaagtttccgaaatgctgcgcaatgtgctcacgctttccgaaacgctgactcgtgagatcatggtgccgcgcaccgacatgatttgcatcgagcgagacgaaacgttggagaatatgcttaagctttgctcccgttccggattctcacgtgtgccggtcatcggcgacgatgtggacgatctggtcggcgtggcttatttgaaagatgccgtgcgcgcgacgaccttcaaccatgcggcgatgacacgcgaagtcgaatcgatagttcgtgaccccatgctcgtgccggaatccaagccggtcgacgatcttttccaccaaatgcagcgcacacgccagcatgtcgccattgtggtggatgaatatggcggaatcgcgggcatggtcaccatcgaagatgccatcgagcagattgtgggcgaactggaagacgaacatgatcgcacgcaacatgccgatccggaacggatcggtgacaagaaatggagcatgcccgcacgcacgcctatcgccgacttggaagagattttcgaaatcgacattgacgaggatgatgtcgacaccgtttacggcttgctgaccaagctgttgggacgtgtgccgatcgtcggatcctccgcagtcactcgaggcttgcgcatgaccgcggtcgactccgcaggacgccgcaaaaaagtgtcgaccattgtggtggagccggcccacgtcgagggcgtggacgaaactgaaacacgtaacgaagaacatgcggatgatgccgaaaaggcatccgacaacgataaggattccaaagacaagcatgactgacgcagcaacaaccgagacgacttccgaccattccgattccgccacgcccgttccatatcggtccggtttcgttgccgtggtcgggcgtcctaacgtgggcaagtcgacgttgatcaacgcgttgatcggtacgcagatcgccatcgcatcatctcgcccggaaaccactcgtaaagccattcgtggcattttaaccacggataatgcgcagatcgttttggttgatacgcctggcatccatcgaccgcgcacactacttgggcagcgtctgaacgatgttgtggacgagtcgctcgccgacgtggacgccgttgctttcctgctgcctagtaatcaggagattggtcccggcgacaagcgcattttgagccgtctgcgttctgatttcgcagtcaagcgagatgatggcacattcaaatggaaggtgccgctggttgccatcgttaccaagattgacgaattaagccgtgacgggctgatcaacaagctcattgaaatcaacgaattcgccgacttcaccgatattgtgccagtcagcgcgctgaagcatgacaatcttgcggaagtcaagaacgtgcttatcgagaacatgccggaaggcccgcaaatgtacccggccgagcagatcaccgaagagcgtccggaagaaaccattgcggaactggtccgtggcgctttcctggaagaattggatgacgagttgccgcattcactggccgtagtcgtggattccatcgaatatccggaagacaacgatagtggcgaagcttacgatggcaaagcccacgtgattgtgtcgatttatgtggaacgcgattcccagaaaccgatcatcatcggcaagggagcggaacatcttgtgcgtgtcaagaagaagttgcgtacgccggtcaaccgtattgttggacagaaagccaaactcgatttgcatgtcaaggttgccaagggatggcagtcggatcctaaacagctcgagaagctaggcttctgatctgtttaggatccgcttcgcagcgaagctgctcacttcacctaaggacagtccactggactgtccttttgacggttcagccaaacagctcgagaagctaggcttctgatctgcttaggatccgcttcgcaacgattgcgtggaaaataataaatgaggtctgattcccgtaggagtcagacctcattctgctgtttcgaagactacttcttcttggtgtacatctgcgtattcagcaaagtggcataacgcttgatgaccttcggacgaatcaccttcatggaagcggtcatcaaaccattctcctgagtgaattcctccggcagaatgatgaacttacgtacggactccgcacgggaaacaccttcgttggcctgatcgacccacttctgcacttccgcacggacggcggcattgttggcggcctcctccatgggtatgtcgcgattcagccccttgctttccaaccacggacgcaaggattcctcgtcaagcgtaacaagtgcggaaatgaatggacgcttgtcgccaagcaccaaggcctgggaaacgaattcgcaacgcttgataacctcttcgatcggaccgggcgagacattcttgccgcctgcggtgatgatgagatccttcttacgtccgatgatatacaggaagccgtcatcgtcgatacgtcccaaatcgccggtacgataccagccgtcttcagtgaatgaatcctcggaggcttcctcgttcttgtggtacttcgggaacacggcggtacccttgacctgaatctcctcatcttcggcgatacgcagctcgaagccagggaaagccacgccgacggaaccctgatgatagggcacaccaagcggattgaacgcgcaaggagccgtggtctcggtcaagccataaccctcatacacgggcactccggcgccacggaagaacgccataagttccgggtcaagaggagcgccgcccgccacgatccactgggcacgtccgccgagcacctcgcgtagcgaagcgtagaccaccgggtcgaacgccatacggcgagccttggccaaagctccggccttacccttcgcactgacctccttcatgtaattctgggctgccacaacggctgcggcgaacgccacgcccttggcgccatgaccagccttctgcgaggccgcgttatacaccttctcaagaacacgcggaacaacgatcatgacggacggcttggcgacctgaagatcggcgatcagcgtcttgatgccctgcgcgatgtaaatatgcagttcgctggctacgcaaatgtagttgatggcacgtgcgaaagagtgcgcctgtggaaggaacagcagcacgctgttcttcctctcatgcagcagtttcggcatatacgccggaagattcaacgcggtggtgcaataatgctcatgggtcatctccacacccttcggcgcggcggtggaaccagaagtatacacaatggagcacaggtcggttttcttgatggaagcgatgcgctcgtcaagctcttcgtcgctcacgccggagccgtaggccatgatttcgtcgagaccgccgttctcgaagcagataatgtgttccagtgccgggcattccttatcggcaccatcggctttggcgcgcatatcggtggtctcgaccaccagcaagcgggaatcggaattattgacgatattacggatctgctccgcggaatccgtgtcgtagatcgtggcgagcacaccaccacatgccatgacggccgcgtcgaacacatcccactcgtacgaggtacggcacatgaacgccacgccgtcgcccttcttaagaccgtaatgcatcagacccttggcgatctgacgaatatcggcgagcacctcgttgccggttttggtcacccattcgccgttcgtcttataggtgtagagcggctcgtcacccatacgctcggctcgatcggcgtaaatatcgtagatggtggtgccctcgtccagcggcggcttgccctcggttttggtggtcaacagaccggtttccggatcgaggaacgtggtggatgggaatccttcgccccattcgacggtgtgcggaaggtcgatatggccgtcgggggagatgatgttgttcggatcgttgtaatccggagtgttgccggaatcgtcgctgacggggtgaacgaagtcacctcccaaacgcagtgccttctgcgcaagatttgcagctcgcttgttcaaagaggtgatgacggacacgtgactctcctacacatttaaatccaatatctgtaggaatgatagacccatgaatgcgacacgtcaccttacggtagcgtagggaaagtgcgcatccagcggggcctgcgtaaaggaattgccatgcgatgccattcaataggtgaacttttcttcatacaaaggtgtgacctacgttacactggtgcgctgtatctgttcattttgatttctttaacgaggaagaaagggcacctatggctgaaacagctgaagccaccgtggtcttcggagttctcaatgagacctccgaacacgagtctcgtgttgctctgacaccggatatcgtaacgaggttgcgtaaatcgggtgttaactgcctgatcgaatccggtgcgggcgtcgcatcgcattatgttgatgaggattatagtaaggccggagcgcaggtcgtctccgccgatgaagtgattgcgcgtgccgacgtgcttggtttcgtcgatcgtccgagcagcgcgctgctcggacgcgttaagcagggtacctggattatcggtatgctcggttcgttcaccgacgccgattatgtcactgcgattgaaaaggccggtctggtcggtgttgccatggagaagctgccgcgtcagttgagctccgcgcagtctatggacgagatgacttctcagaattccgtaatgggttataaggcggccatcgtggcggccaacgcgtacggttcgttcctgccgatgatgaccaccgccgctggcacgatccgcccggccaaggtgcttattcttggcgcaggcatcgcgggtctgcaggccatcggcaccgccaagcgtcttggcgcggttgtcaccgcgtacgatgtgcgtccggcttccaagggcgaagttgaatccttgggcgcgaagttcctggatctgggtcttgacttctccaagggtcagggcgagggcggctatgcccgtgcgctgagtgccgaagagcaggcccagcagcaggctgccgtcgatcagaaggctgccggcttcgatatcgtcatcaccaccgccaaggttcccggccgcaagcctccggttctgctgaccaaggctggcgtggccggactgcaccgtggcgctgtgatcgtcgactgcgcggcaagcgacctcggcggcaacgtcgaaggttccaccgtcggcacccaagtcactgaaaacggcgtgaccatcatcggcgctccgtacctgtcaagcggcgtttccactaccgcatccaacctgctgagccgcaatgtggccgatgtgcttgcgcatttcgtgcgtgacggcaagctggccatcgatctgaacgaagagcttgacaacgccatggtcgtggccggccgcggcgaggaagccaagaaggaaggggagtaagcaatggatatcgttgttgcgattactctgttcgtcctcgcgctgctgatcggcgttgaggttatcggcaaggtgccggccaccttgcatactccgttgatgtcgggcgcgaactcgatccacggcatcgtcatcgccggcgttgttatcgtcgccgcgcatgccaccagcccgctcgcctgggtgttcatcttcctggctgcagtgctgggcacgatgaacgtggtcggcggctatgtcgtcaccgaccgcatgctggagatgttcaagtccgacaagggcaagaagaaggaagaggaggccaagtaaatgggtaccatggctgaaatgctgagcacgccgctcggcgtcatcgaatggttcgtctatctgctggccgccgtgatgttcgttatcggcctgcacttgatgaactctccgaagaccgctcgcaagggcaatatggtctccgctgtcggcatgatccttgccgtggtcatggcgttcattgtgctgttcgcaggtgagatctccaacggattccagcatggcgttgccgttgtgctgctgatagccggcatcatcatcggtgccgtcgccggtgtggtttccgccaagaaggtcaagatgaccgacatgccgcagctcgtttccgtattcaacaccgtgggtggcggcgccgccgcgcttgtggctttgaacgacattctgacctccgagggcacgccttccatcgtggtgttgatcaccgctggtttgggcatcatgatcggttccgtcacgttctccggctctctgatcgcagccggcaagctgcagggcatcaagtgggtgaagaagctgaacttgccgggcaagggcttctggaacattctgttcgccgtactgaccgtcgtatccttcgtcatgctgtgcgtgcagccgggccagcgtctgctgtggtccgtgctcaccaccgtgttcgcgctgtgctacggtctcgtgttcgtcatcccgatcggtggcgccgatatgccggtggtcatttccgtactcaacgcctgcaccggtactgcagtggccatgtccggcttggctatcaataacatcgctctgatcgtggccggcgcactggttggtgccgccggtgtgaccctgtccatcgccatgtccaaggccatgaaccgtccgctgctgtccgtgcttgcaggcggtttcggtggtgccaatgccgccgctggcgctggtgagggtccggaaggcagcatgaaggaaacttccgcggacgatctggccgtacagctcgtatacgccgaaaaggtcatcttcgtgccgggcttcggtctggcccaggctcaggcccagcgcgagcttgctgatcttggtgtgctcctcaagaaccacggcgtcgaagtctcctacgccatccatccggtggcaggccgtatgcctggccacatgaacgtgctgctcgccgaagccaacgtgccgtacgaggagctcgtcgatctggatgacatcaatccgcagttcccgcaggccaacgtggctcttgtggtcggcgccaacgatgtgaccaacccggccgcacgcaagccgggcaccccggtctccggcatgccgatcctcgacgtcgacaaggcccagaatgtggtggtcatgaagcgcggtcgcggtaccggttatgccggtatccagaacgaactgtacttcgaagacaacacgcagatgcttttcggcgacgccaaggcaagcctgcaggccgttatcgcggcagtcaaggagctcatcaactaacagctgaaacgttgcgttgatgcttttcctgaaaggtctcttccggtgagggaagggacctttttgcatatggtgattttcgtaagatcaggtctgttgcatgcgaattgtgagttatccacagtcgttattcgcctgtggatatgggtggagttttccacatatccacagattttcaaggttcggtggcgcaagatgatttgaatatgagacagtaggtgcaccctacaacaaaggagttgcacatggcggaaataatcactggcccgttccatatggatgaacagggatttttggcaacgatcgaagaacttatcgagcggtttgatggatacagttctggcaaatatcttgcggaattgggaaaaatccacgatgaatacggtgagatcggatctctttcgctttttgacgaaaaagtctgtgaactggggaaggaattattctgcagcacatcatgggtggcgaatctggcgtgggccatgatttcgttcgattatgatctggttgagcatgatgcgaattttcttgatggatgccgtaacatcgtgcgtaagtacggtatgagcgtttggctctatgaaatgatcaatgacgcttcgatagcggtggctttgcaaaggcccagcagcagaatgccattccagattggattgacctacaccaaggatgtgtttcggagaagcaagaaaaagggtggaaaatacgctaccagcaaaaagaagagactggcctgcatggctgaatatttgcaggaagtatattggctggccgcgtacagtctgctacgttggggtgaggaagagccgcgtgcggccgatgttgcgttgatggtgcttggatatggcggtatcggcatgtgcatgctgagggacgatccgaaagtggtggattccggatgcgatgaagacttctcctatcgaaatctgtgcgaccatctgcgcgatcttagaattcaagccgatctggactatgcttgcaatgccgaccttgccgaatccatgttgcttgaatatcccgcgtgtatggatgcgcgatatctgtacgatgcggggaaaatcgtggaagcgtatcgtgctttgtggaacaagcagactgaatcagcttcgcaaatcatggaacgcgtttaccagaagggcgcgtatcaggtgacgaacatttgggaggatccgctgtacctgcatgatcttgccctgtcgctgttgggggcagtcggctcgcggccccttactgaagggttccggactcgtgatgacaagatgttccagcagggagtggaaagtctgagacgaacgactgaatccgttaaagggatggggttggcgatgacattgggagggtacatctgcttcccggaaccggaaagtagggatgatgcgcttttcgcaccgcgaaaggagaagaaacgattaatggacgcctgtaacgggcttagggatttgtcggcaatggttgcgctctaccgttttccaagggatatcgaatccctgcgtgcaacgcgtgcgcttctcgctcatgacgcgaagggatatatcgatctgatgggtccatacatgggaagcgcggatgagacgggaggaaacgaggggaggccggtttcaatcggcgactgatcggcctctcagatcgcgaacgtcaaagcgtatgtatcatggttgtgccgagattgaatggcggaacgttcagatgaactttgtctcttcgatctcggtgcatgctatgccgtattgctccaacaattcgcgaaatgcttttacgtatctatctgtggcgaacttctgtgtgaatgacagacagaagttctcgtttacgtaattcacttccaccagcgtggacgtccaatccgcataggcgtaacaattttggacatgccgtgccaaagaaccccgatcgaacattcctgtataactgatgtcagctgttgaacatcgcatgctgataacttgtctgcacatctgtttctgggcttccagattcggcaggctctcaagatagtgattcagccaagtggttcctgccagcttgggaatcagtgtttcaatatcgcacgcgtctacctgttcatggggcattttcagcttggtccggcagatgcggcccttggcacaatctttgcacagaccatcagtgtgatcgtcgcgctggtggtgattcgttgcaagcagaaaggcattcgtttaaggaaggctgatttcaagccgaatcgcaatatgttgggcggcattctcagcatacggacgttcgtatatcggcttcattaccctgccttacttggaaatcgtatcgtcaaggtgcgcaaacagtgggcgagccaaccatgccaagggtagtgatgccagtgctgaaatcagcagaataagccaaaccgtgcaatgtgcgtgcagccatccgtaaagcatctgcccgagtggctgggcgcatatcgtcaatgatgaaataatggccatgaccttgcctgtaagcgcggttggtgtcctcatctgaatagatggtacgagaatgaggttcaagaaatcaacggcgattatgactgccgcagtgcagagcaccagcatgatgagcttggtttgcgttgaacatggaagcaggaaggcgatggccggtgggagcagcataagactttccacgaacaacaacgaaggggcgtttcgtgatttcaaacggttggcgaaacagccagcgatgaatgttcccgctatgccggcaatgccgataatgccatcgcatagaccatatgtcgccgcatcgtagcctaacgtagttcgaataatgtaaggaaagcttactgaactgaatccagtcagtatcagattgatccatgtgcaaacaccggctaatcgtgctacggtcggctccttgcgaagcaggaaagcggtcgccgaatgcatatcgccaatgatgacgtcgagcaggcagatgccggcatcatcttgattcgataggggctttgcgagtctgatgaagcattcaaccatggctgccgacataagacatgctgcggtgatgagcatcatcggtcgaatgccgaccagcccgtacatcacgccacctaggaaactcgggagtaattggctgagctgctgcacttggttgatgatggccgcgcctcggcgaagatcagtggaggactctcttccgatgatttgtggcagtgcggattgcacgacgggagtttccatggcatcgagtactgccaacactacctgcatgatggcgatggcgagaatgttgaatccggatagtgcgaaaaacacagtcgcgagcagtgtgacgattcctgagatgatatcgagcgccaccatcatggcacgtttgcttactcggtcggccataacacctccgaatgggctaataagtatggtcggaatgacggatatggccagcacggtggcgaaggtcgtggatgatgcggtttcgtccagtacccacatggacatggcaaatcggagcatggtattgccgaacaaggaaatgccttgaccgagtacaagcaggatgaagtttgcggagcacaagctggattggagtgtctttgctgacgagtttttcatgactattcctttcgataccgactgacggtatgtaaaaaaggtacaaataaagacagattgacattgccgagcttttattgcggattactggcgagtaggaagaagccttccgcaagccgatcttccatatcactgtcgtgatcgataagtggaactccgagcgagtccataatcaatccaagaccgtggatgcgatgcttgaattcacttagggtagtgatggggtagaagtttggggctagccagtaattgaacagcagtgaaaaaagttccgcggcttcttgagggtattcggttgtgattgaaccgtcccttaacccctcctggatgaagtcgtacgcgattttggtgctgtcggttcgccagatgcgaagattttcggcgaggattttcgggtcgttcagcaggggaaacgcatcgcgcatgagggtcatatgttcggtgtcggtaatctgcatcatgagcgaattgcgtagtttctgcaatccgtttcgtgagccatcctcttgatttgcctggggaagaagtcgttcgttgtcggaatctaccagcgcatgcagcatcgcttctttgtttttgaaatgatggtagatagcgcctttgctgaggtcttcgagctcgtcgagaatatcttgaatcgtggtgcgctcataccccttttgcgcgaacagctttttcgcggcgtcaaggattcgctgtcgtgtcacttcagggtgcgcattgcgcgccatatgcctctccttcgatgatggagtcgaatacaccgacattatacataccgttggtcggtatggtatgtcggatatctcccagctcgatcgaaaagtgtgccgaaagactctctgcagatttctgcgaagaaacctgaatctgcgttgccggggtgcgggatgtctgtcttttctgcggttggtgcatgattgggtgtccaaggtcaacttgagtgagtgacggctggtttcccgaagggaataagaccctggttcctatatgcctttttatggcatggggctttcggtgaagaacgattgcatccgatgtgaaaaatcccacaaatccggcccacgtcctgctcgagaacttcaaaactgttgccaatactggaaacacgccgtatatagtgtttgaaaatgtgacgagacactgtatgttgtggtcttgatttttattttcgttcggataatgtgtgccacataccaacgacgtacggtcgtgaaaggacgtggaacatgaacattacgttatacaccaaagcaaactgcccgcaatgcacggcgacgaaacgccaattggacaaacgaggccttccctatacgactgtcgacattacggccaacgcacgtatttccgacagattgcggaacgaaggatggcggcagatgccagtcatcatcgcagacgacgaatcctggtccgggtatcgtcccgacaaaatccacgagctggaggctcgctgccggtgagcgcgttggtgtacttctcgtcggcatcgggcaatacgacacgcttcgtcgaaggatgccgattggatgaattcggcattcatacaatgcgcataccgctgcggccggacgagccggagctgcatgtggatgagtcctacgtcttgctgacacccacatacggcggaggaacaatcggcaaagcagtgcccgtgcaagtcaaacgattcctcaatgatgaacgcaaccgcagtggcatcatcggcgtcatcgcatcgggtaacaccaacttcggcgaagcctacggcatcgcaggcgacatcatcgcggctaaatgccgcgtgccgctactctaccggttcgaactgatgggcacttcagaagacaccgcgaccgtgcgcgaaggactgcgcagatttttcgacgaatacacacaacaggaacaacgataaccatgccagaagattcaacgacaccacacgcagcaaccgacgtcatagcctcctacgatcgcgcccatgactggcactcgctcaacgcgatgctgaatctctacgacaagcaggggcgcatccaatttgataaagacatccaagccgtacgcgagtacgtcgaaaagcacgtgctgccgaacaccgtccgtttcaactccacacaagacagactcagccggctcatcgcagacggctattacgacgaatccgtatttgcccaatatgatgccgaattccttgacaggttctaccgcaacgtggatgactgcggattcgaattcgatacattcctcggagctttcaagtttcaccgctcatacgcattgaaaacctttgacggcaaacagtacctggagaacttcccgcaacgcgcggccgccgttgcgctcgcgcttgccgccggcgaccatgcggccgccgaatcgtatttcgaagaacttatatcaggacgtttccaaccggcgacgcccactttcctcaacctcggcaaggcgcagcgcggagaggcggtcagctgttttctcgtacgtatcgaagacaacatggagtccatatcgcgtggcatcaacgccgcattgcagttgagcaaacgaggtggaggcgtcgcgctgttgcttagcaatctgcgcgaggccggcgcgcccatcaagcgcatcaaacaccagtccagcggcgttgtgcctgtgatgaaactgcttgaggactctttcagctacgccaaccagttgggcgctagacagggtgccggtgcggtgtacctcaacgctcatcatccggacatcatgcatttcctcgataccaaacgcgagaacgcggatgagaagatccgtatcaaatctttggctcttggagtagtgatacccgacatcacattcgagctggcgaagagacacgaacctatggccctgttcagcccatatgacgtcgaacgcgtcatgggcagacccttcgccgatgtctccatcagcgaaaactaccggaatatggtggacgatgaacgcatcgggaaaacctacatcgacgcacgagagttcttcatgactttggccgaattgcaattcgaatccggatacccgtacatggtgttcgaagatactgtgaaccgagccaacccgatcgacggacgaatcgccatgagcaacctgtgctcggagatcctccaagtgcaggagccaagcacctatcatgaggatctgtcctacaatcacgtgggacgtgacgtgtcctgcaatcttggatcgctcaacatcgccaaagcgatggacggtgatttgggacgaaccgtggaacgtgcgattcgcgcattgacctcggtgtcggaacatacggacatcgcgtgtgtgccatccatccgacgcgccaacgacgaaggtcatgccatcggcctgggacagatgaacctccatggattccttgccagagaatcgatcatgtacggttcaccggaagccctcgacttcaccgacatgtacttcatgaccgttgcataccatgcctaccgtgcctcgcatgagctcgcagtcgaacgcggaacacggtttgcaggcttcgaacggtccgcctatgcgaagcctgcaggcgcaggcaactatttcgacaaatatacgaacggcgagcgctcgctggcgccgaagaccgggaaaatcgcgtcgctgttcgcacggcggggcatccatatccccaacgaggatgattggcgtcgtctgcgtgacgacatcatacgtgacggtatcttcaaccaatatctacaggccgtgccgcccaccgggtcaatttcgtacatcaatcattccacgagttccatccatcctatcgcctcgaagattgagattcgcaaggaaggcaagattggacggatctactatccagctccgtatatgaccaacgacaatctccagtatttcgcggatgcgtacgaaatcggatggaaggccattgttgatacgtatgccgaggcaacgcggcatgtcgatcaaggcctgtcgttgaccttgttcttccccgatacggcgactacccgagatttgaacaaggcgcagatttatgcatggcgcaaaggcatcaaaacgctgtattacatccgcattcgtcagcaggcgttgtctggcaccgaagtacaaggctgcgtcagttgcatgttgtgaaacctgtgacttgaaaggaaaagaaaagacatgtctcgtttggtttaccgcgcgatgcttcgtctgacggctccggacgaatacaggcggttatacggccgcgacgataagacgacgattagaaaggacgaccatcatggcgccgatatccgtacctcgacagaggattaagctcattgaccgtgtgagtgccatcaactggaacaaacttgaggatgacaaggaccttgaggtatgggacaggttgaccggcaatttttggctgccggagaaagtgcccgtctccaatgatttgcccgtttggcgcacaatgagcgaggccgagcatacgttgaccatgcgcgtgttcaccggtctcaccttgcttgacaccatccagggaaccgttggcgcggtcagcctcatacccgatgcgcttaccccgcatgaggaagccgtctatacgaacatcgcgttcatggagtcagtgcacgccaagagctattcctcgattttctccaccttgtgttccacccgacagatcgacgaggcgttctcttggagtgaggagaacgagtatctgcaaaggaaagcgcgcatcgtgctcgactattacgagggggatagtccactcaagcgcaaagtggcctccacgctgctggaatcgttcctgttctactcaggcttctatctaccgatgtatttctccgcgcatgccaaactcaccaacaccgccgacgtgatccgtcttattatccgcgacgaagccgtgcatggttattacatcggatacaaatatcaaaaagggcttgagctggtcagcgaggacaaacgcggcgaactgcgcgactacacctacgacctgctcaacgagttgtatgacaacgaggtggagtacacgcgcagcctctacgagcctgtcggattgacgcaagatgtcgaaaagttcctgcgatacaacggcaacaaggcgttgatgaatctcggatatccagcgcttttcccacaagagatctgcgacgtgaacccgtcgatccttgccgcgttaagtccgaacgccgatgagaaccatgacttcttctccggttcgggaagctcgtacgtaatgggcaaatcagtcgagaccgacgacgatgactgggatttctgactgtatcccagacaaccccgaggaaagcagctatgggaaaccgtcacgggcgagttcgcgtcggatcatccacgcagatatctgcccgtgacgctgtcaggacaggcacggaccgtttccggtgttccctcgcatacgatgcgaccgccggccatgcctccgcccggacccatgtcgatgagataatccgcgttcgcgattacatcaagatcatgttcgattactacaactgtcgccccagaagccaccaacgagtcgaacacgcgtagtaataccagcacatccaacgggtgtagcccgatcgtcggctcgtcgaacacgaataccgaaccggactgtccgcgtcccatttcgctggccagcttcagccgttgcgcttcgccgcctgataacgcaggagtcggctcgccaagtgtcagataccccaggccaagctcatgcagtgtggccagtttcgatcgaacggggcgtaggaaatccaatagaggcatcatctcgtcgacgcttagcaacatcaattccggcagtgaacgggcgacgctgtccgcgcaaaccaatcgaatgtcatcggcggtctgtgcataccgtgtcccatggcaatcgggacacgtgacgtcaacatcgggcaggaactgcacgtccaacgaaatggtaccggttccatcgcaagtggagcagcacaacttgcccgtgttgtatgagaatgcgccaggtttgagattcttcttatgggcatcggaagtcttcgcaaacgcacgacgcagatcatcgtgaacaccgcaatatgtcgccacggtcgaacggatgtttgctccaatgggcgtggcatcgatcagttccactttcgaaatgccatccgcgtcaatcagacgaatcgagctcggggaaacggtaccatcagcggccgagcgcaacgcagggaccagtgtctccaataccatcgtcgtcttaccggaacccgacacgccagacaccacagtgagacgtcctcgcggaatgtccaccaataacggatgcaccgtatgcacggtattcgtctccaaatgaatccgacccttggcgaacatcgcatctaagtcaatctgcggccgcgcccgctcatgtattttgccaccatcacgcagaaaaggcgctatctgagaaccaggtgccgtcataacatccgccaccgcaccctgagcgatcacatgaccgccttcggcaccggccgttggacccatctccaccaaatgatccatcgcggcaagcacacgggtatcatgatcgaccacaaccaccgaattgccgtcagccaccaaatcgcgcatcacgcccaacagtccatccacattcgccggatgcaatccgatagacggttcatccagcacatacagcacgcctgtagtgcggttacgcaccgaacgggccaactgcacacgttggcgctcgccggtggacagtgtcgcacctgcgcggtcaagcgacaaatagcataatccgagttccacgagccgctcggccgtatcctcgaacgattcgcagatggctgtggccatcgcacgcatctcctgcggcaatgacttgggtactgaacgcacccaacgtatcgtttcgtcaagtgtcatcgccgtggcttgtgccagattaataccgagaatctgcggttgacgagcctgctgtgaaagcctcgtaccggaacaatccggacatggttgctcgctgaggaatctcgacacgcgtttgatacccttctcatccttggctttggcgagcgcgttctccacggtatacacggcgttgaagtacgtgaagtcaagttcggcgaaatcattgcctttcttcggtttgtatagaatatgcttcttgacggccgggccgttgaacacgatgtcccgctcggcgtcggtcagctggttgaatggaatgttcgtgcgcactcccatcgcgccgcacacctgcttcatcagatcccacatcaacgatccccatggtaatactgcgccggcgtcgatgcttttggtctcgtctggtaccagggaagcacggtcgacggttcgcacgatgcctgttccggagcaggtcgggcatgcgccggcggaattgaacgacagctgttcggcggatggtgggtgcatgagttgattgcaggatgtgcatcgtataggcaactcggccgccacgttcattgtgggacggttgcgttcgccacaatgctcgcagacatgtgaggcgcaacgggagaacaacagacgcagactgttgagcagctccgtcatcgtgccgaacgtggatcgcacgccgggcactgaaggtctttgatggagggcgagagccgcgggcacatgacgtatgtcgactacctgcgctcgactcgcttgggtgagacgtcgcctggtatacgtcgacaaagcctccagataacgtcgggatccttcagcgtatagcacacctaaagcgagagagctctttccggacccggagataccggcgatgccgactaatttgttcaacggaatgtcgacgtcgacgttcttgagattatgtacacaggcaccgcgcacttcgatgcgggacggcgggaaagctccagatgattgttccatacccactacagtacctgtgtggcggaaaacacgcgggcaggggaaccctgttcgtcatggtattgctgcaattgtggtatctgatccatatattcgaccgcaacggaggggatgccattgtttttcacggctaccgtcagcgtacgtgaatcggaaggcgatgcggtggaatacggggaaatggattgggaaaggaaagaatcatatacatcgtatatatcaatgggaagaagttcgccggggagcggaaccagagtctgttccccggcgcagggcggctaacaagcgaatgcccagaacatccgcataaggcgttgatgggctcatccgccgtgtcagcgtgttgaacgatgtatcatgccgctcaacgtgatgataaggcgttggcgcccttgcctttcgtggcgagcgtcacggcgatgatggacgcgagagcgacggcgtacagtacggtgatgatcggaatcagcgcgctgtatcggtgggccgcatccgtcgcatgagagacgacgaaggatgccaactggttgccggacaatccggcgaacgcccacgcgctcaaagccagtccgtgcacggtggacactgacttcatgccaaagtgctgctcaagcagcaccggcagcgttgaacacggcatcgacggtcaggatgacgctgatgcttcccgcgatggccttggccagaccgaatcccgcgacggcgatgccggtggcgagacctttggcgaaccacagcattaggttcttcaccggcgtcagatagccgacgcccaatccaatgcccatgattacgccatagaagatgagcacgccgggggcatcctgccgcgatactggctccggtaccggcgaacctgcaggcgaagcagaccgttgagatcaaagccgatttcttgatgtccttttcgacgaagggtccaaggaagacggccgacatgccaaggatgttgattggccatgtaatattcgttcctctctgttgtttgttcgccctgcgacgaacaaacaacaagataatggtgaagtattccgtggccttgagcgtgccgggaggcggcagaagtgggtaagccgttgatttcattggattttccaacaaatgaacattgtgtatgttcaccttggggataagcatgaggaaaatctcatgtgaaccttgacacagttttcatggctcacaattcgaatgcgcgtttgatgaaggcattgacggtgttccaatacagttcgggatccacgacggatgcttccatatggcgtgcgtcgggaaccatgagcttttctcgatcgatgctcgagcacgcttcgtaattgatcttgagaaaacgtgagctcacgatgtcgtcctgttcgccatgaatgaacagcatcggaatgacagtatgtctgagcgactgcagacaggtggcttccgaaaaatcgtaccctgcataatgtttgcagaacaatcccgcggcatccacacataccgcggcaagcggtttcggcagacgcgacgaatgccgaaggctgtcgatgaacaccatgcgcgcagacgtgtagccgctatcgacaatcgcggacaccacattgcgcggcagacgcgggtctcccgtcgtcatcatcaccgttgccgcgcccatcgaaccgccatacagcaggatacgggcgtcggcgtcactcgacgcgataaggtcgatccaattcagtagatcattgcgttcaagccagcccatgccgacgtaccgtccctcgctcaagtcttgggcacgctgtgacggaaccaatacggtgaagcccatgcgggcgtaacgatgtgcccatttcgcggtttcctccggtacaccggtataaccatgcatgcagattgcgtacaggtgtggttttggcgcagtgcaatccggatcgaacagccatccatgcagtcgaagtccatcatcgctggtaatcgtcacaggctgtttggcttgcgcgaaccattctcctgcttcctgtgcctcaccctgctgaagtttttcgatacgctccggcgcaatcagcgattgatggaaaacggaacgtttccattgcgtatcgatgcagaaatggaacaggtatttcgcagtcgtagccaacgatgcgatacaggcagccgtcacggctcccgtggcgatgcaaatgtcgcgaacgattgtgtcattgtcatgcttcattgctgtctcgtttccttgcgattgacggattgttcacaattactatcgattgtacgtgcgtacggcgttttcgtgggctttgacagattttttcatttttgatgtgagacgtttttcgataatgtccgccctcgccgtatactggttaactgttgtcttggcgagggaagcgtatggcttccgtaatcgactcggcgtgtgattgtaggctccttgtgggttgattcacggctcgttgatgcgccgaaacagaatgaacgaataaaacataaggagaaatagcccatggctaccaccattaccctcgaaggcgctgcccgtaccgagttcggcaagggcgctgcccgccgcatgcgcgtcgccaaccttattccggccaccgtgtacgcaggcggcgaagagccggtcttcgtgcagctgccgatgaaggaaaccaccctgtccctgcgtcacaccaacgctctgttcaccatcaagttcggtgacgagaccaagatggccgtcgtcaaggacgttcagcgcaacccggtgaagcgcatcgtcgagcacgttgacttctacgaggtcaaggccggcgagaagatcgacgtcgaggtgccggtgttcgtcgagggcaccccgaagggcgctgccgtcgcattcgtcgacattcaggagctcaaggttcgcgccgatgtcgccaacctgccggagaagatcgtggtcaacgttgacggcctgaccgacggttccaaggtcttcgccaaggacgtcgtgctgccggaaggcgttgtgctcgacgtcgaggatccggaagagtccgtcgtcaccgtcgaggtgccggaagacgctgccgatgaggctgctccggtcgaaaccgctccggctgaaaacgctgagtgagttcagatagcttaaggaagcaaacttccatcttacggttttgaacaaccgtaagagatgatgaaaaagcccatgtgctcagacgcacatgggctttttcatactcggcaacacccgttctatgagctggaagacataagagactgacggcgcatcctgcattccttacgcaatattgatacaacgggtggatacggacgtatactcgcctatacgttcagtgaacccgtatggcactgtcgggtacgaagggagcgattgcgtactgccggagacggactgcgtgacgatccgttttcccggcagccatcctgatgccgcacattaatggactatatcgagaatcatcatttgacggtggtaggcttcccacgtgagatcacactgatcgacaatgatctgacgcaggattccagcaaatacgtggcatgcatcagcattccaatcgaataacgactagcatgactgacgatgcatggaaacaatgcacgagagacgaagtgagacggtgcggaagagagaaacatttgaataagcatattattcggcttgatgtggtgacggtggtattccttggcggatgcgtcggcacgggactgcggtatgcgagctcgtccattgcggacgtgggcggcttccatgtcggtacgttcgcggccaatatggtggcctgcttcgtatatgcggcgctttccgcatggctgggatcttccagtctgttgaaaggccgtgcaaaagaatacgtgaatcgtggattcggcatgggcatgtgcggaggcctttccaccatgtccacgctcgcattggaagaattcatgatgattgacgatcatgcgattcccggagtcctcacctattgctgcgcaacgttcattgtcggtttttcgctcgcctacgccggtgccttatgcggttcgtggttggcggaacgaaacaaagacgaacatgctgacaaggaggcgattcgatgagcgcaatgcttgcgatcggcgtatgcgcatgcggtggcgtcggcgcggccgcacgctatatctgcgattcgtatatcaaggcattgtggcgcaaaacgttcccgctttcgacgtttgccatcaatgttgtggccggtctgcttgccggcttggtggcgggattgttcgcggcgaacaccataagccccgactgccgcctactgctcgcaacaggatttctcggcggtttctcaacgttctcaaccatgatgaacgagacggttacgctcctgcgcaatgggaaaatcgcttgtttcatcggttatgctctggcttcgatcgtcgtgcccgtcatggccgttgcgtgcggttactggctggcctgagccaacgtaaacgtgattccaaaatcacgtccgaatgcagagactggcttcagtccgcgcgtagcatgcaaccacgctcggggctatgggaatcacgtataccgatgaaaagaagttcaccaaagaacggacgcagcaactgttccgatccgtcggatgggtgtcaggcaaatatccggaacgtctgtacaaggctctgatgggatcgtccaccgtgttcagcgcatgggacggcgaccgcttggtaggcttggtgcgcgtgctcgatgacactgagatggtggcttatatgcattacgtgctggtcgatccggaatatcagggtcatggcatcgcaggccacctggtgggcatggtcaaagagagatatcgcgactacctttatattgaagtcatgcaggaagaaagcaagaacgccaccttctaccagaagcacggcttctcaatcatggaagacggcgcggccatgcagatccgcaatccaggagaacgccgctgaaacaagcatcgtgacgccaacaatcttattgccccgtctaatgacgggggtattgctttttcgagtatccaccaatacatcggagggttggcttgcatgcttcacccgaaaggatcgcagcatgaccggaagcgacgaacggaacacgcagaacgcgacgagcgttgggaaggctgcgtttccagcgccttccgccatgaagtctcctcaccccaataggcgacagcggcatgttgtactacgacgtcgaaactactcgccccatcattctcacccacatcccgctgtcagagacctgaacgtcataatggtgttttggggaatgaggcacagtcattttttgaacaattcagaatacgttccgagtctatagagcatcaatcaggcgtgagggcggcgactttttcgcaggatgtttcttcctatctcatatcgcgaacgcttgtaatcgaaagagattatgatgtgggaaagttactaaccagaaccggtgccacaagcactgggataccaacaaccgcgggccgctttcgggtggctgcaacaagaagaagtaaagaatgactgaacagaatcatcacgatccggcagagcttgacaagctcaccgagaagttcaccgtgctcccgaacgacaacccggcatccgacgccaaacgtgccgaactcatcgacaagccggcattcggtcaggtcttctccgacaacatggcccacatgacttggaccaagggcgaaggctggggagaccgccgcatcgagccgtatgcgccgctgaagatggatccgggcgcatccgttctgcactatgctcaggaatgcttcgaaggtctgaaggcctaccgtcatgccgatggctccacctggctgttccgtccggatgcgaacgccgagcgtttccagaactccgccaagcgtctgtacctgccggaactgccgatcgacgatttcatcggttccgtggccgccctcgtcaagcgtgacgtgaactgggttccgacccgccgcgagtacaccctgtacatgcgtccgttcatgttcgcttccgagccgttcctcggcgtgcgtgctccgcaggaagtggactactgcgtgatcgcatccccgtccggcccgtacttcccaggcggcgtgaagccggtcagcatctgggttgaagacaagtggttccgcaccggccctggcggcaccggcttcgccaagtgcggtggcaactacgccgcatccctgctgggcgaatacaccggcatcgaccacggctgcgagcaggtctgcttcgtcgacgccgctaccaagacctacctcgaggagcttggcggcatgaacatgatggtcgtgcacaaggacggccacgtagagaccccgtctctgaccggcaacattctgccgggcgtgacccgtcgctccctgattcagctcatccaggacaacggccacgacgtggtcgaaaccatgatcgctctggaccagttgctcgaagacatcaagtccggcgaagtcaccgaggtgttcgcttgcggtaccgcagccatcatcaccccgatcggtcgtttcaagtccgagaagttcgacgtgaccgttgccgacggcaactccggcgaattcaccgtgaacctgcgcaaccagctgctgggcatccagcttggcgagatcgaggatccgcacaactggatgtggaaggtctgctgatttttcgcgactgacttatagttcaaagtccgccgaggggcggggaacatggtattcgacatactcaaggccgttcggccaagcctacggtcgaacaccatgtttcccgcccctcggcttattgtgtacgatgggaagtcgcgaaatccgagagtgagggaagtgagggaagggaaaaggatgggaaagcatgtcggtggcgttggagagtaatgccttcttttgggggattgaatatttggcgacgttctgctgcggcatgtgcggcggacttgccgccgtgcgcaaaggctacgatatcttcgcgattctcgtcaccacatggctcaccgcattgggcggaggaatcatccgtgacgtgctgctgggcatcgcgccaccggtaggcgtgtcggataaaggactggtgatcgttgctctgctggcttcggtggccgtcgcggtgtgccatcccgaaatcaacaggctcaaatggtccatgctgtcgttggatgctctggcattgggattgtatgcggtcaacggtaccagcaaagccatgatgtaccacacgtcaggcatgaccgcggtttttctcggcatgttcaccgcgcttggaggtggcctgattcgagacatgctcatcaacgaagtgccgatggtgattcgtgacaaacattggtatgcggttccatctgccgtggggtgcgtactgacggtgcttgtctgcaaaggcgtggacgctggaatcgtcagttttccagccgaagtggtgcttgatctgctgatcgtcgcattgatggtcagcatgcgattggtatcggtgattttcgacattcagcttccgggagcgttggtgcgtcataatacatatctgccaagtgaagcgaaatatttgaaacgaccggtcattcattctgataaggattccgacaaacgcaagtgtgacaagcgtaggtagcgacagtgagatggtaattaaacggaagacatttgcgtaacaaaaaatcccgcaggaaaaacctgcgggattttcgttagctgtgagcttctaaaactcagagagcgttgatggccacggcaagaccggacttgcggttagcagcctggttcttgtgaatcacgccagcgccagcagccttgtcgagcttctgagctgcgaccttgtaggcggcttctgctgcggacttatcgccggcggcgatagcttcacgggtggcgcgaacggcagtcttcaggctggacttcacggccacgttgcgcttgtgggccttctcgttggtgagaacgcgcttcttctgcgacttaatgtttgccactatttctccaaacgacgttttctataaggacatacaaacgatgatgataacatggcgcgcggataaattgccaacgggcttaggagtgtcgcgactcaccatgccgatactagcagttagaatcgtttgcgtcgaatatttcaagaggaggatggcgtgggccagcagcataaccagcccggtttcaccgatcagtcgttgattcgcaatttctgcatcatcgcgcatatcgatcacggcaagtccacggtggcagaccgtattctgcagctcagcggcatcgtgcccgaacgtgagatgcgtgatcgtttcctggatcgtatggatattgagcaggagcgtggcatcaccatcaaatcgcaggctgtgcgcgtgccgtggacgttcgacggcactgaatataccctcggcatgatcgacactccaggccacgtcgatttcacttatgaggtttcccgcgctctcgccgcatgcgaaggcgcagtgctgcttgtcgacgcgacgcagggcatcgaagcgcagaccctgtcgaacctgtatatggccatcgaccatgatctggccatcattcctgtactgaacaaaatcgatcttcccagcgcggaaccagacaagcatgccgaggaaatcgcaggtctgattggttgcgatccttccgaagtgctgcgcgtgtccggtaaaaccggtgaaggcgtgaccgaactgctcgaccgcattgttgccgacgttcctgcaccaaccggcgatccggaagctcccgcgcgtgcgctgatcttcgactccgtctacgactcctaccgcggcatcgtcacctacattcgtatggtcgatggcgagttgcgttcccgtgagaaactgcacatgatgggtatcggcatgacccatgatccgattgaaatcggcgtgatcagcccagacatgatgcctacgaaggcgcttggtgcgggtgaggtcggttatgttatcaccggcgcgaaagacgtcagccagtccaaggtgggcgacaccatcacttccgcgctcaagcctgcggccgatccgctcgaaggctatcgtgacccgcagcccatggtctacgctggcctgttcccaatcgacaacgcgcagtatccggaacttcgtgaggcgctcgacaagctcaagctcaacgacgcggctttgatctacgagccggaaacgtccgtggcgttgggtttcggtttccgctgcggcttccttggcctgctgcatatggaaatcgtgaccgaacgactgagccgcgaattcgatctcgacttgatctccaccgcaccgaacgtgccatacgaggtcaccgcggaagacaattccgtgcatcgtgtgaccaatccgagcgaattccccgacggcaagatcaagcagatcgtcgaaccggtggttgccgccgacatcatcactccgaaggaattcatcggcgcggttatggacttgtgccaggaccatcgtggacagatgggcactatggaatatatttccgccgaccgtgtggaaatgcattatcgcattccgttggccgaaatcgtgttcgacttcttcgaccagttgaagagccgcaccaagggctatgcgtcgctcgactaccatgaggacggcgaacagtccgccgatctggtgaaggtcgatattctcatccagggtgagaaggtcgatgcgttcagcgccatcgtgcataaggataaggcgtattcctacggcgtgatgatgacgaagaagttgcgtgagctcattcctcgccagcagttcgaaattccgattcaggccgccatcggctcccgcattatcgcacgtgagaacattcgcgcactgcgcaaggacgtgctcgccaagtgttatggcggcgatatttcccgtaagcgcaagctgctcgaaaagcagaaggccggcaagaagcgtatgaagatgctcggccatgtcgaggtgccgcaggaggcgttcatcgccgcattgtcgaccggagacgcaggcaacgaccgcgacaccaaagacaagattcgcgccgcccagaaaaccgaaggctgatgttcgaagcctacattcatgtgccgttctgcatacggcgctgtgggtactgtgatttcaacacgtataccgctgtcgacatgggagcgggcgcttcgcgtggcaattacgccaatatggtgattcgcgagatgtcaatcgtccatgattggcagatcgcgcatggcgttaacgaaccggaagcggccaccgtctttttcggcggtggcactcccacgattctgaaagcctcggatctggtcgccatgttgaatgccgtgcgtgacacgtggggcattgccgacaatgcggaaatcaccaccgaagcgaatccggacacggtgaacgccgattacgtgaaggaactcgcggacggcggattcaaccgcatctctttcggcatgcagtcggctgtgccaagcgtgctgaaaacattggatcgtacgcataccccggccaatgtggcggcgggaatcgcagcggcaaatgctgccggcatgcgttccagcgtggatttgatttacggtgcgccgggggagagtctcgacgattggcgtgtttccgtacggacggcgatcgacttgggtgttgaccatatttcggcatatgcgttgaccgtcgcaccgaacacgaaaatgggacgtcagattgctgttggaaccttgcctacgcctgatgatgacgatgaggcgaccaagtatgagattgccgacgatctactgagcgcagccggtcttgaatggtatgagatcagcaattgggcacgtcctggttatgaatcgcaacataatcttggctattggcgcaatgttgattgggcggggctcggtcccggcgcacacagccattacggcaatgtgatggatgttgaacagtccacgtcggctgaaacatctgaaacggtcaaatcgtcgggcttgcgcagctgggatattgcgcatcctcgcatgtgggggcaggctatcaacgatgataatgtgccatggtcgggaagcgaacgaatctccaacgaggagaacctcgaagaaatcatcatgcttggtctgcgcatacgtgagggtctggatttgagtcgccttggaaacatggttgatatggctcgcatccagcccatggaagacgaaggccttatcgttatccgtgacggacgtgtgattccaacccgaaccggacgcttgctcaacgacaccgtcatcgagcgtttcttcgacgcctgctcgttgtaatgccgataatcctctgacgaattggttttagatgatccatcttggtatgggtggatacagtgtgcagattgaaacgggcctcggatgcaggttgttgcattccaggcccgatggcatagagcctagaacgaggctgtcaccggatgttcgtaatcagcgcatcgtgagtccgccatcgacatgcaacgtctgaccggtgacgaaacgagcgtcctcgccaaccagcatcgccacaccgcccgcaatatcatcagccgtggcaagcctgcccaaaggcgtctgcgcgatgatgcgctcgcggacgtcttcggtggtggcgcggctcgaatccgtgcccacggtcaaaccggccgcgatggcgttcaccgtgacgccccacgctccggcctcctgcgccagcgagcgcgtgaatccgatgagtgctcctttggctgcgatgtagtcgtggtaggggacgatcgggctgtctacgaggttgctggagatgttgacgatgcgtccccatgattggcgtcgcatgtagggcagcgcggtcgtgcaggtgttgtaggtgcctttgagacatccttcgagttgggtcgcgtagtcgttccagctggtgttgctgaaggtgttgcggttgcgtgggtcgaacgagtagtggctgagcgcgttgttgatgaggatgtcgatgcctccgaaggtgttggctgtggtttgtgcgagttcgttgacttgggtttcgtcggtcacgtcggctttgcatgtgatgacgcgtccttgtgcgtccgcttcgttttcgatgtgttgcttggtgtgttgggcgcgttcgtcgttgcttaggtagtcgatggtcacgttggcgccgagttgtgcgagtctgagtgcgattgcggcgccgatgcctcggcttgcgccggtgatgatggcggttttgccggtgagtgtccggtgttcggattgctggttcacgtaaggtcctttgggattattcgtagtcgatgtcgaaggtgtcggcgtaacggtcggtgttgcgttcgatgtcgacggctctgacgaggtcgaggatgttgaatccgccgtcgtggtgccatccggatttcgcgcggttcatttctccgacggggcagatgcggtcgatgccgtattcgcccacttgttgcgcgagtgcgaacagtctggatgagcttgtggcgatcgcgcaggtttgcagccactcgcggtagggtttcagtgtgggcagcgcgtgtttgagttggtccacggcgacgatgttaatggtgcggttgagcggtgtccccaacgaggggagactgctggtattggggtagtagagcacggtccagtcggtgccttgcggcgattcgatgacgaacggtgcctgtgggtcggcctgtgcggcgctgtctggagtcatggacgtcatgaacagcgcttgcatctcggtttgagagcgtgccctgcggatggcgagggattccgtgtcggaaggggttgatcgtggatatttgcgttgttgcgagtcgagctcgctggcgagcagttccgccgtctgagcgggggagatggctccgccgcgttccacgaagatggtttgcggcgccaggcagctttgctggtcgtaggtggccacgtccacggccatacggtgcacggtttgcacgtgagtgtccgcgcgtagcgcttcacgtccgatgagtgagaagccgatgcgtgcgccatagctgaggaacggtttgcccgcgctcacgcgtggacggatcgcctcggtggtgtgcgacgaaccgtaggcgatcacggcgttcgcttcgccgatcgccacgtcttcaagctctaccgtgccgccgcgccacggcactatggccaatacgtcggcgagatccgggttgatctgtgtcagagaacgagcgaacagtacgggcatcagcggttcgtcgaacgatgatttgccgatgatcgcgcttttcgtcagcagactcatggtcatgctccatacgggaatgccgggaacattgctggaaaacacgtggaatgtcaagtccggcccgtacaggcgcgtgtatccgccggacttgttcggtcggtattcgtccagcatgcgcgggcttggcagttcgtcatcaagaaaacgcaatagttcgcgtctgcggaacatgcgcatgtaacgtttcagttcgatacgcgtcatcgtcgcgtcatagccggtgatggagggaatcagagactccgctatctggcgaccctcataatcgggattcgtccacaattccaccgcctcgccgatgatgtcgacgatgtgttcgacggaatatgctgccaatgtctgcgatcgattgcaacgcgttgtctcgcacaaatcttggacagtctcaggcgtgagtaccggataacgcaacgtgacctcaccgcggtcggtgagaacgccgcgtgtttcgaaatcctcaaatacgaagccgcgcggcgcatggaaaatgtcgatgacgctcatgcgtttgccgccatcacctcgtcgacggcgatggagcagccgcgtgcctccgcacccttcgcacgaccgttgagctcgtaaccggaatcggtgcgcacgccaagatcttcggtcagaatcgccagacaggaattccaattcgccaaatcgtaatgcgcgatcaccccctgctcgccatcggcgacaggcgtgagcgtcgccggatcgaggaacacggaacgaacccacgacggcgtcgccttcagataattcgacgaaccatccgtatagtacgacagcagattctgatcgtaaatctgcgaactcaactccgtcataccgtacatgttcacgcaatgcgtgcgtgcgacgccaaacacctcaaggaacttcgcatacaaatcatcgacggtcatatcggttttcgtactcttgaaaccaccggtatcgaaaacacgcgaatccttcgccaacgcataggttttgccccgctcggcaagatagtcaagcagatacagatacgcggacgaagcgcccatcagcatcaccggctcgccgtctgccaccgactgatcaaggaacttttccacaccagcgaagtccaaaccatcctcatggaagaagaagccgctgccctcgctgccgcactgctccaccgcacgcgtcagataacgggccaacgaaccattatgattcatctcccaggcaggggagagcaccgcgatacgcatgcgctcacggtcaggcatgatgaaatgacggaacgggccgatcatcgacgcatcccacacctcaagatcaggatgatagttgcgtccacgctgacccggatgcgtagtgccgctggtcatgaacactgcctcgcaatcatcttcaggcaccgaagtgagcgtcagcatcttgaacccatccaccggcatcggcggaatatccatccaatccgacaacatctgcggagtcaccctacgagacatgcaatacgcgcgatactgcatgttatgggcaaactggaaagcgaaaatcttatgtgcgagcgcgtcgaacgcctcatccggagcgacctcgcaaccatacttttcgatgaactcaagcacgtttgccttgacttcctgcgcgtcggcacccaacgacattgatgtcatatgcggtattcctttctataaacgatactgatattcgaaagcaaatcagatctgcgacggaacttcagcttcgctgtttcctttacgacgattgatcagattcggcaggtcgatcagcagtgccttgagaatcaccacacagaacgccccaaccagaatcgaattggagaagaacacgtgagcgccgccctccaagccgctcaacgcgctcggcagcgcgatgcccaacagcagggacaatccaatgaccgcctgggaacggtcgttcgactccaccttgcgcagcgtattgaagcccgtgctgatcaggcttgccgcggccggcaggaaaatgccgccgatcacaggggaaggaatcaacgacaataccgctccggccttcggaatgaaaccaagaaccacaaataccacgccggcgatgatcaccggcacacgggtacgggtcttgccctcatccgtgaccttaagcaacgcgacattctgcggatacgcggtagtggtgaaaccgccgatcatcgaagaaatcgcggaaccggcagcctcgccggccaaaccataacgaacctgacgatcctcaagcttgacgccctggatctcactggccgcctgatacacgccaagcgcctccataatcgcaaccatatatgcgatgaagaacggcacaaacaccgccgcatcaaagtcaaaaccgccatacggcataatctgaggaagaccaaaccaaggcttcgacgcgacaccggaaaaatcagccatgccaaataccatcgaaagcgcagtgccggcaaccagagcaatcagataggaaagcgccctgaccatacccttgccgaactgggaaagcgccaccaccagcacgcaagtcacgatagacacggccaacgtcttcggatcggcaaaaccatcatcgccgggagcgccaccaagaaactcgctcaacgtgaaactcgacagcgaaacgccaaccagaaaaataatcacgcccgacaccatcggcgcgaacagaaaacgcatcttctcaatcacacgggtcagacacagcaccaagaaaatcagcgaactgacaaaaatcgacgtaccagcggcagccaacgaaccagcagtgcccgcagcgatcatcaacgcatcgaacgcggcggacggaccctgcacaatcggcaaacgcaccaacctcgtggcctgaatcaatgtgaccaaaccagacacaatgaaaatggcattcaccatatttgacgacaacgccaacggcaagccaatggcaccagccacaaacaccggatcaagccacacattggacaccaacacatgctgcaaacccagcagcacattcttcggagtcaacttcttcgaacccgaaccaagctgctcaggcacctgcgacgcatcagacacgccaaatcccttctctttccacgaaacacacggccaaacaccagccgtcagcacagagaagacgcgcacgcgcaccgttcgtaacatccctacgcaggcactaccctgttcaggtcataagggtccgggcaaacgcccatctcagccacatcggctcccctgtactcttcggacaaccaccagcataacgacacgcatcgataccggcaaccaccacaacccaacacatatcctccacattttcccaagaaaaacagtcttgacttttccgagtattcgttatatggacacgcgaaacgtatttgatacaggggcgcggtattctaaaccacgcattaaagaaccgcaagacttttcttgcccaaaaacattgaaggtggtttcggtgactttccacgccccgttagatctcacgatccatgattcccaaggtatgtacgatcccggcgccgagcacgacgcctgcggcgtgggtatggtcaccaccctcaacaagcgccccgaacgcaaaatcgtcgacgacgccatcgaagtgctcgtcaacctcaaccaccgcggagccgtaggcgccgaagaaaacaccggcgacggcgcaggcatcctcatgagcatgcccgacgaattcatgcgcgccaccgcaggcgtcgaactgcccgaagaaggccactacgccgccggcatcgcattcctcgaccgcgacatcgccacctccggacaacaagaacaagccatcgccaaaatcgtgcgcgaagaaggcctcgaagtactcgcatggcgcgtcgtacccaccaacccggacggactcggactgcaggcgctcgccagcatgcccgcgttcaagacgctggtcgtggccgaccccgaaggccagctcgcaggcatcgaactggaccgcaagaccttccgcatccgcaagcgcgtcgaacacgaggtgggcatctacttcgcgtccctgtccgcacgcaccatcacctacaagggcatgctcaccaccatgcagctcaagcccttcttcctggatctttccgacgagcgcatgaaggcgaagatcgccatcgtgcactcccgcttctccaccaacacgttcccgagctggccgctggcccagccgttccgccagctggcccataacggcgagatcaacaccatccagggcaaccgcaactggctgtccgcacgtgaaggccgcctaagctccgaactgctcggcgaattcaagccgctgctgccgatcgctaccccgggctactccgattccggcacgttcgacgaatgcctcgaactgctgcacctgtccggacgttccatgccacatgccatctccatgatgctgccgccggcatgggagaagaacgaccagcttgaccccgatgtcagggcgttctacgaatacaacaatacgctgatcgaaccgtgggacggtccggcgcacatcatcttcactgacggcacccaggtcggcgcgctgctcgaccgcaacggcttccgccccggccgctggcagcttaccgacgacggctacatcgtgctcgcatccgaaaccggcgtgctcccggagaacgccgaggaacacatcgtgtccaagggccgcctggaaccgggcaagatgttcctcgtcgataccaaggaaggccgcatcatcccggacgaggagatcaagaagtccctcgcgtcccagcatccgtaccgtcagtgggtcgaaggcaacaccgtcgagatgagccagctgcccaagcgcgagcacgtcaaccactccggccagtccgtgcaacgccgccagcgcgccttcggctacaccgaagaggatctgaagctgctgctcgccccgatggccaacaccggcaaggagccgctcggatccatgggcaatgacgcgcctatggccgcgctttcctcccgcagccgcatgctgttcgactacttcacccagaagttcgcgcaggtcaccaatccgccgctcgactgggagcgtgaaaagatcgtgacctgccttgaatccgccatcggtcccgagccgaacctgctggccgattccgaactgcatgccaagaagatcctcattccgttgccggtgctcaactccgacgagatggcgcagctcaagcgcctcgaccgcgccaagatcctcggcggctactataagccgttcgtcgtcaagggtctttatcaggtcgctggcggcggcaaggcgctgaaggaacgtctcgacgagatcttccaggaagtcgacgaagccatcgaaaacggatccaacttcctcgtgctctccgatcgcgactccaactacacgtggggaccgattccgtcgctgctgctcacctccgcggtgcagcaccatctgctgcgcagacacacgcgcacccagatctccatggtcgtcgaggccggcgatgtgcgtgaaatccaccatgtcgctctgctgatcgcctatggcgcggcggccgtcaacccgtatctggcgttcgaatctgtcgaagacctgtcccgcaagggctatctcaacgtcgatgccgaaaccgcggtgaagaacctgaccaacgcgttgtcgaccggcgtgctcaagatcatggcgaaaatgggcgtctccaccatcatgagctaccgtggcgcacagctgttcgaagccatcggcctgaacaaggacgtcatcgacgaatacttcaccggcaccacctcccgcgtcggaggcgtcggactcgacgaactggccgaagaggtcgccatccgccatcgcgtggcctacccgtcgcagtggaccgcccgcccgcaccgcaacctgcgcaccggcggcgaatacaagtggcgtcgtaccggcgaagaccacctcaacgaccctgaagccatcttcctgctgcagcagtccacccagcgcggtgactacgacatgttcaagaagtactcggcgcacatcaacgacacctccaaccgtttgatgacgctgcgcggcctgatgaagttcaagtccggtcgcaagccgatcgacatcagcgaggtcgaaccggccagcgagatcgtcaagcgtttctccaccggcgccatgagctatggctccatctcccaggaggcgcacgagaccctcgcgatcgccatgaacaccatcggcgcacgttccaactccggtgaaggcggcgaatccgaagaccgcatcaatgatccgctgcgctacagcaagatcaagcagatcgcatcggcacgtttcggcgtgaccagcgactacttggtgcacgccaccgacctgcagatcaagctcgcccaaggcgccaagcctggcgaaggcggacatcttcctggcgccaaggttccgccgtggatcgccaaggtgcgtcacgcgactccgggcgtcgagctcatctccccgccgccgcaccatgacatctactccatcgaggatctgaagcagctgatcaacgacgcgaagatggccaatccgaaggcccgcgtgcacgtcaagctcgtttccgagttcggtgtgggcaccatcgccgcaggcgttgccaagtgccatgccgacgtggtgctgatctccggttacgacggcggcactggcgcggctccgctcaacgccatcaagcacgccggcaccccgtgggagatcggcctgtccgaaacccagcagacgctcgtgctcaacggcctgcgttcccgcatcaccgtgcaatgtgacggcgagctcaagacgggccgcgacgtggtgatcgcagccctgctcggcgccgaggaattcggtttcgccaccgccgcgctgatcgtcgaaggctgcgtcatgatgcgcgcctgccagaagaacacctgcccgcagggcatcgcaacccaggatcccgaactgcgcgcacgcttcaagggcaagccggaacatgtcatcaacttcttcatgttcatcgccgaggaagtacgcgagctgctcgcccagctcggcttccgcaccttggaagaggccgtcggccatgtcgaatgcctcgaccagaacgaagcgatcaagcgttggaagtctgacggcatcgacctgagcaacgtgctcatgcagccgggaccggtgccgggaaccatcctgcaccagaccatcgagcagaaccacgagctcgacaaggcgctcgacaacaagctcatcgagctcgcgcagcccgcccttgagaagaaggagccggtgcgcatcgagatgccgatccgtaacgtgtaccgtacgctcggcaccatggtcggctacgagatcaccaagcgttacggcgaggaaggcctgcctgacgacaccatcgacatgacgttccatggtgcgggcggccagtccatcggcgcgttcattccgcgtggcgagaccatccgcgtgtacggcgaagtcaacgactacgcgggcaagggactttccggcggacgcatggtcgtgcgtccggaggcgggcatcaccttcgatccgcatgagaacgtgatcgcgggcaacgtcaccggcttcggtgccacttccggccagatgttcgtggcaggtcgtgcaggcgaacgcttcggcgtgcgcaacggcggcgccaccttcgtggtggagggcgtcggcgaccatggttgcgaatacatgaccggcggcaccgtcgtgatcctcggtcccacgggtcgcaacctcggcgcaggcttctccggtggccacgtgtacgtgctcgaccttgacatgaagcaggtcaacccggctgccgccgccaacggcgcgttgctgttcgaaccgctcgacagtgagtcgaacgaaatcgtgcacggtctggtcaagcagcatgccgaagaaacaggctccgcattcgcggccggactgctcgccgactgggagaacgcatccaagcgattcacacacatcgttccgaagcacttcctcgccatgcagaaggcgatgaagaacgccgaagagaacaacatcgatttcaatacgcccggcgtctgggaacaggtgtacgagcaggttatggaaggagcgcgctgacatgggagatccacgtggattcctgaaggtccgtacccgtcgcgaactggccgaacgccccgtcgaggagcgaatcaaggattggttcgacgtccacgccgaatccggcctgcagccttggaccaccgaacaggcggcccgatgcatggactgcggcacgccgttctgcatgagcggctgcccgctgggtaacatcatcccagaattcaacgatctggtgcgccaggagaagtgggaggacgcgtacaaccgcctgtccgaaacgaacaacttccccgaagtcacaggccgcatctgccccgcgttgtgcgaggcagcctgcgtgctcggcattcaccagccgccgaccatgatcaagaacgacgaatgcacgatcatcgatcaggcttgggaactcgactacgtcaagccattgcctccgcagcgcctgaccgaccagaccgtcgccgtggtcggctccggcccgtccggtctggcatgcgcccagcagcttacccgcgcaggccacaccgtggtcgtatacgagcgtgatgacgccatcggcggcctgatgcgctacggtatcccgaacttcaaactcgacaagcgactcatcgaccgccgcgtggaacagatggaagccgaaggcaccgtgttccgcaccggcgtggagatcggcaaagacatctcatgggacgatctgcgatcccgctacgatgccgtggtcgtcgccatcggctccaccgtgccgcgcgacatgaagattccgggccgtgaactcaagggcatccactttgccatggaattcctgcccgacgcgacccgccgcgtctacggcgtcaagccagtcaacgacatcaccgctgaaggcaagcacgtcgtgatcatcggtggcggcgacaccggatctgactgcctgggcacgtccatccgccaaggcgccaaggacgtcactgtgctgcagatcatgccgcaggaaccaagcgaacgcccggccaaccagccatggccgaccttcgcgcgcctgtaccagaagacctcctccatggaagaaggcttcgaaacccagcgcgccgagtacgtgtacagcacggattctgtgaacttcgtcggtaccgaagaggaacaggccaaggtgaaggtggagcactccaccgctactgaaggcttcgtggccgatgagaacggacatgtgaccggtctcaaggtagtgaacgttgcacccggcgaaaacggaccgttcacccgtcagcccggcaccgaacgcgtgattccggctgatttggtgctcatctccgtcggcttcctgcacccggacaccaccacgctcgtggaccagctgcccgtcgaccttgacggacgaggcaatgtggcgcgcaacgacaagttcgctaccagccaggacggcgtgttcgcctgtggtgacgccggacgcggtcagagcctcgtggtgtgggccatctccgaaggccgttcctgcgcggccgccgtggacgaatacctcaccggcgccaccgaactgccggcacccatcgtcgcatccaaaaggccgatgatgctgccgcgctgaacataagcagttaacgtaacagaaaaatcgtccgattctccgccaaaacggaatcggacgatttttcatatccccacttcccggaacctcgaacaatacagacgtggcataaacgtccgaatgacgtgccgttcggcgaaaaaccggcagtcatgcagtaaagtgaactgcagcacatcgcaacaaaggagtgacccaatgccaaatcgtgcagaacgtcgagcgcaggcaaagaacaaccgcaggggagtgccgcagcagtacgaccaaacccatggccgcgcacgttccggaatgctggacgaataccagctgcaggaaaagtcccgccgactgcaagacggtaccgatggaccttggaagccgaccggcggcaccatcgaagaaaccgaaagcctgctgaccaccagcccgaactacacgaacccgaagatgttcaaggcaccgcattccgcacgccaatggttccgcgtgatcagctggctgctcatcgcactgtccgcaatcgcattcctggtgatcatgtggctgccgtcacatcccatgtggttggtcgccacggtctccatcgtcttcgctgtcggtgtgcttagcctgttcttcacggcgggtaacccgaagcataatccgaacctcgatcagaatggtacggccgtctgatagcaaggcgatgaacgtaaagcggggctgcatccgatggaaggatgcagccccgctttcacatgcgagtcacgaatgacggcactattcgttcctggtttattgacctccttgcctgcatttttaggaaagatgcaaaactttgtgacacgaatgaaacaatcaggcgtttcattgaaaaattgccttacagtagtgatggaacaactgcctgactcgaagaggagagcacagatatgaaggttgacatcctttcccgtgaatatccgcccaaggtgtatggcggcgcaggcgtgcacgcggaggagctttccaaagttctggcggaacgcgtggatgtgacggtccgtgcgtttgacggaccacgtgccgagaatgagattcccgaaatcccgggtgacaatccgaaaggttcgctcaaggtcgtcggatacgacgttcccaaggaactccaggaagcaaacggcgcgctgaagacgttcggcgtcgatctgcagatcgccgacgatgtggacgccgacatcatccacgcgcacacgtggtatgcatgcttggccggataccttgccaagatgctgcacggaacgccgctggtcatcaccgcgcattccctcgaaccgttccgcccatggaagcgtgaacagctgggtggcggctacgatttgagctcgtgggccgagcgtgacgcatacgagcatgccgaccgcgtgatcgccgtgtccgcaggaatgcgcgaagacatcctgagcgcctatccgaatcttgaccccgacaaggtggtcgtggtgcacaacggtatcaccatgagccagttcgaaaccccatccgacgacgatccgggctggaaggtgttcgaacgctacaatatcgaccgcaacaagcccacgctgctgttcgtcggacgtatcacccggcagaagggcctgccatacctgcttcaggcgttgcatttcgtcgatccgggcatccagatcgtgctatgcgcgggcgcgcccgacactccggagatcatgaacgaggtcaaaaccgcgttcgccaagcttgacgaggagcgcggcaacatcatctggattgaggagatgctgccgaagccggagctcaacgcgcttgagcacggttgcgacgcgttcatctgcccatccatctacgagccactcggtatcgtgaacttggaggccatggcgtgtggccttccggtggtggcctccgcgaccggcggcattcccgaagtcgtcgtcgatggcgaaaccggatatctcgtgcctgtcgaccagctgcacgacggcaccggcactccgaccaatccagacaagttcgtgcatgacatggccgacgctatcaaccgcatcatggccgatcctgaaaaggcgaagcagatgggacaggccggttacgagcgtgcgcgcgaccacttcagctgggagtcgatcgccgacaagaccgtcaaggtctatgaagacgtgcttgccgagcagggcaaaaccgccgaataaccagttcaccacgtagacgatgcgtggaacgccttccgctgaaagcattatgctggcggaaggcgtttccatatctacaagccgaacaacgataggggaggaagaatgccggagcagaacatcgcactggaactcgctgacgtggaatttcgtcgccgtggacgcgtgattctcaccaaggtcaatctgaaaatcaacaagggcgagaaatgggtgctgttcggacccaacggcatcggcaaatccagcttggttcaaatgatgagcaccagaggattcccgtcggaaggcaccgtcgacattctcggcaatcgcttgggcaaggtcgatgtgttctcctatcgcaaccgtatcggtttgagctccgcggaactgagtcgcgcgttccctccccaagaagatccgctcgacgccatcgtgaccgcattgaccgcgaccaccggccgttggcgcgacacctacaccgacgaagactatgccaaggcgcgttccctgatgcgtgaattcggtatcgaatatctcgaaggtaaaatgatgttcaaactttcggaaggcgagcgtacgcgcgtgctgatctgccgtgcgttgatggctgatccggatctgctgattttggacgagccgactaccggtcttgatttgggcggtcgtgagattgcgcttcgtgcgttgagccgtgtcggcgccgagcagtcggatcgtgccgtggtgctggtgacgcatcgtcttgaggagattccgcagggattcgaccatgtggcgatcatgggcaggatcaccggcagcgaggccgacgcctacgccgacaatgtcgcaggcaacgatccggctccgggcaccatcgtgtactcgggtgatctggaacacggtttcacttcggaacggttgagcgaagtgttcggtttggagcttgaggtgacgcatgcgaatggacgttggagcgcgtacgcgcggtaacgggtgctgtgtgcgccggaatatgctgtagcatgaatagcgtcggacaggagtcattcggttccgtgctgtcgtgatggtggaatccgtgtgggtatgaaggagtgattgatgcgtcgaggaccgttgacggcgggtgagaaggtacagttcacggatcgcagatccaataagatcaccgaccaattggtgccgggcggtgtgacgcagacctcgcacggcatcattctgcatgacgatgtgatcgggcagtcggaagggtccgtggtggtgacggtgagcgccaaacgtgaggcgcagatcaatcaggatcatccggaacgcgacgccaacaagccttggaagggaacgcgcgccattggcggatggcagttcgcggtgatgcgccctcggttggccgattatgtgctgtcgatgcctcgtggcgcgcagatcatgtatccgaaggacattgcccaagtgattcagcttggcgacattcgttccggcatgaacgtgttggaatccggtgccggatccggcgccatgagcgtcaacctgctggacgcggtgggggagcgtggaagactgaccaccatcgagatgcgttcggaattcgcccgcgtggccgaagcgaatgccacggtctatttcggtgggcgccccgcatggtgggatctgaaaatcggtgatttcgattcggtcgccgccacattgccggagcattccttcgaccgcatcatgcttgacatgcttgacccctggaaccgtcttgagcaggcataccgagtgattgcgcccggcggtgtgctcgtggcgtatgtgaccactactacgcagctaagccgtatggcggaggcgttgagggaggctggctgctggacggaaccggatatccaggagactctggaacgcgactggaaggttcagggattggcgatacgtcccgaccatcagatgatcggacacaccggcttccttatggtttcgcgggctatggcgccgggatttcaggcgttgcgcaagcgtgaccgtgccacgaaagacacgaccaccgatattgattcgctgagcgccgaagaacgtgccgaacagctcgaagatcttgagttgcgggatatttccgatcgcaagttgcgtaaggtgctgcgtgatctcgacgcgcaggtcgaggctatcggcgattgatacggtgtttcttgccgttgttctgagacaatagtcatagcgcgttgcgttggtacatacgctggatcgttaaggattggagcattcgtccatgggaacgagcctcaagaaggttgcgaaaaaagccaaggattacaagtatgtgttgctggtgatgcgtcacgccaaaaccgagccgtttggtgacggtggcgacgccgggcgtgagctgaccgacaaggggcgtaagcaggcgaaagccgtcgccaaaggcctggccgcgcacaagatggtgccgacgcgcattgcgtgctccagcgccaccagggccaggcagacctgcgatcgcatgcttaaggtgttcggcgacgacccgaaggtcgactatcgtcagagtctgtacgaaggtggggtgcagtcggtatttgacgagcttgcccagaccaaggagaagcatcgcgagctgttggtactcggccatgagcccactgtgtcgatcgcatgccaatggctggcgagctccgaatcggatgcaatgctgctcgacatgctgaatctgggcatgtcgccggcatcgctcgccgtgttcggatcaaatgagccattcaaccaatggcagctgcacagtggcgaactcatcgcattgctgacggccaaggattttgaatgattccttcgcctctcggcatgatgctgagaggcgtgaaatgttgccatgccaactgatataaatcgtgcttatagcgacacttaaattttcttgatgagttatagctggcgatttcgtggtagcttgagcgggttgcattgttcatatcagatggaggattcatgtccgttctcacttccgtctccggtttccctcgcatcggccagaaccgcgagctgaagaagattatcgaagcttattggaagggtgtcgcaacgctcgacgacgtgcgcgccaccgccaaggagctgcgcgccaagcattggaagctgcagcaggaagccggaatcgatttgattccgagcaacgacttcagctattacgaccaaatgctcgacactgccatcctgctgaacgtcattccgcagcgctaccagcgcctcgccttcgacaatcccgaagagacgctgttcgccatgggccgcggctaccaaggagacaagggcgacgtcaccgcgttgccgatgaagaagtggttcaccaccaactaccactatctggtgccggaagtcgacgaagccaccgacatcaagctcaacagcaccaagccgttcgacgaattcaacgaggcgaaggcgctcggcatcaccaccaagccggtgctcatcggcccgtacaccttcctcaagctcgcccgcaatccgcaggccgaagaactcgaatacgacaagggcctggtcaacgcggtcgccgccgtctacgccgaggtcgtggccaagttcgccgagctgggcgccgaatggatccagatcgacgaaccgtacctcgtgctcgacaaggagccgggcgacgtcgaactgttcaagagcctgtacaccaagatcctgcccgcacgcgacggcaagatcaaggtgctgctcaacacctacttcggccacatcgccgacgtgtatgagacagtcaacctgctcgccttcgacggcatcggactcgacctcaacgaaggcaaggacgagaatctcgccgccgttgaaaagttcggcgtcgcagagagcaccaccatcttcgccggtgtggtcaacggccgcaacatctggcgtaacgattacgccgtcagccttggactcgtcgacgcgctgaagaaggtcaccgacaacgtggccgtctccaccgcaagctccctgctgcatgtgccgttcagcaccgaaggtgaagacggtctcgccgatgatgtgcgcaagcatttcgccttcgccgttgaaaagctcggcgaactgcacgacctcgcggttctcgccgacgccagcgaggaagacaagaaggcatccggggcattggcagccaaccaggcgctcttcgacggtacccgcgtcgccgccgacaagaacgtggcggaacgtctcgcagccctgaccgactcggacttcgtgcgccagccggcacgtgccgaacgtcagaaggcacagcgggaggcgttgaacctgccattgctgccgaccaccaccatcggatccttcccgcaaaccaaggaagtgcgcgccgaacgcgccagactgcgcaagggcgaaatcaccaagactgaatacgacgaatacatgaaggcgcagatcgacgcctgcatcaagcatcaggagcagatcggccttgacgtgctcgtgcacggcgaattcgagcgtaacgatatggtcgaatacttcggccagaacctcaacggtttcctgttcaccaagaacgcttgggtgcagtcctacggcacccgttgtgtgaagcctccgatcgtatggggcgacgtgtcccgcgccaacccgatcaccgtggaatggagcgcctacgcacagtcccgtaccagccatgtgatgaagggcatgctcaccggcccggtcactattctcaactggtcctggccacgcgaggacatcacccacgagcagcagacccagcagctggccctcgccatccgcgacgaagtgctcgacctcgaagccgcaggcatcaaggtcatccagatcgacgaggccgccctgcgtgaaaagctgccgctcaggaagaccgactggcacaagaagtacctcgactgggccattccggcattccgactggtgcactccgcggtcaagccgaccacgcagatccacacccacatgtgctactcggagttcaacgacatcatcaccgacatcgacgccatggacgccgacgtgatctccttcgaagcctcccgcggcgatctcgtggtgctcgacgccattcacgacgccaacttcgaaaccgaagctggcccgggcgtctacgatatccactcgccgcgcatcccgtccgaagccgaaatcgaggaacgcatctacgaaatcctcaagaagatggacgtcgaaaaggtgtggatcaaccccgactgcggtttgaagacccgcggcaacgccgaaacctggccaagcctcgaaaacctcgtggccgcagcccaggctgtgcgtgccaagctgaccaaataaggcgaaacgttaggaacaagacgacagccatgcattcgccaatgttctcgctcgaggtgttccctccgaagcgaacctcccctgtaggcaccatctacgacacgttggatggcctgcaggggttggaccccgatttcatttccgtcacctacggcaccggcaaatcatccgaccgtacattgaccgcgcgcatcgcccacacggtaagcgaatacggcatccccagcgtggcccatctgaccgcgcagtatctgaacaaggatgacgtcgaccaggcactcgacatgttcgaacaggccaaggtctccggcgtgctcgccttgcgtggcgaccgcatcgacggtgccgaaccggcaggagtattcgaacatgccagcgatctggccgtatacatccgccagcaacgtccggacatgaaaatctacggcgcctgctacccggaaaagcacccacagtcggcaacgctggaagaggacatcgacaatctcaaaaagaaagtcgatgccggcgtgacgcatctgatctcacaactgttctacgacaacgaggacttcctgagattcctcgacaaagcgagggctgcgggaatcgacgtgccgatcgaagcgggcatcatgccggtcatgaacgcgaaatcggtgctgaacatgtcgaacaaatgccagtcgaaagttcctgaaaaactcggcatcatgctcgataaatggggaggtgacaaggctctgctcaaagaagcgggcatcgcctacgcatccgagcagatctgcgaactggtggcgcggggcgtcgacggcgtgcacctgtacacgatgaaccatccatgtgtcagccgacgcatttggtccaacgtcaaaccattcttcgtctgatttcaggcgatgcaacaaacatcaagggtggttgcgggtatttcgcaaccgcccttggttttatcagcggttactatagaaaccatgacttccatgcaacacaagttcggggcgcttgatctgattcgagcagggctgcaagatctcgacagggctcgcacgttgttcgacgagctgcacaatgacggcatcgatgacgacaggatgcggctgctactagccacgctggaaaaagcgtgcgatcccgacatcgcactcagcaacctggtggacatcatcaaagtgatgcaaagtcaaggcaaggatttcaccaacatcatcgccgatgaaaactctttcgtgcgactgatcaccgtgctcggcgtatccgatgaaatgggcaagctcatgcgattccgcccggaacttgtggaggccgcagccaacgatgcctgcgaaagccacctttacaatcacgaacagcgcagagcgcatgtgctcaaatcggtaggagccgatcccaatgaccacaccatgccgaccgcaagcctgccacttgccgaagctgcgacggcgctacgtaaaacctatcgcaaacaactcgccgcaatcatggcgcaagacgccacggcgaacgatcccatcgaaatccaaccgcgcatcagcaccgaactttccgaccttgcggacgcggcgcttgaaggcgcgctcgccatcgcacgccatgaagtggacggcagcgaacatgtgcgtttcgccatcatcggcatgggcaaactgggcgcacaggagctcaactatgtatccgacgtggacctgatctacgtggtggaacccgccgacatggacaccaacggcatggcactcagccgaatcggcaccaaaatggccaccacgctgcaacgtgtatgccaatccgtcatcatgggcgtcgcagaaccgacactctggcagatcgacggtggactacgccccgaaggcaaggacggtccgctggtacgcagactcgaatcccacgaagcctattacgagcaatgggcggaaaactgggaattccaggccctgctcaaagcccgcccggtagccggcgacaccgacctcggacaagcgtatatggatatgacccgaccgttcgtttggacagcttccaagcgagacaacttcgtctatgactgccagcagatgcgcaaacgtgtcgaagaccttattcccaacccgctgaaagaccgcgaaatcaaactcggcaggggaggcttgcgcgacgtcgaattcaccgtgcagatgctccaactcgtgcacggccgctccgacgaagcattgcgtaccagctccacactcgaatccctgcaggccttggccgaaggcgggtacgtctcacgcaaacaagccaagaaactttcatgggactaccgattcgaacgtgtgatggaacaccgccagcaaatgtgggcgctcaaacgcacccacctgttcccagacctcggcaaagccaacgctggcggtcttgaacgcaaacgagacatcaccatcgacgagctgaaccaaaatcccgaactacgtcgactcgcgcgcgcatttcacatgcatcccgaagaactcgtcaacaaatacgatgagacacgtcgtgaggtgcgtcacctgcacatggacatctattaccggcccatgctgcccatcaacgcgggactcgacgacgaacaggtggaactctccacgaaagccacgcaggaacgattcgaatccatcggattcgccgatgccgacgcggccatgcggcacgtcaccgcgctcaccgcaggcatctcccgtgcggcaaaaatcaaccgcatcctgctccccgcagtactgcaatggctcggcgaagggcagaatcccgacatgggactgcttaactggcgcaaacttgaagaaaacttcggctccgaaagcggatacctcggattcctacgcgattcaccatccgcggcacaacgcctatgccacgtactatccaactcacgattcctcggcgacgcactcaacaaatccgtcgaatcagtcacatggctcggcaacgacgactctttgcaaccacgttcgcgagaaagcctcgacattcaaaccaaggcgacgcttgaacgcaatgccggcaacatcaacgatttcgccaactccatccgagccatgcgcagacacgaaatcgaacgcatcggtctcgcttggatgagtggcgtgatcgacgatgaagcatcgctcgccggcatgaccgacgtatacgacgcggccatcgaagcatcgctgcagtgggccatccagcatcgcatcaacgacatacagatcgacgaagctccggcggcgatcgccatcatcggcatgggacggtacggcggtagggaagtgaacttcagctctgatgctgacgtgatcatcatctacaggccggccgaaggtgccgatgacgaccaagccaaccttttcgcacgaaaagtgcaggaagacctacgtgcgatcctgcaaggtccaaccacattcgaaccaaaaatcgaacttgacatggatcttaggcctgaaggcaaaaacggaccgctcgtacgttcctacgcatcctgcgaggaatactatcgatcctgggcaagcacatgggagcatcaggcgctattacgcgcacgatatgcggcaggcgacgcgtctcttgccgaggatttcctcatgaacatcgccgacccgttgcgttatccgaaaatcgatcttacggaaacgcagatcgccgaaatccgcaaactcaaggcacgtatggaagctgaacgtctgccgcgcggagtacgtagggatcgccatctgaagctcggcaagggcggactgtctgacgttgagtggacgatccagttgctgcaattgcagcatgcgggagacaatgccaacttgcgtgtcaacggtacgttgcaggcattgaacgagttggaacatcgcaagctgatttccgctggcgatgctgtggtgttgcgtaaggcatggcgtatgtgcacggccgcgcgcaacggcagttatctgtggagcggacgcgtcaatcaggctgatattttgccggacgattcatattcgctgggaggcatcgccgtgtatctcggttacgatgcgaatcgcggccaacatttcgaaaacgacctgctcgccgtgatacgcaaagcccgtgacgtaacggaacgcctgttctacggtcgttcgtgagtcgtgccatttgaacggctaggagcatggtgtggccgtcggaccgaagttatacggctctgacggttatgctgattcagggtttcgtgcatggaaggatggaggttgcgccacgaatacttgtgaacacgcggtgaactggcagggtctgcatttcaggctatagttggctaggtcacttcgagtggccaccttcaaccacaagttgcatgaaaggtgagccgttgtcttcagtactcgaacaggcggttgaaacgccgatggtcgggaaaagcgtcatcacattggatgatctttccattcgccagattcaagaattactccacaaggcgcagtacattgattctcatcgtaaagaagtggcgcacacctgcgacggcagggtgctcgccactttattttatgagcccagcacccgtacgcgtctgagctttgaaaccgccatgctccgactcggcggcaaggtgatcggcttcgccggcgcccagctcgcttccgtgaccaagggcgaaaccatttcggacaccctgaaaaccgtgtccaactacgtggacgtggtggcgatccgccacccgaaggaaggcgccgcgctcgtggcgtcccgtgcagcctccgtgccggtcatcaacgccggcgatggtggacatatgcaccccacgcagactctggccgatcttgcgacgatgcagtcgcgcttcggtcgcgtgaacaatctgactgtcggactgtgcggcgatctgactttcgggcgcaccgtgcattccctgatcgaaaccctgtgccgtttcggcaacgtgaacttcgtgctgatcagcccggatgagctcaagaccccgcagtatgtgctcgaccgcatcaacgccaccgactcctgctcctacacggaagtcaaggatctcgtttccgtgatcggcgatctcgacgtgctgtacatgacccgagtgcagaaggaacgcttcttcaacgaagacgactatctgcgactgcgcgacacctacattctcgacgaagccaagatggcttacgccaagaaagacatggccgtgctgcacccgctgccgcgagtcaacgaaatcgccgtcgaagtggatgacgacccacgcgctgcctacttcgaacaggtcaagaacggcatgcttatgcgcatggcattggaaagctcggtggtcggagacgaactgccgggatatgaaccgcttgaatccaaggaggttgcagcctgatggaggtcaccagcattcagaacggcatcatcatcgaccatgtgcctgctggcaccgcgctcaaggtgctcgaatacctgaaaattgatccggctaagaccaagctcgcgctgatcatgaacaccgacagccacatgttcggcaccaaagacatcatcaaaatcgaaagcgaagaggaagccgaaaccatcgaccttgacgtgctcggccttgtggcacgcaccgcaaccgtcggcattgtgcgcggcggtaaaatcgtagagaaaaagcagcctacactgccggaacatgtggtcaatatcatcaaatgcgtgaacccgcgctgcgtgactaccaccgagccggccgtacagatgttccacctggtgcattccgaccgtcaggaataccgctgcgactactgtgacgaggaagcgaagttctgacccatgaccctcacccttcacgacatcaaggtttggaacaccggcgaagtcatcgacctgatcgtcccatctgacgctgatgaaacggtggacgcttcggccatgaccatcgccccgggattcgaagatccccacgtccacttccgcgatccgggccagacctacaaggaatccatggtttccggttgcgcggctgccgcctctggcgggtatacgaacgtgctcatcatgccgaacaccgttcccgccatggatggcgtgaaggtgacggcgggggaaccgggcgccagtgaagtgctcgacgccggtttcgacacggtcatcgactatttgcagcattacgaacaagcccatgatgtgaccttgccggtgcgttatgacctgtgcgtatgcgcttccaaagggcgtgcaggcaaggaagcaaccgacgtggccgactggatcggctacctgcctgaacacgatgacgacaacaaggacgcctaccagctgtgccacccggtgaccgccatcagcgatgacggttccgcggtaacaccggaaatcctcgatcaagtgttcgacaacgtcaagaaatcaggcttatacctgatcgagcattgcgaacaccacgacaccggggcggtcaatgaaggtcccgtatcacgagaactgggcgtacccggcattcccgaagataccgaactgaaaatcgtcgaacgcgatatcgagatggcgcgcaaaaccggcgtgcatgtgcacttccagcatgtcagcactgcgatttctttcgacgcgattcgcaaggccaaagctgaaggcttaccgatcacgtgcgaaactgcaccgcactacgttgcgttgtgcgatgaagcattgctgaaatacggcactctcgccaagatgaatccgccgttgcgctccgaagaggatcgcaaggcaaccatcgcagccgtagctgacggcaccgtcgatctgctggccaccgaccatgcaccgcataccatggaagagaaggaccttggtttcctcgatgctccgaacggcatcattggtcttgaatgcgcgtatggcgtatgccacaagattcttgtggacggtggctttatctccgacgaacgcctgattgaactcatgtcgactgcgccagccgaacttatgggccacagcaaggccgacgtcacagcgttgcttgacgaatacgcagacgccgtccccggagacgacgacaccaaacgcgtgctggacctcgtcaaggttcctgcagaagaccgcgcggatctggtggtgctcaacaccgacgaggcatggaccgtgaatcctgaacgattccattcctcggctcgtaacaccccgtttggtggatggcaggtcaccggccgtccgctcgccaccatcatcggctcgaaactagtcttcagccgtatcaacaaggaggattgatggatcgcctgatcgaagcaatcgaagccaagcagaatccgagcgttgtgggacttgacccgaccgaagcgctcgtgccagcgcaaatcgtggccggctttgccgaggaaatcagcgaacaggttgaagatccggcggaagcgccgtccatgcagctttccgtggccttcttcgaattcaaccgcgccatcatcgacgccgtcgcagacatcgtgcctgcggtcaaaccgcagatcgccatgtatgagacgctcggtccggcaggcatcgacgcctacaccatgacctgcgaatacgccaagcagcagggcctgtacgtgctcggcgacgtcaagcgcggagacatcggctctaccgcggctgcatatgctcatcacctcagcggtataggattggacgacaccgcctatgatccatggcatgaggatgcggtgaccgtgaacccatacctcggcaccgatggcatcacaccgttcgtcgacgccgccaccgccaacgacaaagacattttcgtgcttgtacgcacctccaatccgtctagcagtgaactgcaggaacttgaactcgcctccggtgaacgcgtatacgagcatgtcgccgatctggtggaaggctggggcgccgaaaccatcggcaagaacggctattcacgtgtaggcgcagtggtcggagccacgcacccagaggaaggcaaggcattgcgcgcacgcatgccgcacacgttcttccttgtaccgggatacggcgctcaaggcggcaccgcgcaaggtgtggccggcatgttcgaccgtgacggcatgggtgcgcttgtcaactcgtcacgtggcgttatcggtgcatggaaaaagtccggcaagtattctgaatccatgagcgccgacgatgctctggatctggttgcggaatcagcccgtgaggcagccaaagatatgcgtgacaatctgcgtgcggtcttgccgtaacctgccgactggccaactgttcaatctgaaagaaaaacaaccaccaaaccatcgaacgtaacagagagggagttcatgaccaccgcaacaacgttcgttccgaccgttgccgaagcgactgcggcaggctttttcccgagccggcatgaagtcgaggtcgttgacaatcaggaactgactgacggcgtgtaccgtttgacgttccgtgacgaatacatcgccagccatgcaaagccggcacaattcgttgacgtatattccaacgatccaagcaagctgatgccgcgtccgttcggcgtttgcgaaaccaacggcgacgaagtcagcctcatgttcgccgtggtaggcaagggcaccgcagaatttgccggattgaaagctggggacaccattcgtgtgatgggcccgctcggcaattcgttcaagaccaaggagcccgccaattatgtgctcgtggcaggaggtcttggcgtgcctccgctcgtgcatgcggcacagcatatcgccggcgtcgaaggcgcggtcagcaccgcggtgttcggctaccgcaacgtgcgtttcggcgacgaatatgcgggcaagtatgccgacaaggtgtacagcatcgacgagagcgaaggcaacgtgatcaccttgcttgaccgcatcgaaggcgagttgatggattcgggactcaagccggtgattctgacctgcggtcctctgccgatgatgaaggccgtcgccgcatgggccgtgaagcgtgacatggcgtgccagctgagcttggaacagcgcatgggctgtggctatggcacttgcgtgctgtgtacggtcgacacgttggacggacgtttgaaggtctgctccgatggtccggtctttactcgcgaacgtttgggatggggtgaatgagatgatcgacgatacccagcatgagaacctgtacggttcgtacgagtggaagcatcccacgcaggtggcgggcgtgccgtggaagaatccggtcgccacggcttccggcaccttccagtatgcggcggtccgctggttctacgacgtgagccaactgggcgcggtcaccaccaagggcgtctccccggtgccatgggaaggcaatcccggcattcgtaccgctgaaggcccatccagcaacatcaacgcggtcggcctgcagaacccgggtgtggaccattatttggaagacgacctgcccaagctcaaggccatcaacgctacggtcatcgccaatgtggccggtcactgcgacgacgactatgtcgaagtcgtgtccaagctgaacgattctccggcagacatgctggaaatcaacgtgagctgcccgaacgtgtccgccggaggtatgagcgtcggcactgatccggtggcgttgagccgtctgatcacccgcctgcgcaagctcaccgacaagaagatgattgtcaagctcacgccgaacgtcaccgacatcaccgtgcctgcccgcgcggccgtggaaagcggcgccgacgcgctgagcatgatcaacacactgctcggcatgcgcatcaacattcgcactggagaaccgatcatcgaccatgtgaccggcggcgtttccggaccggccgtgctgccgatgggactcgtggccgtgtggaagacccgctccgcattaccgaacactccgatcatcggcatcggcggcatcgattccggtgagaaggcgcttgaatacctgtatgccggagcgaacgccgtggaagtcggtgcggccgcactgttcgaaccgaccgcgccattgcgtgtggcccgcgaactcgacgagctgctcgacgcacgtcccgaactcgcagacaagctcgccaagggcgaaacttggcgttgacctcgatcattcatcaaaggagcatgacatgactgaatccctcgaccaccgttttaccaagttcctgctggaagcgcaggcgctgaaattcggcgagttcacgctgaagtccggtcgtaagtcgccgtatttcatcaatgcgggcgcattcaacgacggacgtaagatcgccacgctcggcgcattctatgcggagaagatcgcggcggaaatcgaagcaggcaatctgccgaacgacatcgacaccattttcggtcctgcctacaagggcattccgctgggcgtctccaccgcgatcgctctgacttccggccacggtatggaagtcggctacaccttcgaccgcaaggagaagaaggatcatggcgacggcggcatgatggtcggcacccagctgaccgacggcatgaaggtactgctcgtcgacgatgtgatgaccgcaggcaccgcagtacgcgaggtcattcccaagctcaaggccgaagcggatgtggaggtcgtcggcttggtgctttccgtggatcgtatggaaaagaccaaggattccgacacgtccgcggtgaaggccgtcgaagcagagttcggcttcccggtattcgccattgccaacgtgcgcgagatcttcgaggccggccagcatatcgaaaccgctgacggcaccgcgtatgtgaccgacgagatcaaggccgctgccgacgcttatctggagcagtatggtgcctgaattctataggcgggtcctacagttgaacatatgaaaagtgcctcacaccaatcgaaagcatcggtgcgaggcacttttcaatctcatatcagagtgcatccagttgatgagtgcattcagtcgatcaggttgtatccatggtcggccaccaccgacttgagcttctccaaatagttttccgcggccttcgacagcttcgcacgctcgttcgtgatccagccgaccagcatggtctcatcggtgtcaagcggcacggtcacgattttctcattgttgagatcgccgttgtcgatgccggtgcacacggtgtagccgttcagaccgatgatgaagttcagaatcgtcgcacggtcggtcacgttgatctgcttgggggagtattccggccagaccgcctcttcggcgaagaagaagctgccctcctcgccctgctcgtactggatgaacgggaacggcttcaagtcgtccatcgtgactttcttcttgccggccagtggattgttgcgtgaaatgaacacatgcaacggagcacggaacagtggatggaattccaaatgcttttcgcgcaacatcttgccaatcacgtctttgttgaaatcggacaggtagatgatgccgatttcggaaagcatgttcgccacttggttgatgatgtctttggtgcgcgtctcacgaatggtgaactcgtattcgtcggatttgatggagttgatcatttccacgaacgcttcgacggcgaacatgtaatgctgtgtggacacggagcacagctgcttgcgtggcttcgcgttcttgtaacgttcttcgagcagcgacgcctgatcgagcacctggcgcgcgtaggtgaggaattccgctccgtccacggtcaaggcgatgccttgcgacgagcgggtgaagatctcgatgccaagctcgttctcgagttccttcacagacgagctcaacgcgggctgtgacacgtacagctcgtgcgaggcttcgttcatggaaccgcattccacgattttcacaatatatttcagctgaagaagagtcataaattcaggttagagccatgtactgaccgtgggggagtgcttataccctcttgtctggatagtggactgccgatcgcgcagatcaaggacgtgaaaaaaccaattgcagcttgacgaggatcgcacacagttggaaaccccacaaaccgtgctcgacaaaaccggtcaggtgttcgcccaatgggagcggaccggcttgacgggtcaggcctacaagcaaaagagttgtccctatcggagtgctccatatcggcataagcgacaaaaagggattgcccggctttctacacaccagacaatcccgttcgtcacaacctactacagttcggtctactggtacagatggccgccctgctcgcggaagcgctcgctcatctcttgcatgccggcagcgatggtttgcgcgtcggcgacgagcttctcctgtgcttcggcattaccgaattttttgcggatgttttggctgatggccatggagcagaacttcggaccgcacatcgaacagaaatgcgccatcttcgcaggctcggccggcaaagtatcatcatggaacgcgatggcggtgtccggatcgtagctcaggttgaactggtcaagccaacggaattcgaaacgtgccttgctcatggcattgtcgcggtcgatggcatgcggatgatgcttggcgatatcagccgcatggcaggcgatcttgtatgcgatcacaccttgcttcacatcgtccttatttggcagcccaagatgttccttcggcgtcacataacacagcatggcagtgccatagcgggcgatttccacaccgccgatcgccgacgtgatgtggtcgtagccgggagcggtgtcggtggtgagcggtccaagcgtatagaacggcgcgtccttgcagatcgccttttccatctcgatgttcatgcgcacggtgtcgaacggaatatggccgggtccttcgatcatcacctgcacgtcgtgttcccatgcgcgctgcgtaagctcgcccaaagtcatcagttcggcgaactgtgccgcatcgttcgcatcggcaagcgatcccggacgaagtccatcacccagtgagaatgcgacatcgtacttggcgaagatctcacacaactcatcgaaatgcgtatacaggaagctttcctgatgatgctgcaaacaccattcggccatgatcgaaccgccacgcgaaacgatgcccgtcatacgattcgccgtcaacggcacgaaacgcagcagcacaccggcgtgaatcgtcatgtaatccacgccttgctcgcactgttcgatcactgtgtcgcggaacagttcccagctgagcttggacgcatcatcctccaccttttcgagcgcctgatacattggcacggtgccgatcggcacgggggagttgcgcagaatccattcacgagtggtgtgaatgtcgttgccggtagacagatccatcacagtgtcggcaccccacttggtggcccacgtgagcttctccacctcctcgtcaatagacgaagtgaccgccgaattgcccatattggcgttgagcttggtgaggaacttcgagccgatgatcatgggttcagcttcgggatggttgatattgcaaggcatgaccgcacgccctgcggccagttcgctgcgtaccaattccacgctgcaatgctcgcgctccgccacatagcgcatttccggcgtgatgatgttgtggcgcgcgtaccacatttgcgtcaccggatgatccttggccttcatcggcttatgctggcgaccacgccattccttggaagccttgccacgtttgatggcgcgtttgccgtcatcttccaaattgcggcgacgtccttcatattcttcgacgtctccacggtcaagaatccagtccaaacgtaggggagcgagaccctccttcggatcgcatttcggaccttcggtgttgtaatccttgaatggtgcgttcggtccgacgccaggagtgtcagacagtttgatttcagtgtacggcacttgcagatcgtaggaaccgaattcgttttcgaaatgcaccggcgtggttttgcgaatatgtgctttgtctcgctgcttggaatcgcgtgcggcaatgtcgacgcgctgttgcttggcaagcttggaggcggccttggcttccttcgcattggtgaacttcttttcgccggatgcgccgtcggctgtgttgtcagtgttgatttccgctgttttctgggctttcacgcgcggcgcgtacccgtgcttcgtgtcgccacgtacggctttccagcgcgctaccatattgcgggttgcagcttccggatcatcggctcctgcaatcgcggacaccacgaaccagcctgccgcctttgaatgcgccagcatctccatatcatctgcggtcacgccaccgcctaccactaccggaaaaccactggctgaacaaatggtgttgatctgctcttcgtcaagcgtgcgaccggaaccgtcattgccgcctacggacgcttccggcttggtgacggaaacatgcagtggtgccgcaccgatatagtcgatgcagccgtcgggcaattcgttgatgagtttgaccaggctttccgtttcggcggacaagcccacgatggcatcttcgccaagcagtgcacgggcttcgcgcggttccatatcggtctgtccgatgtgcacgccgtcaaccttgatgcctttgctgcgggcctgccagaccacgtccacacggtcgtcgatcacgaatgccacggaatccgacttattgttgtcttcgatgatttgcgcgatatcacgcgccatgtcggtgagatccttcgcgtcagcgtctttgacgcgcagttggatgaagcttgcgcccccgcgcaatgcgtcatcgatgacgtcggtgatcggtcggcctttgcaatcctgtggtcctaccacaaaataggcgctcaggtcgaagctgtctcgcatcgacgcatatggataattgctcatgattcccccttgattatgctgttttgggttgggaaaacttgatttcgcaggcaatgggtatgctgacgcgcccgtatgctcggttatacgggatagaaaatggaattacgattgatgattgcgcgatgcagactgtttggtcgacgcatctgctgcgcagacttttacggatgccaattgacgctggcaatgcgtgtgcgctacgacactcattcttcgctccctacgttggtgctaaccaacaggttcaaagggtcaggcattcgcctatctcagctccgttggggagcccccctgctttacgtgttggctatgaatctacgccctgcactggacgtaactttcatcgaagcccacaggagagttaggccagccgtcactttcgcatgtatcgcctccatccgcgtcacgcctccgccgcgcaactcacagcaaactctccttgcaggctaatctatacttcagttcaatgcattgcgtgtgaaagaggtcgactacatgttggaaacggaacggctgacattgagggcttgggcggaaacagatgcggaaagcttgtactcctatgcgaaagatccggatatcgggcctatcgcgggctggcccgcacaccgatcgaaagaagaaagtctcaatacgattcgtcatgtgctcaatggcaaggaatgctacgcgatttgcgagcgcggcagcaataaccccattggttcgattgagttaaagcttaatggtcatacggatatgacggatcgtgatgatgagtgtgagttgggttactggctgggcaagcctttctgggggaggggttatatgccggaggcagccaaggaggttatccgtcatggttttgttgatcttggtatgagtgcgatttggtgcggctattatgacggcaatctgaagtcgaagcgggtgcaggagaaggttggttttgtctatcatcacacgtgtgatgaggtaccggtgcctcttatgcacgaggtgcgtgtcgggcacgtgaatgttcttaccaaatcacgctggcaaaatttagctgcctgctgattgtgctagaagctaacctagaatgctttggaagggtcttggtgggcttcgaacggatgctggtcaagaccctttagagcttcatgatgttttcctcgatgcgacggatgacgtcaatgaaagcttcatcgttgtgcccggttggatctggcagattccaattatcgtcgaaagccttgccgatatagggacatcccacgtcgcagcccatggagatcgcggtgtcaggttttggaatatccgaaatcagcttggagtattgcgttttctccatgtcgatgccgtaaagctctttcatgagtcgtacggcatcctgattgatctgcggcttggtttccacacctgcggaataaaaatcacaatcggttccgcgtagatgctttcccaacgcttcggcaatctggctgcggcatgaattatgcatgcaaataaaagccacttttctcatagctttccctgtctgcgatgttatgatttcacgattgctgtcccgtattatacgtttcgcccaatgctccgcgttcacatcatcgaataacacaatgcccggtacgaccatgtcataagctggtcgtaccgggcattggcttggattattcgccccagacttcttcggcgatggaccttacgagtgcgatcttggcccactgctgctcctcagtgagcttgttgccttcctcagtggaggcaaaaccgcactgggtggacaggcacaagcggtcgagcggcacatactgggccgcttcggagatgcgagccttaatcacttccggatcttcaagttccggtctcttggaggtgacgaggccaagcacaacctgtttatcgccggaaacctcagccagtggcgcgaagtcaccggaacggtcgtcgtcgaactccagatagtaggcgtccacgttctcttcgccgaacagcttggctgcgaccggagcataaccgccggacgacagccacgtggaatggaaattaccacggcagatatgggtgttgatcaccaaatcatcaggctggtctgcgatcactgcgttgatcacgtcaagattctcctgctgcaggcgggccgcatcctcatcgctccagccgagacgctcacgcacgctcttgtcgcacaggcgagtccaagtgcagtcatcgaactgcacgttacggcagccggcggcatacaggtcggcaatgacctgacggtatgcggccacgatatccgcggtcagctcgtcgtcatctttgtagaactcgtcgtacgggtaggcgttcttgttgccggtaagcacgaaacgggtctgcgctggggaaggcatggtctggcgagcaacggtattgtcatcttcaaactgcctgacgaacttgaaatgctccacgaacggatgatcgtgtccgtcgagcttgccggtcaccgtggcagtgtcggcgggagtgacctcgtcatggaaggcaacgcgatgggcggctgcgacatggtccacgccgttgaagccccacatgaaatcgaaatgccaccagccgcgacggaattcaccatcggtgatgacatgcaggccggcggccttctgcttggcaaccagatcagtgatcagcctgtcttcgacagctttcaattcagcggcatcaataatacctgcagcataatctgcacgagcctgcttgagttcgtccggacgcagataagaaccgaccacatcggcgcggaacggcgcattcttggaatatgtcatgattctccttcgactattgacttgcaattaacaatcacaacgacaaaaccaacaatatgctatcccaccacccacaaacacgacgtattccatccgcctggttgacaacgtacttccgtccatccgcagagttttcaatgctggaataaatgggggtaaatgacactgcatggcgttccgatattggcagacgcgcggccgatgattgtgcaaagaatcgcgaaaggcatgcggaatcacgacatgagtggcgttgtgttcgtatataatcgcaacggacatgaacgactgcaaggaggctgccatgactgtgccgcaacgagtgcttgacaccatgaattccggactgatctacacctgcgatgacgaagagatgatcaaagcacagaaggaacagatggaactgctatacgacttcaatgcaacccgccccagtcaaatgacgcaacgcaacgaaatcgcacgccaactgcttggcgaattcggcgaggacgcttatatcgaaccgccgttacatgccaattggggatgcaacacgtatttcagtgcgcacgcttacgccaatttcaaccttacgttagttgatgatggtgaagtgcatatcggcgaacataccatgatcggcccgaactgcactatcattaccaccggccatccgattcgtcctgacctgcgcgagaaggtcacacagtattctctgccggtcaccatcggccgtaatgtgtggttgggcgccaacgttaccgtgcttcccggcgtcaccattggcgacaattcggtgattggcgcatgctcgctggttaccaaagatattcccgccaatatggtcgcattcggacagccatgcaaggtgtatcgcgaaatcggcgaacatgatgacgtctactattggcgtgaccgcatgatcaacccaccctatgaccagaagcagtaaaacaaatcactatcgaccaaccgttcaaacaggtcgaatcatcgtggactagtcgttatgacagatccacgatcccataatttgcgactgtcaagcgaaataccgggcgcaccattgctccaccacacgggcaaggtgcgccttctttgaaaactcagtcctggttgctccaatcaatcatgcttcccaccataacgtgcgaaacgtaacgcacgcatgtccgcggtagatgtttagataattatctaaataagaaaatgtgtgaacattgcgaagcgaaggaggaatgtatggcaggggagggattcaaagcgctctccgatcccacgcgacggcgcattttggaattgctgcgcgaacgtgacatgacggctggtgaacttgcggaacaattcaacatgagcaaaccgtcgatcagccaccatctgaccacgttgaaaaccgcgggactggtaaccgacgaacggcacgggcagaacatcatctacagtctcaacaccacggtgatgcaggatctgatcggatggttcatgggattcatggacggcgatggaaacgtcaatcaagcgaatgatcaaacagacaataaataaaggagggtcttatgcgcgggaacaacttgaacgatttaaaaaacaacatcaacaatgccgaagacaagaacaagactgattcgggggagaagatcgctccgatcggacgcaatctgtgcattgcgcttgttgcactgtgtgtagtcaacatcatcgcacatcttgcctgctatagtcggcttcccgaaaacgtgccgattcattggggtgccgatggttcggtcaatggttatggcccgcgtgccgtaacgttgattcttgatgtattgccgttgctgtgcttgggacttttcctcgtcatcccgaagatggaccccaagggagaaaactacatgaaggccagcggactgtatcgtggattcgtcatcgcgttcacactcatcatgtgcggtgtcacatggttcactgaagccaccgcattcggtgtaatcccagctaccggcggtcccgttgggcttattgttagcgtggtattgggcgcgctgttcgtcggcttaggcaattaccttccgcgcatgcgccagaattacactttcggcatcagaacgccttgggctctggtcgacgagaacaattggaagcgtacgcagcgtgtgggtggcatctctttcatggtgttgggagtgctgttgattgtggcgggtgttgtcagctctgttgtgcctgtgggcgacatgctcatggtcgcaattattgtgacgatagcggttggtgcagcgctcgttccttatgtatacagctacctgttgttccgccgcagtcgcggttcgcggcaaaactgaagtaacgtcatagcgacgctagataccgtcgccttgacacagaacacaaatcaacgttgacaaacgccgttggcaatctgggaaagtttaatgaacggactcaggagaaccaattgcaaacagtgaaggaatcgaatctgaatttcttcagtccaacaatcggggtgcggttcacatgcgtgcgatccgcaccctttgttaattcaagtgttcgttttgaaaaagtcagaaatccatgcccaaagatttcagatcgcggcgagcctgaccggcgttagtgaagcggaacgcgtgcatgcccacggcctgtgcgccagtgacgttcttcgcggtgtcgtcgaagaacacgctggattccggcctgagattgaaacggctcagcgccagttcgtagatgtcggcattcggcttgtgcatcttctctacgccggacaccaccgtgccctgcagcagctcgccgagctgcgggaaacgttcgaatgcgaaatggaacgtctcatgcgaccaattcgtcaacccccacacgccgtagcctgcagccttcaaatcacgaagcagctgttccatatccggaatcatgcggggaagcgcatcgccgtaacgttcgatgtaatcgcggaaaatctcggcgatctcttcgccctgttcacgtaccacgtcgggataaatggcttcgaaatcctcgccatggtccatgcgatcctcataatcgtagaagccgcacggatcattatccgcgcaaatacggtctacaaccacttgggggtacctgccttcaaggcatgcgcgcgtctgccagtcgataagcacgccgcaaaaatcaaagaccacatcggtgacgttggcactgggggaggtcatgaaaatccttcctgcaaaatacggattggcaacgctagtgtagcgcaaagccaccgatgttggggctggtgttcggtaaatttgttttgcaattaaagtaattgcaaaaatgccggctgaatgccgccgataatatcgctcgcgatgatcggatggccgatttccccgaaatgctgctttttggaatgcccatagatctgcggacgatgccatccacgctgttcggatcgcgatgcgatcgcgcccgcaagaccatgtatgtaggctccggccgccacgacttcgggaactaatgccggatcctcggcaagcatgtcgtcctgttgcgcgagcagggcgcccaacatgccggcaagcacatcgcccgatcctgcggtggacatccacgccggcgcgcgtccggaaagaatcacccgctcgttgccttcgccgtccgtgccgaccaccatggtcaccgcgcccttcaacaatacggtcgcgccggtcagctcatggaccctgcgggcgcaggcgagcggctgcgagcgcactttgtcgacgctggcttcgtttccgtctagccgagtcaacatgcgggccagctccccgacgtgcggggtgacaaccacttgagccggcactttgcctggcagcaggtccaaagctccggcgtctaccacgatcggcggcatgcccagggcgctttcattcctggcgtcgtcattggagccggttttttcctgcagtgcgtaatgcttcaacaacgcggttatggtttcgcgttgaatgtcggtgtcggcggcttcgtcgccacccgtgggaacgccggaaccaaccacccatgattggacgcggcccttgccgatcaccgcctcgggcaacgaggaaagcaccatgtcctgcgctcgttgcgggccgagatagcgcaccatgccagtgttggcgcgcgccgccgccgtggccgacaatacggctgcaccggggtaacgggcggagccggtcaccaagccgaccactccacgcgaatacttgccgtccgaaagttgcggaaggcgaatcgaatccgttacgaaatcgccgtccgtcatttcggccgcggggacgcaatcatcaatgtcgaaaccgaaatcgaccaaagtgaggcggccgcatgcgtatgaggcgggtggcaccatcgcgcacggcttcatcgcgccgaatgttaccgtaacatcagcaggaatgtacggtcctggaagcgaaccgtcatttacgccaacgccggacggcgtgtcgatcgccacgacgagcggcagggcggaggaaggctcgttgttcggcagggcgggcctgtcgggaagttcgccatcgaatcccaaggaggaagcgatggcgcctgcgatgccacgcaatgcgccgcttacgccgattccggtcatcgcgtcgatgatcacatgggagccctgaacgtattcaacggcggcctgcagtcgttctccggcctctcccgcggaaaaacccgtggtgcatcctgggatttcggcggcgggatcaagtacgagaacacggcctccggcatgcacgaacgcgccgaacgcctcctcgtgcagggaacgtcccacggcgatcgcggtgacatgcgcgccttcgttcgccagttccgcgccggcgtatagaccgtcgccgccattatctcccgcccctacaaggagggctacccgcgcgtcctcgacggcgaggtcctcatcatcgagcagtgtcatggtcacatgggccgcagccgaggcggccatgcgcatcagcggcacgccgtcgtcaagcagcggacgttccatctcgcgcacggtatcggaatcgtaagcgctgtacagcagtgtttgcaaacggtcggcgtcgtcggcgatgtccataacgttcccttcctcgtcgtctatgagcaacaatccctactgtagtcgtaatattgggagtcaaggatttttcggcgtggaatggagaccaaaatggcatatatcgaaatgcagcatagttacaagcgttaccaaatgggttccaccaccatcaccgcgaacgatgatgtgagcttcggcatcgaaaaaggcgaactggccatcattctgggcgcgtcgggcgcgggcaagtcgacggtgctcaacattttgggtggcatggacacgaattcagaaggcagcgtggtcatcgacggacgcgacatttccaactattccccgaaacagcagacggcttatcgcaggacggacatcggtttcgtgttccagttctacaatcttgtggcgaatttgaccgcgaaggaaaacgtcgagctcgcctcgcagatcgtttccgatgctcaggatgccgtcaaagtgttggaagacgtcggtctcggcgatcgtgtcgacaattttcccgcgcagctttccggcggtgaacagcagcgtgtggccatcgcccgagctgtggcgaagaatccgaagatcctgctgtgcgacgagccgaccggcgcgttggactacaacaccggcaagcaggtcctgcagattctgcaggacatgagccgtaagaaaggcgccaccgtggtgatcgtgacccataattccgcgatcgcgccgatcgcggaccgtgtgatccgcatgcatgatggcaaggtcaccgccgtcgacgtcaacgagcatccgatggacatcgcggaactcgaatggtgatgtcgcgacacgctgtgcgacactcgatttgcgaagacaaaggatttgtgtaatatatgtgacttgtgcacggaagcaattccgtacaggaagcacattcctgcgtagctcagttggcagagcatccgactgttaatcggacggtcactggttcaagcccagtcgcaggagcgcgtttttaggtttttcctgattttcgtcggggagaagcttagaacaggagaatattcctgcgtagctcagttggcagagcatccgactgttaatcggacggtcactggttcaagcccagtcgcaggagccacatgaaagcccttggaaatcaagggctttttgttactctaacgaatcaagcacgtcgtcgatcagcgtgcgctcgtgcggtccatcggtcttgagccgaggaaagcgccgcaacgcgttggcgggacttgccccggccgcgcgcgccacattcgatttcgactcgccgtgcgccaaagccgtttccgcaagacggtccaccagcgagtccgacaccttgcggatctgctcggcaacccacaactgcgccagttcgggggagagcgcgtaatcgtcctgcaattcgcttgacgcttcctgcacggccgcccacagcaccataaaaggcttctgatagtaggtgatccgatcgtaatcggactcgctttccagttgctgcaacgctttgcgctgtgacgtgttatcgctcatacgttccatcgtatgccgagacacgcccggagcctgtggataactcatcctccgaccacagggccgtttcagctggacaagcacaacttcacactgtcatgctggcgatttaccacagcacaacgcaacggcgcaaacacagcaacgtgaaggagccatcatggacgaacgtgaatatcgcaggcgaatccgacggaacagaatcgcacaggaggaaaagaagcgcatccgccagcagttgcgccaaaccatggtcgtatgcgctctggcatgtgtcatgctgctcgtgtgctgcctatggtcggccgaaccgacgtatgcgaaaacgaatgcggcgaccgcgtccggttcctgcgccgtcctgatgcgatggccgctgaacggcgcgcaggtggtcggcaagtacgatgcgccgaaacaacagtggcttccaggccatcggggtgtcgacctgcttgcggaccctcaggaagccatcgtcgcgcccgcggacggcgtgatcgccttcagcggcaacgtgggaggcaaagccgtggtcaccatccggcatggaggcgacctttccggcctgacctcgacgttcgaacccgccattgcggaacgcgatgtcggcgcacatgttgcgcaaggggagcgtttcgcgcgtgtggagggcgaatccgaccattgcgacgagcggtgcctgcattgggggataaaatcggaaggacggcaatacaccaatccggaaagcaaaacccgtacggtgagaatcggattgaaaggcctgtgaaacaggggtcgacagaaccattgattttgtccatacgtcgtggcctcgtcgaaaaaagtgaagctctcaggctatgatgctacatgtacgacgattacgcaggggagaaatgccatgtacaaggaatacacgcggcctttggaacagcagatcgacacggataagaacattttctcggtgcttgatgaacgagcgaaccgcactccgaacgattcattggtcgaatacaagaacgagcatggcgagtggtcgtcgttcagcgccaccgaattccgtgccaaggtcatcgccatcgccaaaggcctgatcgcccaaggcatcatgcccggcgaatcggtgtccatcatctctcacacctgctggcagtggactgcgctcgacgtggccatcatgtcgatcggagcgctcaccgttcccgtatacgagacgaattctcccgcgcaggtcaaaatgatcttcaacgacgccaacgtcaaaatggcgttcgcagaagatgacgcgcaacgcgacaagatcgaatccatcagaaacgaatgctccaatcttggcgacgtctacgtcatcggacttggcgcgatcgacacgatgatcgaatacggacatgccgtgtccgacgccgaattccaagagcgcgaacatgcggtcaaaggatcggacctcgccaccatcgtgtacacctccggctccacaggcacgccaaaaggcattgagctcacccattccaatttcgtgttcatcacctattcgggcattagctccatgcccgatatcgcgatgaagccgaaccgtcgtctgctgctgttccttccactggcgcacgtgttcgcacgctacatgcagttcttctgcttcgcaggtaacgtctcgctcggcctatccagcaacttgaagacgatcctggctgatttcaaagcgttcaagccgacgttcatccttgccgtgccgcgtatcttcgaaaagatatacaatgcggcgtcgcaaaaggccggagccggcctcaaaggacgtattttcgcaggtgccacgcagacggcgcgcgactggtcgtacgcacagcagtcaggcgaaggcattccggttgtcttgaatctcaagcatgcgctgtacaacaagctggtgtactcctcgatcatggacgtgttcggcggccatgtggaatacgcggtttccggaggcgctccgcttgattcatccatcgcgcattttttcaatggcgtcggactgccgctgctggaaggctacggcatgaccgaaacctgcgctccgtcaagcgtcaatccgacctccggatacaagattggcaccatcggactgcctctgcagggcgtggccatgggtgtcgacgaggaaggtgaactgtgcatcaagagcccggccgtatgcgccggctaccacaacaatcccgacgtcaccaggcagcagattgtcgacggctggctgcataccggtgatcttggttccatcgacgacgaaggcttcgtctccatcgtcggacgtaagaaggacctcatcatcaccgccggcggcaagaacgtctctccatgcgaaatggaagcgtcgatcatgacgtcgcccgtggtgagtcaatgcgtgatgatcggcgaccgcaagccgttcatagcggccatcattgcgttggatcttggcgaaacgaacgcatggcttgcatcgaaaggcgcggaatgcgcggcatccctcgaggaggcctcccgcaatccgatcgtgcgcgccgaagtggaacgtgccgtcaacaaagccaacgagctcgcatcccgtgccgaatcgatccgtaagttcgaaatcgtgccggacgagttcaccgaagaaaacggcttggtcacgccgagcatgaaggcacgccgtcaggcggtggttgatcactaccgcatgctgatcgacaccgtcatctacgttccgaagaagtagaatgcgatgatcggcggtaggaatgtgccggccgcaacataaaaagctggcttccgtcgcggcggttcgacggaagccagctttttccatctcttgtcggatttcctatgtctgataatccggattaccttgttgccggtctacaagcctgcttcggcgagcgagatatatcccggttcgatcagcgttttcttcagattgctggcgctgaccgcaagcgcctcttcctgaatggtcggcactttcatgtcttccatggcgacggatgagatgaacgtcatcttcgcaagtttgcccgacgtgttgagctgcacgcaggtctgtgcgatgtcggatgctaaggtcttgcgattttccaaagcggtcatccactgtttgccgttcacgatattcggtatggagctgacgtaggcgccgtaaccggtgatgatcggccattgcgagttctgctcgtcaagggaatcgctggtatcctccgtatcggaatcgccgtcatcggattcaggcgcctgcgcaggatcgggaacggactgttttttcaggtctttcttgccggtgatattgtctacgatgccggaaatggtgatggatgggttgatgtcggccgccgaaccggtatatccaagatcgttgagctcttcggaagcatagccggccacataatcattgcaggagatgatgccgtcgatgcgggtatggcgcgatgtgtccttatccatgccgagacgtccggcgagcgtggatttgacccgctcacttttcgccgcgtcgaacgccacggacacccaatcggattccgcgctcgacgaggtcagcgtgccggatggggaaacggccttcccatctttgaaatacggtccaagcactgaccaaatgcctttgaacacgccttgcgcgaaagtcgcgtccgctgtgctgccgctttcattggcggcatcgtaggggagtagcacttcgatatgcttcggattgtcggagctggttttgtcgagctcgagcttgctgaccagctgtttggcttgaagctggccgatctgctcggccgtggtcatcggcacgtacacatccggagtgaaaccctgcagcgtgttcgacactaacacgactttcatgccctcgttttgagcgagctgcaatgcggaaaccaaacgttccgcggattgggcgtagtcctgggcgtcttcgtcggaggagctcccattccatgtgatggcgtgcgacacatagtctccatattggcggtcggattcggtggtgtcggccaccggcgccactaccagagtggttttgtcggaggaatccgcatcgtcgctggtgctgttgacgtgattcaccacgtaatcctgcacgctttggctttgcttgtcgagacttggcgccgctttgacggtgatgttggcgcctttgacatcattgtctttcaatgatgaaacgatttccggcaccagcttctcccatttgctcagaggcgtctgctgggagatggtgatgccgtccgaaggggtgaagatcaccacgttgccggcatcggtggcagtggcggtgctgggggagtccgtttcatgcgattgcgtttcattggcggatgagcaggcgcccatggtcatgatgagcgaggtcgatgccaacagtgcgaacagacgtttcgtcacggtcgtgcggtgcagtgtcatgccgtttccttcatgaaaatcgaatgatgattcctatgctgagctccgattgtaatatccggacgtcaaaaagggctggatatgcgtgtgaaccatacatatccagcccttttgagcctgctgctggccgttcagccaaaggttatttcgctaggtcattcggccagagccttggcgagattctcgtccaaagcgttcatgaagccttcggtgtcaagccaggcctgatccggaccaacgagcatggcgagatccttggtcatctgaccgccttcaacggtagacacgatgaccttctccaaagtttcggcgaaatacttgacttccggagtgttatccaagtcggcgcggtgcttgagaccgccggtccaagcgaaaatcgatgcgatcggattggtggaggtcttctcgcccttctgccagcggcggtagtggcgggtcacagtgccgtgtgcggcctcggcctcgacggtctggccgtcaggggtcatgagcacggaggtcatgaggccgagagagccgaagccttgcgccacggaatcggactgcacgtcgccatcatagttcttgcaggcccaaatgtagccgccatgccacttgagggagctggccaccatgtcgtcgatcagacgatgctcataagtcaggcccgctgcggcgtacttgtctttgtattcgttttcgaacacttcggcgaacgtatccttgaactggccgtcgtatgccttgagaatcgtgttcttggtggaaagatacaccggatagccgcgcatcagaccatagttaaagcaggcgcgggcgaaaccacggatggaatcgttcacgttgtactgcacctgggccacgccgccgtcggcaccatagttgtacacgacatgttcgatcggctcggaaccatcttccggagtgaaggtgacggtgagcgtgcctgcccccggaaccttgaaatcagtggccttatactggtcgccgaacgcatggcgggctactacaatcggcttggtccagccgggaaccaggcgcggaacgttgctcatcacgatcggctcgcggaaaatggttccgccgagaatattgcggatggtgccattgggggacttccacatcttcttcaggccgaattccttgacacgcgcctcatccggcgtgatggtggcgcactttacgccgacatgttcacgctggatggccttcgccgcgtcgacggtcacctgatcgtcggtggcatcgcggttttcgatgccgagatcgtaatattcgagatccacgtcgaggtatggaaggatcaggcgatccttgatatctttccagatgacgcgggtcatttcgtcgccgtcgagttcgacgaccttgccttcgaccttgattttggccatgtgttgccctcctgtcgggattgaaggtgataagttcctgtcttataacgaacgtgttaacggcacctgttaatgtccaaaaaacggtgtggcggcaggtgacacgctcttgcatactgtcattgctgagcattagccttgaaaacatgtctcaggaaattgaaatcggtttgggcaagaagggccgtctggcatactctctggacgacgtttccattgttccctcccgtcgtactcgcgatccgcaggatgtgtccacctcgtggcaggttgacgcttatgaattcgacgtgccggttatcggcgctccgatggattcggtgaccagcccggccaccgccatcgccatgggcaagatgggcgcgcttggcgtgctcgacctcgaaggcctgtggacccgctacgacgatccgcagccgctgcttgacgagatcgccgaactgccggccgaaagcgcgaccgagcgtattcagcagatctacgccgagccgatcaagccggagctcattgtcgagcgtctgcatgagattcgtgacgccggcgtcaccgttgcgggcgccctgtccccgcagcgcacgcaggactattattcgaccgtgctcgaagcgggcgtcgacctgttcgtcatccgcggcacggtcgtttccgccgagcacgtctcccaggatcacgagccattgaacctgaagaagttcatctacgatctggatgtgcccgtcatcgtaggcggcgccgccaactacaccgcggccctgcacttgatgcgtaccggcgcggccggcgtgctcgtcggcttcggcggcggcgcagtatccgcgaaccgcaacaccatcggtgttcacgctccgatggccaccgccatcgccgacgtggccgaagcccgccgcgactacatggacgagtccggcggccgttacgtccaagtgatcgccgacggcggcatgggcgactccggcagcttcatcaaggcgttcgcgcttggcgccgatgccgtgatgcttggctctccgctggcccgtgccgaggaagctccgggcaagggcatgcattggggtgccgaagcccgtcatcagacgcttccgcgcggcttccgcacgaacgtcggcaccgtcggcaccctggaagatatcatgtttggccccagccacaatgcggacggcaccaccaattacattggcgcgctccgtcgtgccatggcaaccaccggctatgtcgatctcaaaagcttccagcgttgcccggtcacggtcgctccgacccgctgaacgagctttgcggtaaagcctgaataacggttcattgatcctgtagcgtcatgctgcaggatcttttttgttatgtttccccggctaagaaagtcaggttggaatgattaagctatacatcgcaaatgaaagagcagaggtgagatgaatggcagcgcatagaagtggcgattcccgacgtttggacccgttgtccggacgattcacggattacatcgtgatcgatacggaaacaaccggattgagtgtgcgcaaaggtgccaagctcattgagatcggcgcggtcaaaatccgtaatgatgagctggttgacgaattcgaccagctcatcaacccgttcgaacacgtcccgtcaagaatcactggtttgacgggaatcgacgatggcatgctgctcggcaaaccggatgtgcgtgaagtcatggatgagtttgcacgctggtgttcggacacagccgtggtcatggcgcacaatgcgtccttcgacatgtcgttcctcgacaatgctgtacagctcgcttactcggagcgagacgcgcgctttgcgcaccatttcgtcgacactctggacctcagccgtcgactgcatccggaaaaacgaagccacaaagtttccaccctcatcgtcgactaccacatcgccgacatggaggagcaccgcgcattgtccgacgccaggcaggagtggatgctgtaccgcgccatgcgtgacgaggccgagctgctcggcatgctctgacagcctaacgtcgttcgaacacttcgatccggtattctcccacaggtgtctgttgatttatggatggattatttgttcggcttcgtgccgcagcaggcgtcatctccactggcggagaacattgcattgggtgcgaagttcagagcgaaaccgctctgttggtgggagacgttggctgaatcggatttggcgtcattcgtgatatttgccctctgtgagggctccgttccggcaacgaacgaggcgatatctcctggaacgcctgcgctacgtaactgacgcacggtgactggaatcgtgccgatgctgctttccgaggtgaacgcgaccactccggcagggaagaacgctttgaagaagtggattggattcaacttcgtcagtgttaagcagcaggaagaatacggttttcgcaccaatactctttaagcgcatggactctccaaggttcgtgatgctggagatgatgctgaacagcagcagcggaaccaccagtgcggtaattgcgttggaccagatggaacccaccgcgccgacataatcagtgtggccgttgaaagcgattcccaaaatgataccgaatgccgttgcaagcaacacgcgtgtggtgaaacccgcgtttttcttacgtttgagaaacgccaggatgacgaacaggatcgcggctacgccgagggcgatccaatcatatgcgatgcctgacattactatcattcccttcccaaaaaatggtgatacattacgtgagatacccccacgttcatgtcggacatcaatctatccgctccgtctccggcgcaacgccttgtagttattgctgttttccatagtcgtctatcagacggtagtcattccgaggcacgcatgctgacattccagcgctccacaagtcattccgagacgtggttgttttgcgtttagggagggctcgttttaagatggaacgtcggataactggcttcgtgtctggatttgtgagagccggaggaattggagattagacatggcattaagtgccgcgattattcttgcggcgggtgagggcacccgcatgcgttccaacaagccgaaagtgctgcacactttggccggaaagacgtttttgaaccgtgtgatggactccgtgtcggcgctcgaccctgaaacgttggccgtggtcgtgcactaccaggcggaacgagtcgccgaagcggcccgctcctacaatgagcgtgtcaccatcgtcaatcaggacgacattcccggcaccgggcgagccgtgcagtgcgccatgacgcagttgaaggagcaaggcggtcttgacggctcggtgctgatcgcagcttcggatatgccgctgctcgacgccgacacgttgaaccagctgcttgccttccatgagcaaagcggcaacggagccaccgtgctcaccaccattcttgacgatcctactggctatggtcgcatcatccgcgacagcaaaggcaacgtgctgcgcatcgtggaacagaaggacgccaacagcagcgaactggccgtgcatgaagtgaacacgtccgtctacgtgttcgatgccaaactgctggctgaagcgatcgccaacctcaaatccaacaacgcccaaggcgagttctacctgaccgacgcactcgaaaccgccaaagccaacggtgccgtcggtgcgttcgccgcccccgacccgttgagcgtcgaaggtgtcaacgaccgcgtgcagctcgcagcgctcgccaaagctcacaacaagcgtatctgcgagcattggatgcgtaagggcgtgaccattctcgactctgaaaccacgtggatcgaagatgacgtgcgtatcgaacgcgatgcggtgatccttcccggatgcttcctggaaggccagactgtgatcggcgagggcgcgcaggtcggcccatacacaacacttatcagcgcggtcatcgatgccgacgcccatgtggagcgttcccgcgtgcaggaaacccacatcggtcgcgcggccaacatcggtccgtggacgtacctgcgtccgggcaacgatcttggcgaggagtccaaggccggcgcctttgtggaaatgaagaaggcgcacatcggcaacggcaccaaggtgccgcatctgagctatgttggcgacgccgacttgggtgagcacaccaatatcggcggcggtaccatcaccgccaactatgatggcgtgcacaagcaccacaccaccatcggatcgaacgtgcacgtcggtgccggcaacctgttcgtggcccctgtcgaagtcggcagcggcgtcactaccggagccggttccgtggtacgccacgacgttccggacgattccatggtctattccgaaaacacacaacatgtagtagagggctggaagcccgaatgggagcgctgaatatgccggcagtacaagattccatcgacgccatccgcatcgccgccgccgcggccgaccgtatgaaggccaccgaccttgttgccttcgacgtcaccgaaccattggccattaccgacgcgatgctcgtcgccaccgcttcgaacgaacgtcaggtgttggcggttgccgaagagatcgaaaaggacctgtatctcaaaagcggcaagcgtcaaccgcgttcccgcgaaggcttgaccgaaggccagtgggtgctgctcgactatggtgatttcgtgatccacgtcatgcatcaggagtcccgcgacttctatcgcctcgaacgcttgtggaaggattgcccgagcatcgacctgcagctcgaacatccggagacttccgacgaagagaccgcggaaatcgcggaataacacgtatgaacatgccttcccgtatagatgcggaaggcatgttttcatatcaagcgaagcagttttcgcaaacattccataatcgagaaagcaacggagagcagcagcatgcctcgaaacgtcgaacttgagcataacagcgcagtaccggaacacgtgcacgccatcacgctggtgcgtcacggacgtaccgcctacaatgcgcagcatcgtctgcaaggccagatcgacattcccctcgacgaagtcggacaatggcaggttcgccagacggccgacgcattgcgtgaactgtatgttgatcgtcgtcccgatattccgaaccggctggtcatctgttccgatctggggcgtgccgcagccaccgcgcatgcgttcgccgacccgctgggcttggaagtgcatcccgacatccgcgtgcgtgaacgcagcttcggcgattgggaaggcattccggttgaggaactcgcgcaacggtacccggaagactatcgttcctgggctgaattccgtggcggcgaactcaaatacggtgccgaacccaaggaggaagtcggacgtcgtggcgtcgaagcgttgaacgattgggcgttccgtgccggatccgacacggacttgtacgtgttctcgcatggtgcatggatttctcaaacgttgcagacgctgctgggaatggcggatgcgcatggcgatttcgccgacattttgtcgatgcgcaacgctcactgggtgcggctcattccattggagatcggttccacattgcgttggcgtttgatggactacaatcacggtcccgctatcgccgattccgaggaatgggagcatcccagcctgtagccagcctgtagccggccgatacatgatgtcggacgctggtctgtcaccgctttttcaagcttttcacagaatcgccagtactttcatagcgaaattagctatcgtcatggcttgtgaaaaacttttttaagggaatctctttttcgtcgatttgcgcgggtgcgctggcggcggtcacgtcattcctactttccgcgaaaatcggtatcgcgggatcggtgattggtgtggccgcgggttcggttgtttccgcggttgccacgcaggtctacaagaacgttttgaaggcatcaggggagaagatccaacaggccgtgccgttcccgtcgagtagcgagacggtttcgaatgagcgagctgcggatgaaacgcaggtgcttggctcttccgaacaggatgatgagacgaggattattggatcgtctcctgttgcgtcggatgtcacgatggtattgtctgccgatacggctgcggtagcgcagtccggtttaccgcgcgtcatttcctccggacaggaatatgcggatgcgactcgtgcgctcggcgatattgccggggcaggggagacttccgttttcccgaacggacagcgtggcgtcagcgatgttggcgtagttaccggtaagaccggaacactcggaagcgcgcatgatgcccgagtacagcatgctgggcagcgttcctcgaattggttgcatagcaagtacgctccggcgatcatcgcattcgtcagtgctttggttggtgtgggagtgagcgcgggattgattcttgctttcaccggcggtcaggggacggacaccgtggtgcgtgacgtggtgcatgagaaggttgtaccttcgcatggaaataccgatgactatcagactggcgacgggcagacccccgtgcaaaagcctaagtccgattccacggattcgaacgacgaaaccaccacggacggcagcgacaaaaccaccaacggatccaccgactcgtccacttccaacggcacatcgagcaataccaatggatccacgtccggaaacagcgggtcgtcatccgataattccagcaatggttccagccagaacggaacggattcgtccaacggcactggctcaaacggaggcacgtccggcaccactggtgatggctcatcatccggatccggaaacagcggaaccgatggttcgactggcactggcacgtcgggatccaccgacggtactaccggctcgacgggagatgcaagtagtaactaatgtcgctggtggcgcacttcccatgtcgcccgcataaggttcacataaggtgattgcgtagtgcggttttactcatgccaattcctcagtgcgggcgacacgccgaaatttgcgtgacttatgtctgcgatgtatattatacagagtttgcagggcagactttggggctatggcgcagctggtagcgcatctccatggcatggagagggtcaggggttcgaatccccttagctccacgattatcgagggccactccgtaaggggtggccctttttgttgaaacgacgctgtttcgcggacgtgcttgccgaacctcaaaaacggttcaaggtgatagaaaccggttataaggtggtaaagaaacaggacttccacgacgacgcggagaaccttcggcaagatcgtatacaagccgaacagacggacgcatgaacgacccgtgtcggcaggggtgtcggcgacggacggtagagccgacatgggcttattgttaattttcattcatagatgctttgtcttgtcttatgagtgcttctaatttataatcctcataaaatataaatgactttttgaaagcagtgaccgttatgagcatggaatacaggactttggcgcggctgttccacgccgacaggagcatggactcctacgccaaccacgaccggctcgtcagacaacgcctcgaagcggactccacattcacaaccggaatcggcacacccttgggcgaactgttcatcgccacgccgcgctgcgtgtgcatgctcacacagaaggtgctcctcgccgaacgccgggtatcggccatgtggcggagcatcccaggagtcatgcggtggaactacatctaccacgccatatccgaggaattgctcgccaccaacgagatggagggggtcaggtcgacgcggaaggagacggaagccgccgtggccgcagcccggcaggccaggaccgagggcgacatggagaaggccaggttcggcgagttcgcgaaactgtatctcaacctcaccaatcgcgacgttgaactgcccaagactctcgaggacatcagggacatctacgacaagatagccctcgacgagatcgacgacaagaacagacccgacggggagctgttcaggaaaggcgatgtcgaggtccaaggaccgcacggcaccgtcatccacagcggcgtcagcagcgaggcgcggatatcagcgctgctcgcacagatgatggacctcgcccggtcggataccataccgttcctgcagcgggcgatagccagccacttcctgttcgaatacatccacccgttctacgacggcaacggcaggacaggcaggtatctgctcgcgctctacctcagcaacgatctcactctgcccaccgtgctgtccctctccaggacgatcgcggagaacaagaacgaatactacaaggcgttcactgaggccgaggacaaactcaacagcggggaactcacgttcttcgtatacaccatcctcggactcatcgaacgggcgcaggaatccctgatcgaggagctcggcgtcaaaatcgaccagctcgacaaggcgaccgtcctgcgtgacgagctacggagggaacatgcactgtccacgaacgcgaccctgcttctctacgcagtcatgcaggaggagctgttcgacaccaccaagtccatgacgctcgaagatgcaggcggcgacctcatgctgacgaaacagacgatccgcaaatacgtggatgagctggcgggcgcgagcctcatcgagttcacaggaagacgccctctcagattcagggcctccggggcgttgcgtacgcgcatacaagcaaagcgagaatgggggatggaataaaatgcctttgtgctttctctggcagatactgtctgacatatctaagccagcaaacaagaattgccacatcgcaaaaagcccaggctaaatcggaaatgtctgaatctgcataaattcttttgagggaaaaacccatcaatggaataaaggaattcacacacaatatctaaaccaagtgcggatatcggcatgctgcaggctttgtctttgaacccattgcgaatcaactcgacgtgcatatcgtccagcagataccgctgatgccaacccaaaatcaatcctttcttttccatgattgattggatagcggatgatcgtggtctgatgcctcagcaaagtgcgaaacaggtgttatctctcctaaattcggtttcagatggagcgcgtatgtgatgttattcacgttgggcgaacatgcgttgtggggtttcttgtcgtagtctgaaagtatgcccgcattccatgggcatatagacgaaaggacggcatcatggtagatctcaccgatgagatgaagggattcctcaacagcaacctcgcatgggtggccaccatcagcaaagaaggccaggtcgatctcggtccgaagatgagcatgttcatcatcgacaacaaccatatcggctaccacgagcgcaccgcgggccagacataccgtaacctgcttgacggcagtgatctggtcgtcgcggtcgccaacctcgaacagaagaagggataccgtttccgcggcaacgtcgtgctgcattccgatgacgccatctatgacgaacaggtcaaagtcgccgaagaacgcggcacgaaaaagccgatgaccattccggttttggagatcacggaaattcaggatctcactccgggcgctacggcaggcaaaaccatcgtcaaggactgatcggttccatactgaaccagtcgaaacgacaatatcggagaaccgcagacgggactgtatgtccggtctgcggttcgctgttatcggaacggaagatcgcgaatctgcagcatatcgttcgcggcggttcgaccatggattcctatacggcagttgcatgtatgggttgtggataagtgtggataagtgttcgctcatccacttatccacagattttcttaaagaggtggcgggcgaatattggtttctgccatgctggtctgcacgcataagcgaagacgcctatgcgacaaccaacaaccaaagaaggtgaaccatgacacaacacaccatacgccgccgatggacctccatgcttgcgctgggcatgatcgcggctcttgccatgccgggcacggcccaagccacgccgcaactcggcgatttaggcgtcaagcagtccatgagcgtgaaggcaagcaacggggaaagcctcgaaggcaaggacctccgcgccatccagcttgccacatataccgccgcaagcgtggacggcaacacgatcgtcggctacgatctgaccacgaacacggcattggcatccgacatcaccgcggcagccaaagcggccggagccaccgatacgaaccttaccgtcaacggcaaaaacgatccgatggtgtgggtggtgaagaacctgaccgactcgcgcagcgatccatggagcggaaagctacgcaacttctgcaacagcctcgccaaacaaaccaacttcgccaagcaggatggaacggcggtttccacactcagccaagacaaagccaccatgtcgaccggcaacgtactcgtaccgggaatctacgccatcgtggaccgtacaccggcgacaaccacactaagcagcggcaccgccatcaaaacaaccgcgtccatcatgatgatgaacggcaccgcggtcaacggcgtcaaccaactacgtacggccggcggcacgaccctgaccctcgggcaagtgatctacaaggtatccaacgtggaatcgccagacaaaaaagtcaacgtcggcagtgcctggaaagacagcgcatccgaagcgataggcaaggacctgacctaccgtgtgacgcagaaaatccccaactggacaggctacgagcactactatcttgcgttgaacgatacgcttggcgcgggtctcgactatggttcgctcacctcgatcaccgtcggcggcaaagcattggcgagcacgttctacaaggaaaacgtcaacggcaaaaccatcagctggctgttcggcgtcaacggagacattctcgcctcggacgcatcaaaggcggccctgccggtcggcgcgacgatcacagtcacctacaaggccagactcaacagcaatgcggtcatcggaagcccctgcaacgtcaactccatcgacttggaatactcccacaatcccaacgcatggcaggaccacaacaaccagcccggcaacgaggttaaagtctgcaccggtgaaatcgcattacgcaaggtcgacgccaaaagccaaaagctcaccggcgcgaaattcgccatcgcccaaggcgccagcgacaaaacgcctttgaaactcgtggccctcggcaacggcacctaccgcctcgccaccagcggcgataccaccacaaccaccacattcgaagccggcgaaaccaaaatccaaggactcaaaggcgaatacaccatcaccgaaacacaagcgccccaggactactcgtcgctcatgctgcccagcgcagtcgtcaccgtcaacgttgacgacaccaacatgacgtggagcctcgacgtcaaatccgaccccaacaacctcatcaaaaaaggcgacagccacaccgtggtcgtcaccaacatccgtaccatcaccgaaataccgttgactggtgcggcaggcctcaccatgctcttcagcatcgcggcactcctcttcataggaggcatcgtcatgctgcgcatgtgccgatcaagcaacgactagccaacatccgacaataggcaacacatggcgattcccccgcatagcaaaccacggcacaaaaaagcgcccaacaaacgcagcatcatccgatggtgcgtgggaaccgccatgctcaccgcaacggcactcatcatcagcatccccctgatcatgcgcgccgaagacaacatccaacaagcagccaacgtcaaagcgtacgcagccaccatcaccaacaccgcaaacaaggcaatccaagaaagcaaacggcaggcgaaactctacaacgcgcgcctcgcaaaccaaaccagcaaccaaacagacgacgaacccgcaacgcaaaatcccgacgaatacaatcggcaactcgtcatcccacccagcgacgtcatggcaaccatcaactacccgaaactcggcatcagcctacccatacgtcacggaacaagcgaacagacgctcgccatcggcgcagggcattgggaaggcacatccctgccaatcgggggagcgggaacccataccgtcatcaccgcacaccggggcctcgccgacaaactcatgttcaccaaactcgaccaagcccgagaaggtgacgaattcaccatcaccaccctcggcgaaaccctcacctatcaagtgcaaacaatccgcaccatcacccccgacgatttcacctggataaacaaacacgacgccagcgccgatcaggccacccttatgacctgcaccccatacggcatcaacacccaccggcttctcatcacaggaacgcgcgtccccaaccacgacgaatgcccgccagaaacaggatgcctcaccgacggaaccctctccaccacggcattcgcgctcacagccatctgggcgaccctcaccacactcgcacggcatagctacaatgaaatgcatgatcgacgaagtactcttcctgcgccacggacgcaccgcatacaatctcgcaagacgactgcaaggccaaatcgacattcccctcgacatcgtcggcaggtggcaggccgaccaaagcgcttatgaactcgccaaaacatactattgggcgaaagtcgcgcacatcgccgaccataatgatgaactcgcccaacccgcgtacgagggcgcgtatctcgccgatcttaacgaaatcaacgaggcaccggccgcgagccgacgcatggtcgtcgtatcatccgaccttttccgcgcccaacagaccgctcacgccatcgccgaccttctcggacttgacgtagccctcgacccacgcctgcgcgaacgcagcttcggcgaatgggaaggcatgacccgcgaggaaatcctcgaacagtacgccgacgactaccattcatggcgtgcccacaccggaggcgaaaccaagcatggcgtcgaaagccgcaggcataccggccagcgtggctcccaagccatacgaagcattatcgccgaacatgccgatgatccgacggccaccacgctgctcgcagtcggccatggatcgtggatcgtggccaccgtcgccgtgctgctcgacatggatccggacgacctcaacaatctcggagccatgcgcaacgccttctggacgagcatgagcgtcaacacaggcggttccaacggtcctgcggatcccgacacatggcagtggaagctcgacgccttcaaccaaggtcccgccatcgccgcgcttaccgattgggagaatgggccgaaggaattgcgaggccccaacatgccattgtggaagcccatcgtgcagtgatccgcagtaaccgcaacgatctgcagtgactgtcgcctgccgcggacgcatgcgtcgaacatgaattctcgatgaaatctcaggcacgcggccggccaactctcaaggtgggactatcctaaataaggttgtttgcccgaatgttccagatcgatcgcaagagaccgatcgccggagatgttggattcgggctgccgtacagcgatagaacgtcggaaagcgcgaaaggcgggtgagagacatgttgagaatgttcagaacgattaacggccaggtggagcagatccaaaaacccgaaaacggatcttggttatgcctttcggatccgacggatgtggaactcgccaacgtttccatggaaaccggcgttgatctcgccgacctgcgcgccccgcttgatgacgaagaacgctcccgcgtggacgtggaagacgattacacgatgatcatcgtcgacattccaaccgtcgaagagcgcggcgggcgagactggtacgagaccatcccgttgtcgatcatcatcacgcagtcggccatcatcaccgtctgcatgcaggacactccggtgttgcacccgttcatggaaggtacgatccgcggtttcaacacgtatatgaaaacgcgtttcatcctgcagatcctgtaccgcaacgccaccatgtatctgcggtatctgcgtatcatcgaccgcgaaagcgacaagctcgaactcaaactgcgccattccatgcagaatcgtgagattctcatgctgctcgaactgagcaaaacgttggtctacttcaccacgtcgctcaaatcgaacgaaatcgtgatggaaaagctgaccacgctgccgcgcatcaagcagtatccggaagacgaggatctgctcgacgacgtcatcaccgaaaacaagcaggcaatcgagatggccaacatctacagcggcgttcttgccaacatgaccgacgcgttcgcgtcgatcgtgtcgaacaatctgaacaacgtgatgcgcatcttcacgatcatctccatcacgctgtcgattccgacattgatcttctcaatgtacggcatgaacttccaggagggcatgctaggcatgccgttgacggacaagccgtggggcttcgccgtgatcatcggaatctcgctggtcgtttcggccattgtcacctggttcctgacgcgttcgcgcatgttcaagtagaatcgcgtagaatcgcgcgtatgctacgtctgtcacgtctgtcacgaaatatcgcggcgctggtatgcgccgcttcgaccgtattgggcacgagcgcgtgcggcacttccatttccgtagtgaccaatggtctcgcgcaggggccgaccattgcgattggcgtggccgcggaccagcctggtttgggttttctgcatgggggagagtattcgggtttcgatatttccgtggcgcaatatgtggcgaacacgctgggattcgcgaaaaaacagatcgtgttcaaacaggtgctgccgtcgacgcgcgtttcgtcacttgaagacggcaccgtggacatggtggtcgatgctttcgccgctgatgacgttcaggatggtgaggttgagcttgcaggaccgtatctgactgtgcatgcggcattgttggtacgttccgacagtgcgggaaccatcaccggaaccgatgatcttgccggaaggacggtatgcgtggccaaaggaggaataccctcctacagcgtgcgaaatcttgcggaagatgtgaccgtgagcgaacgcgacacgtatccgcaatgcgaaacggcattgatgatcgggcaggcggacgccatcgcggcagatgacgccatagcggcgggcctcgcatccaacaggggaggcggatatctcaaggtcgtaggcgaaacgttcggcgaacgttcgtacgcgatcgcggtcaaatccggccaatccacgctggccaaacagatcgacgccgcattgcagtccatgatggacgacggctcgtggaagcaggccatagacaagatgaaacagtcgatcggctacgttcccgacatgtcgctcaaccctcccgcgataacgctctcggcagcgtcggaaggctgacggcccccgccttgcgtgacgctttgcaaaacgcttcttgcataatgattgacgccttgcgaagtgtccagttgcgcggctagtttcatgcattatgagtgacattgagaaaagcgcgcagacgcagtcgaacgaaccagccgaaccgtcgttccgttacaacgcggatttggctcagggcattgaggaaaaatggcagaagatttgggatgacgaaggcaccttctgggccgccaacgtcaatggcgatctgaaggacggcaagggtcgcaacgccgaaggacgcccgtcgtacttcgccatggatatgttcccgtacccgtcgggcaagggcctgcatgtgggccatccgctcggctacctcgccaccgatgtggtcagccgctaccaccgcatgaagggcgagaacgtgttgcacgccatgggctacgacgccttcggtctgccggctgagcaatatgcagtccagaccggccagcatccgcgcatcaccaccgagcagaacatcgccaacatgcgccgccagctgcatcgtatgggcctgagcttcgacaaccgccgctccttcgccactattgacccgggctatgtgcgttggacccagtggatcttctcccgcatctacgattcctggtacgacgaggatgccaccaacccgtctggctccaagggctgcgcacgcccgatcagcacgctggtggagcagttcgaatccggcgagcgtgagattccgggattcgcaggcaagcagtggaatgatctgaccgaagccgagcaggccgacgtgctcaacgacttccgcctggcatacatctccaagtctccggtgaactggtgcccgggcctgggcacggtgctcgccaacgaggaggtcaccgccgaaggcaagtccgaacgcggtaacttcccggtgttccagcgtgagctgcgccagtggtccatgcgcatcaccgcatacggccaccgtctgatcgaagatcttgacggcatcgactggccggaaaaggtcaagctcatgcagcgcaactggatcggcgaatcccacggcgcttccgtgcatttcgacgtcgaaaccccgaacggcgtcaaggacatggagatctacaccacccgtcccgataccctgttcggcaccacgttcgccgtggtctccccggagcatcatctgctcgaggatgttcccgccgaatggccgtccgagactccggaagactggaagggcggctacgccactccggtcgaggctgtgaaggcctaccgtatggccgcggaatccaagaccgccaaggaccgtgtggacgaggcgggcgagaagaccggcctgttcaccggcctgtacgccatcaacccgatcaccggagccaagctgccgctgttcaccgcagactatgtgcttatggattacggcaccggcgccatcatggccgtgccgggtggcgaccagcgtgattacgatttcgcggtcaagttcggtctgccggtcacctacaccgtgcagccgctgccggaatccggcgacgatctggccaactatgagggcaaggctccgttcgtctcccacgacggcatcgtcatcaactccgctgtggacgccacccgtgccaagggcgacgcgttgagcctcaatggactgcgcgtggacgaagccatcgacaaggtgaacgcatggctggaagaagctggtgtcggcaagggcacggtcagctaccgtctgcgcgactggctgttcagccgccagcgttactggggcgagccgttcccgatcgtctacggcgaagatggcaccccgcatctgttgccggacgaccagctgccgatcaacctgccggacgtgccggactacagcccgaagactttcgatccggaagacgccgaatccaatcctgaagcgccgctgagccgcaacgaggattgggtgaaggtcgaactcgacttgggcgacggcaagaagacctactaccgcgacaccaacaccatgccgaactgggccggatcctgctggtactacatgcgctacctcgacccgaccgacaccgaacacatggtggagaagagcgagttcgactactggatgggcccgaaccacaacgagaccactggcaagtccggcggcgtggacctgtacatcggtggcgtggagcacgccgtgctgcacttgctgtactcccgcttctggcacaaggtgctcttcgacctcggcttcgtggattccgcggaaccgttccacaagctgttcaaccagggcatgatccaggcatacgcctacaccgacgaccgtggccagtacgtgccggccgccgaagtggtggaaggcccggccgacgccaacggagagccgaccttcacctggaacggagagcacgccaaccgcgagtttggcaagatgggcaagagcctgaagaacatcatcacgccggacgacatgtatgcgaactacggcgcggacaccttccgcctgtatgagatgggcatgggcccgctggccgaatcccgtccgtggaacacgcgcaacgtggtcggatccatgcgcttcctgcagcgcctgtggcgcaacgtcgtcgacgagaacaccggcgaagtgcgcgtcaccgatggtaagctcgacacgaagacgctgaagctgctgaacaacacgatcgccgacgtgaccgtggaaatggaagcgatgcgtcctaacacggccatcgccaagctcatcgtgctcaacaaccatctgaccagcctcaacgaagtgccgcgcgcggccgtcgaaccgttgattctgatgctttccccgatcgctccgcacatctgcgaggaactgtggaacaagctcggacacggcgaatcgttggcccacgccgaatggccgaaggccgacgaacgctatgtcggccaggacgccgtcaccgcggtcgtgcagatcaagggcaaggtgcgcgccaagctcgaggtctcgcccgacatcgatcctaaggaacttgagaagatggcgttggaagccgtcgccgatcgtctgggcggcaaggaaccgcgcaaggtcatcgtcaaggctccgaagatcgtgtccatcgttcctgcggaatgatatttcgaaaaacggatccaacggcttctggcgagacctttgacgaggcttccaacagggtgggaaccgtttccgcataaggcgacacgccgaacatgtggataactcccatccttcgaccacaggggccgtttcgactggacaacatgcccatgcatcctccactttggatgcatgggcattatcgttaccccgccgggcaggcgcaacaggcaagccgaaaccgcatcgcagtccgcgcaacggctgcgcggacttggcatgcccgaaacacgtggaaagaacgcgcgcgggcagaacgttcgcaacgaacatgctgttcccgcgatatccgaaacaacctcaatatccgagatttccgcagcggctgaaacgtccactgcaatcgcgacaactgaacaatcgcctgaacccgcaaaacccacattgcgggatctggccggcgtcaagccttccgacaaaccgactgaacaggaccggcccaaacgcgaccgtccacgactcgtcttccaaccaatccacgcggtcatcgccatactcaccctgtcgtgcgcgctctgcgcaagcctgaccatgctcatccaacaggccgtccactacagtgcgctccaacaatcgcagatcacccaatccgaacaatcgaaggcgaacggaaccgagaaagacaagacggcgtccacgcaaacaacaccaagccagcagccatccacggaacccgacagccagagcgaaccaacatccggaccagcggagcccgccgatccggctgacggtctgctgaacatcaacaccgcaggatccgacgaactgcagaccttgaaaggcgtcggtcccgtgaccgcgcaacgcatcatcgactatcgcaatcagatcggccgtttcgacaatgtcgaccaactgttggaagtcaaaggcatcggcgagaaaacgctggcgaaattccgagaccaagtgtgcgcacgatgagaggaaacacgttcgaatggcgggatggggagcaggggagcagggattggcgtctgctgccggccgccctatgcgggtgggcggcgagcttggccacgcatatgggattcgactattgcgtcgaacgggatggtcggttcggcatgctgctgctcgttgtggcattggcggtaccgttgctggcattattgggattattgggattgccgttcctgcgatcgcctatgctgcgagtgccggttggcgtgcggcgggcggtctcggcatggcatttcagcattatcgtatgcgtggtcgcggcgatggcatgcgcgtcttccgcgttgacctacgacgtattgcaatggagggatgtggcctcgtacgcggccagaaacggcgaaagcgacgttgtcacgctggtacgtacgacatctcccgcagtgaattcgaacagacgtgcaaacgattgccagattgatgcgacgatctcaacgatcacggcaagccaggtcacgcagccaagcatgatgcgggtgcgcgtctatgcggaccggccggactgtggcacgctcaaacaaggcggcgaataccggatgcggggcacgctcgccatatcgcaatacggtgccatgccgctatggctgacggacatcgcctccgtggaacgcatacggggaccgaacctcgcattgcgcacgatcggcatgatgcagcaggcgttcttcgaacagacgtcacggctttccgaccaagggaaagtgctcgttcccggcctgaccttaggtattcttgggcaggattacgttcctccagatagtggcaatggccagacgggcacgggtattgattccacatacgccaatctgcttgaaaatgccttccaacgttcgggcatactgcatctgatggcggtcagcggcgggcatcttgcggtcgtcgccaccctggtgcgcgccgtctgctcgttcctgctgctgcccaaacgcgtcacggccatcgccatcggcgcgtcgtacatcatgctggcgatgtgcgtgttcccatccgattcggtgtcgcgcgccctgctcatgggtttggcgggagcgggcttcctgttcctcggccgaagaacgcaagccctgtcaaccctcagctggaccacgttgggcatgctcatggtcaatccgcacatgtcacgcagtttcggattcgcattgtcatgcgccgccgtacttggcatcgtactgttcgcaggaccgttaggcgcatggctcacaccgatcatgccggcattcatcgcgcaaaccatggccatgaccatcgccgcgcaactcttcaccctgccgatccaagtgcttatcgaaccagaactgccggtctactccattccagccaatctggtcgtcgcacccttcgtgggattctctacacttgccggactcgccagtctcgccatctcatggatactgccaagcctcgggttcatattcgccagcctcgcctcatggggcaccgccatcatggaattcatggccctcaacctcggatcaggagaccacgccaccattccatggaccggagacgcaggcggcgcgctactgatcatcctcgtcgaaatcatcggatacacgaccgcacgattcgccggaacactcttcgcccgcatcaccacaacggaaccaaacctgccgggccgacgcctcatacacaatccgatcgaacgggcgaaagcatggggcgaacgaacctacaacgcgctcaaaaccatgaaatggaacgaatgaatcttgtccaccgatacagcgagattgaatactatgccgaaaccatccgcaacaacgcccttccacctcatctacggaggcgacccgtacctcaacgagcagaccgtacgcgacctgcgccaccaagcgcaacgcaaacaccccgacgcggaaaccatcgaactcgacgcaaccaacgccgatcattacgccttcgacgaagcggtaagcccatcactgctctccgaacgatcaatcgtcatcgtatccaacctgcaaaacgccgacgacaaactcggcgaaaccatggtcgcctactgcaagcaagccgtcaacaatccagccgaagccagcgtcgtcatctgccaacacgaaggcggcatcaaaggcaaacgactcatcgaccaactcaccaaagccggagccgtcaaagaaaccgtagccgacctcaaaaaagccgaagcgaaactcaacttcaccatacaatgcttcgaacgacgcaaccgacgcatcgaacccatggccgcacaacaactcgtggccgtactcggcgacaaaaccggcgaactcgcagccatggcaggacaactctgcttcgacttcgacgacaatcccataacattggaacgcgtcaaccaatacctcacagcaaatccccaagtagacggcttccgtgtcgccgacctcgcactctccggacgtgccgccgacgccatcatcgccatgcgagcctcaatagaacaaggcaccgcgccaatcgcactcatcggagcgctcgccatgaaactacgcaccatggccaaagcctcagccgtacgctccggcaccatcagcgaagcggaagcgaaaaccaattcatgggtgctgaaaaacgccaccagacagctctccggatggacctccgacggcatgagacgatgcatccaaatgctcgcatgggccgacgaacaaagcaaaactaacggatcggaccctgtctacgcgctagaacgatccatcgaactgatcagcagcaaaggacgaaccaactaacatgagcgaggcaaccattactgacgccaacgaaaacaccagcgaaggcactgccaaaaccgtcaccgtcgaagcgacaaccggcgaagccatgcgcgaactcggcaaacaagtcgcacacctcacccacggcggagacgtcatactcctctcagggccactcggcgcaggaaaaaccaccttcgcacaaggcttcggcgcaggactcaacatcagcgaacccatcgtctcgccaaccttcaccatcgcacgcgaactcaaaggccaattccccagcggtaactccgcccacctcatacacgtcgacgcctaccgactcggcggcaacgcctatgccccaggccaaaatgccatcgaacgactactcgatgaactcgaatccctcggactcgacgaagaactcgaagaccccagcgacaacaccatcatcctcatggaatggggagaacagatggcagccgcgctcgcaccggaacgcctcgaaatccacatcgaccggccactcaacaccgttagcacagacgaaacaagcagagccgacaacgaactcaccagcaacggcacccgcactgtaaccttcattcccgtcggcgcatcctggcaaaccttcgacatcacacgcaacaaccgctaaaacaccagcagcaagcacgattccagcatcggttgtacagtagttcccagcttggcataaggagtttccacaaaatgcagacactggtgatcgacacctcatacggctcaaccgtcggcatggtcggacacgaccccatcgtcgaaaccgactcacgcacccacgtcgaaaaactacaggtgaacatcgccacaaccgtggaacaagccggcctcaaaccggaaaacatcgaccgcatcatcgtaggcatcggacctgcacccttcaccggactacgcgcaggaatcgttgcagccaaagcgctcgccttcgccaccggtgcacagcttatcgggcagaatgtgctttccccgcaggtgcttgtgcgcaacgcggagcatgacggccgccatcatctgacgctcgccgtgaacgatgcgcgacgcaagcagctgtatttcacattgttggatggcagcggctatgaggccggtggcagcgcaggcgaagaccatgacgcaaacgttgaaaacggctgtgtggaaaccctgatcgacatggatatcgactatcccgaatcgattgcgaaccgtgtcaacgaggtgctggaacggcttcgccaggccgatccgaacgtggaatatgtggtcgacgtcgtcggccatggagcggcgaaatacgcgcaatcgtgggcaagccttcccgaaggcggcgaagtgcgcgatcaggcgctgctcgacgagggcgcgtccggattggaacgattcgcggccttcgccacttcgcaacagtctttggtgaatccggagccggtcgaaccgttgtatttgcgcaggccggacgtgtcggtgccgaacccgttgaagcatgtactcaaccatgccggcgcggaacgcacggagtgacgatacggcatgatcgttgaccatacaagcatcgatgaacagatcgcagtgccgcagatggccgctttggaagcggacctgttcggcaggggagcgtggagcgaacagtcgattcgccaggaattccaagcgccagcacgcacgtatctgttcgatattgatgatgacggcaagaccgcggattgcgggattgcgggttgcgttgccgtggatgagccggttgctggatcggttgcaggcgattctgctagacaacagcccgttgtgcgcggctatgccggtttctggtatgacggcgacgatgcggaaatcatgacgatcggcgtcggcagacggttccaacggcagggaatcgcggcttcgttgatggaggcgttgattgcgcgggcacgtgagcagggggccaaacgcatgttgcttgaagtgcgcgtcgacaatactccggccttggcattgtacgaacggttcggttttgccaaaatgggattgcgcaaacgctactaccagcccgaaggcatcgacgcgtacaccatgagccttgaccttgagccgaggatcgtcggcttcgcagcagcggaacaataaacagaacaaccaaacggaacagcaagcaaagcagcgaacggagcagcaatgagcggaccaatcgtactcggcatcgaatccacctgcgacgagaccgcggcctcggtagtgcaggggcgcaccctgatttccaacgtcgtcgcatcctccatggatgagcacgcgcgttacgggggtgtgattccagaaattgcgtcacgcgcccacgccgaagcgttcgtgccatgcgtttccaaggcgttggccgatgcgaacatgacgttgtctgacgtcgacgcgatcgccgtgtccgcaggtcctggacttgctggctgcctcgccgttggcgtgtccggcgcgaaatcgcttgcctgggcggcgaataagccgatttacggcatcaaccatgtgatcgggcatattgcggtcacacagttgcagttcggcccgttccccgaagacacgctcgccttgatcgtgtccggcggacacacgtccttgctgcatgttgaggatgtcgcacgtcatatcgacgtggtcggcaccacgcttgatgatgcggccggcgaatgcttcgacaaggtcgctcgcctgctcggtttcccctatccgggcggaccgcatatcgatcgtcatgcgcagttgggcgacccgcatgccatcaaagtgccgcagggactcacccaaggcaaagcgggccagcagcatccgtacgatttcagcttttccggcgtgaaaacggccgtcgcgcgttggatcgaggaacagcaggcgcaaggcaatgagattcccgtcgatgacgtgtgcgcgtcgctggcggattccgtggcgactgtactcgccaagaaggcgatgcgcggctgcgagcagtacgattcgaagacgttgattgtaggaggtggcttctccgcgaattcgcagcttcgtgccaaactgttggaagtcggtgccgagcatggggtagaggtgcgtgtaccgcagctcaaactgtgcaccgacaacggtgccatggtggccatgctgggcgtcaacctggtcgaagcgggagtggctccgtcaaacccggatttcgccatcgattcggccatgccgttgacgaagatctccatgtaagattaggccgaaagcatcgtatggaaacgttttgcaagtcgaaacacacatgtgacacgctgaagatttgaaatccacaagttttggtgtagtatttttgtcttgtgcacagcgcattcctgcgtagctcagttggcagagcatccgactgttaatcggacggtcactggttcaagcccagtcgcaggagccatttgaaagcccttggaaatcaagggcttttgtcatattcatcgtcatattcgaggaatcaacgaagatgccgaggttctggcttataggaacttttggccaataacccggatattgcggcaggcacgttttacacgaaattcatgattgaggagaacgatactatggatgaggtagccaaagcagattcttccacgggcaaaacttaagattttcccagcaagcggcgtttaccatgaacacgcaagcaagaaaaccacggcaaatcatggaagggagtccatatgtgcactggtgttcgtttctccgacaatgagggaaacatgtatttcggccgtaatctcgactggagcttctcctacggcgagaccattctggtcactccgcgaggctaccggtatgactatgcgtatggggccaaaggcaagagcgagccgaatgcggtgatcggcgtgggcgtggttatggccgatcgccccatgtatttcgattgcgccaacgagcacggcttggccatcgccggattgaacttccccggatacgcctccttcgcgcacgaaccggtcgagggaaccgaaaacgtcgccactttcgaattcccgctgtgggtggcacgcaatttcgacagtgtcgacgaagtcgaagaggcgttgaaggacgtgacgctcgtttcgcaggtcgtgcccggccagcaggagtccttgctgcactggttcattggcgatggcacccgtagcatcgtcatcgagcagatggctgatggcatgcatgttcatcatgacgatgtggatgtgctcaccaatcaaccgaccttcgacttccatatggaaaacctgcgcaactacatgtgcgtgagcaacgaaatggcggagccgaccacttggggcaaggcggaactgagcgcatggggcgccggcgtgagcatgcacggcattcccggtgacgtgagttcgccgtcgcgtttcgtacgtgtcgcctacaccaacacgcactatccacagcagaacaacgagtccgccaatgtgtctcgtctgttccacacgctggcctccgtacagatggttgaaggcatgtccaagatgggcaacggccagttcgagcgcacgctgttcaccagcggttattccggaaagactaacacgtattacatgaacacgtatgaggatccggcgatccgctcgtttgccatgtccgacttcgacatggattcgagcgagctgatcaccgccgattgattccggaatttcgagttcgaagattccgcagtaatcgcactatgtgcgatggcataaaaggacgcaacgtcgcagtcggcgttgcgtccttttaatcagtaaaactgatgagatttgattaaaaaattaaaatggtcgaggcatgcttccaaacgtactttcaggcgttttcttcgttatgttccttatgcgaggaagcgaatcgcgacagaacacctgacttacgtaaagcgcaatacattccccaggaaccgaaaccggcgaatgccaccgcgctaagcagctcgcaaatagtgccgatgatgcctcgcgggctgaagaacgtgaatgcctgatagtagaagaacagcaggtagaagttgtagacgattccaatcgccaaagcagacagaatggtgacgccgagcgtccaacgacggtagcggaacagtgcgaataccgcttctgcggctgccgcctgcagcaatgcgattaccaccaggctcacactgtatttcgtgccgagtaccacctcgacgaacgatgcgaccaaaagcacgtaggccgaagctcccggcttgcgcacgatcagagagcccagcgtggcggggaagtagaacaaagcatgaagtagcgccgctgaaccaggaagaatcaaagtcatcaacggaaaaagaccatacgacaggccgtcgaacacccaaaacatcactcccgacatcacgccgaccgccgcgccgaccgcgatatcgaccacacgccatgtgagggccttgtgtattccttggtttgttttcaaaggctgccttacctgcttcgacagcttcgcgtctgtattatgaataacggttttagagaatggcttcgccataatgataatgaatccttgcgttggtcgatgccgtgcaccgtgagtcggagatcgcggcagtcgccgtgggccgttcctcgacctgcgcggctcgggcaggaacgacgaaaggtattatacgacgtgttgtttgccgaatacgcatcatggatttccctgtatccaaaatatcgttacaaatattccaaatccgcatcatggatttccctgtacccaaaatatcgttacaaatattccaaatccgggcgtacggtccagtccagtacatctaatccgcacgatttcgttcaactcagcagcataagagctttttgttgtgaggtggcattcgtccaaaacagcgtggtctgatgttccttacgatgaacacgtaagttacgctttgcagacgcaacttagctaattgtcaggattacatgttcttttgctatgagatagcatgcaacacgccaattagacttcaagcactttaagtttttacagtgcagggtatgagcactacaacatggcatacgattcgtgaagcatccatgatttccggacttcccgaatccactttgcgctactacgagcaaatcggtatcattgccccgatcgcacgtgacccaagttctggccatcgcgcctacaccgacgaagacattcaatcgttggtcactatttcctgcttgtctgcgactggcatgccgcttgacgccatgcgcgagtatctgaaaaaccgtttcgacggaaccgaaggtgcgcgcaggcaaatggcgctactggacgcgcaggcgttgcgtttggccgcaaaagccgaaagcatccgcatgcagcaagcctatgtttcccttaaaacattgtattggcgtgccgtggcggaaggccatgacgacgaagcgcaacgacttctggaggaaaaccacgatgtcatcgaaacagtgaaaaaacagattcgtagcaaggctgacgcataagtcgaggcgtcatcgcagacgttaccttaattcaattcgtataacaaaggagcaactcatgaaggcagcgatcttcaagggagtcaagcagatggcatgcgaagagcatgccgaaccgaccatcatcgatgggggagatgccatcatccgcgtggtacgcgcatgcgtgtgcggatccgacctgtggttctaccgcgacggcagcaaggaacccaacactcaggccggacatgaggccatcggcgtggtcgagcagatcggcgacgacgtgaccgtggccaagccgggcgatttcgtgatcgtaccgttcccgttcagctgcggcaagtgcccggtatgcaaggccggtttcgaatccagctgcccccacggcggatatttcggagacgagggattgggctgtcaggcggaatacctgcgcgttcccgaggccgatggcacgctggtggtcgttccgggcgacgcgaagagcttctccgacgaaatgctcgcatcgctgctcaccctctctgacgtgatgtcgaccggttaccatgcggctgcttccgccgaaatcaagccgggagacaccgcagtcgtgttcggcgacggtgcggtcggcctgtgcggagtgctgtccgccaagctgatgggcgccacccgcatcatttccatgagccgccatgccgaccgccaacgtatcgcacgcgaattcggtgccaccgatttcgtggaggaacgtggcgacgaggctgtagccaaggtactggaaatgactgatggttacggtgccgacgccgtgcttgaatgcgtagggtccgcattgtcgaacgacactgccatgaaggttgcgcgtgcgggcgctgtagtcgggcgcgttggcttgccgcacggcgtggaagccgatattccaggactgttctaccgcaacgttggtctgcgcggcggtccggcaccggtgcgcacgtacgatctgcagcgactgctcaaggaagtgctcgacggcaacatcaatcccggcatcgtctacacctccgaatacacgctcgacgatattcaggaagcgtacgcggccatggacgagcgccgcaccgtaaagtcgctgctgcgcatcagtgaggtctgagcaatataccgacgatagaataagcgcaaatcaaacgaaaggaagcaaatcttgtttgaagagctgcacaaacggatgaattcgttctggaataatgacaggacattgtcgcaaaccgatccggaattcattgaattcttctcgaatttcgcttatgacgaagtggtgaacgaaccgggagcgaaccatcctgatttggatgacaaaacccgctctttggccattcttgccgtgctggtcggatgccaaggcttggatgctttcgaaatgatgctgccggtggcctacgaaaccggactgtcgtccatcgccatcaaggaaatggtgtatcaggcgaccgcatactgtggtttcggcaaaaccctgccgttcctgaagaaactcaacaactttctcggcgcggccaacgtgcatcttccgcttgaaccgcaaggcaccaccacgccggaaacgcgtgccagggcgggcgaagacaagcagatcgaaatcttcggtgaaggaatgcgtggattcacgcaatccggccccgaagatacgcgacacatcaacaagtggcttgcctgcaactgcttcggcgactactacacgcgcggtggcttgagcacgcgtgagcgtgaaatgatcacgttgtgcttccttgccgcgcagggcggttgcgagccgcagctgacgtctcatgcgaaggccaatatgggcgtaggcaatgagaaggcatttctgattgccgttatttcgcagtgcatgccgtatatcgggtatccgcgtacgctgaatgcgattcgttgcatcaacgatgcagcggagcagatgcaaggctgattgcggtaggatttcgttcgcttcagtacgaaaggggctgtttgccagtcacgattggattgcaaacagccccttatatgttttttacaagcgcgctacgcgtgtgcgatcatcactcgccccatacgtccttggcgacggactgcacgagcgcgatcttggcccactgctgctcttcggtaagcttgttgccttcctcggtggacgcgaaaccgcactgggtggacaggcacaagcggtcaagcggcacatactgggccgcttcggcaatgcgagccttgatcacttccggatcctcaagttccggcttcttggaagtgatcagaccgagcacaaccttcttatctccggaaaccttggcgagcggctcgaagtcgccggaacgatcatcgtcgaactccaggtagtaggcggcgacgttttccttgccgaaaagcacgtcggccacagtggcgtatccgccggcggaagcccacgtggagtggtaattgccacggcagtcgtgcgtggtgatcaccagatcctctggcagatcctcgatggcggcgttgttcatggcggcatactgttcctgcatggcggcgaactcatcggcggtgtaatgctggttgaagttcggatcacagaacatgccccacgtgcagtcatccagctgaacattgcggcagccggcctcatacaatgccatgatcagaccatggaaggccttggcgttgtcgtcggcaagctcgtcgtaatccttctgggtgtcgccgtagaactcgtgcacggaagcgatgttctccgggcggaacagctccgcatacagctgtgccggagccggaatggtctggcgtgcaatggcggtgtcgtcttcgaactgcttgatgaacttgaaatgctcaacgaacgggtgggccgggtcgaaggcgatcttgctggtcaggcgtgcggattcggcgcgggtctcctcatcgtggaagaaatagcccttgtccatcgacaccttttccacgccggcgaagccccacatgcagtcgagatgccaccagccacggcggaattcaccgtcggtgatgacgtgcagaccggcggccttctgcttggcgaccagttcggtaatggcattatcttccacggccttgagttcggcctcgtcaatcttgcctgctgcgaaatcggcgcgagcctgcttgagttctgccggacgcaggtatgagccgaccacgtcggcgcggaacggcgcgttctgggaatacgtcattggatgctccttgttgtgctgtcagtgaaaatacctagggaagactagtcaatccttcagaaaaatgcacgattacgtcgggaatatgagacgggcgcattatagtgttttgcgattgaacgacatatgattcggggggggggtgatatgagtgatgggaccgggcggcaggcaatggcagcgcaaagtggtacgtcggataatccgaaatcctccaatcaggaatcatcgaaaaagccgaaaacgctcggcaaatatctgttggtgtcggcaacgcaaaccattgtggaattcggatcgttcaccttgctgcatgtgctttccgtaccatccgccatcgcgaacggcgtggccatcgtgctgtcggcttcgtacaacttcctgatgaaccgcaatgtcacgttcaaatcgtccagcaatttcggccgtagcgtggctttgttcatgctgctgtgggtttggaattacctgttcggttcgatcatgctggcatggctgccttccgcattcggatggaatgcggtgttggtgaagttcctgactatggcatgtcagttcgcgtggggctatccgctgtgcaaggaagtgatttttcgctgaacctgcaagcgtgtcaatccgggtggcaccctatgacagcaccctatgtatgattgaatatgtcttgtattaactccagaaagaaatggaaaggcaatgaacgaatcgcaagattccaacgacagtagtacgagcaatccgaacgatattcgccaacaggaggcagaacatcaaggagcggccgtaaaagcggcgctcggagccaacattggtgtggccatcgccaagctcgctgcggcgttctttaccggatcgtccgcgatgctttccgaatcggtgcattccatcgccgactgttccaacgaaatcgtgctcatggcaggcggtcgcttctccaagcataagacggacggcgatcatccgttcggtctgtaccgcgccaaatatctcgcttcgttcgtagtggcgacgctgctgtttttcgtcggtggtttcttctccacttcggaggcggtgaagaaattgttcgccattgccgaagaccccgcactgcgtgacgccaaccagatggaactgctggtggcgtttatcgtggtgtttatcagcgcttgtttggaaggctacggcctgcatcaaagcatcaaggaagcgaacgagcgtatggagcgcacgggtgtggcccatatgggtgtgttccgtttttggaggcgtaccaagtcggcggagcttgcgtccgtcattatggaagacacgcttgctttgatcggcttggcattcgcaggggctggcatcggtcttgcgattctgtttgataatgagatatttgatgcattcggcggtttgatggttggtcttgtattgattgcgggatcgttgctgctcatgttcaaatccggttcgctgttgattggtgaggccgtcgattcggatacgcgcaagaagattgagcaggctgttatttcaacgcctggtgtggaacgactgctgaatatgcagaccgtgcatatgtccgaggatgacattctgctgtgcgtcaaggtgcagaccagcaagctcgaccgcgattacgatgttgaaaccgtgaacaaaatcgaacgaagcgtgcgtaccgcgctgccgtggttccgtttcgaaatctacgtagagcccgacctctaccgcgccgaccacaaaatcgtctcgtagtggtgtgcggtgtacctatggttatgagacgtagagtatgaggcgacgatacggttttcaggaggagctggcattccgatgagttcggagtgccagctcctccttttcatgtgctttcttgttatgcgtctccttgagcccatacatatgcatcctttccaacatccgagctttagcctcatcaacctcggcgcgagtaatgccgctatccagtatgaactgctcaatgctatagctcattacatttcctttcgtatgattcctctaatctaatggattacccccatatctaatagatcgtaaaacccgttttcttgaagcaaaggcgtctaggtggaggtatgtctcggatgcgattggtttgtttatctcgagatgtgagacacacttaccccccctaaagtggtagggtgggtggtgcattcggggacgcatgcgcccctgtcataacgttccgggagacaggatggagaaaatggagaatatggagaatccgaagaaactggccgttgcgaccatcgcaggcttgaccgaggtggccggtatggccgcgcccgccatggcagatgagacggccgccgatccgatggtgggccagacccagtcggccgatccgacgaaggatgcgctcgacaaggccaacacggccgtatccgaatcccagaccgcttatgataatgcccagcagaatgtgcaggacgctcaatccaaggtggatgatgcgtatgcttccgacccggccacgaatgcggcgcagtccgaactggatgccgcccagtcggctaagaaggatgccgaccagtcggcggctgacgcgcaggccgatgtggatgccgcccaggctgctctggctgaagtgaacgccacgctgaagacagccgaaaccgcattggccacggcgaagtccgacgcggaatccgcgcaggacgcgtacgacaaggcccacaaggttgtcaccccgtcgaaggatacgaccatcacggttgatactccggacagtgcgaacagtgcgaacagtgcgaacagggcggccgtgaagacctccacgcaggccaagcttggcgacacgggcgtggacgtgatggagaccgccgtgtttaccattatggccgccggtaccgccggagccacgctcatgctgaagcgtcgtggtgacggccgttacggtcttatggcacgccacgccaagtaggtttttgccataaaatcctagaaaatgatgtgcggatgggaacgaacgattcccatccgctttttcctaaaacgtatgtgacataactcatcgaaagcacaagtatgcagggaaaactatctgaagtttccaacccgaatataagcgatgccgggtcaaagaatgtaactgaaaacaagaagaagagcagaaagcctgctgtgatcgccgtggcttcggtcgcggccgtggctgtgctggctggtggcggctggttcgtttggaagacctacgcgaaccatgagctggccgaggcgagacaggcgtgtgtggaagcgtcggaaagctaccgcaaggcggcggactcgtattccgggctggtggatggcgacgcggccacagcctcccagatcaccgtgaagcaggtggcggatgcgaagaccgtggatgcgttggccgaagcgttgaaggcgaacgagcctgacgtggtcgcctgcgtggccgattcgaaggcggattacgagtcgaagaccagcctgattgaaaagaacaccggctggtacgggaaacacgagaagagcttggaagaagcggtgaaggccgtgaacgattcgaaactggagaagaccgtttccgatgcggaacggttgttgaagaattcggacggcaaggtcgccgatgcggcgacgcgcgacgaactgtccaaggcagtcaaggccagggatgcggacaagatcgcggccgcgtcgaagaaggtcaacgactcggtgacggcgaagacgaaggcggacgaggaggcgcagcgcaaggccgaggaggaggccgccgcacaggccgccgcacaggcccagacgcagcagtcgtattcggcgccgcaacagtcgtacacgccctcgtattcaggcggttcgacatcgagtggcggcggttccagcagcgtgccggacttcgttccaagcagcggaggtctcggatgcacgacagactgccctccgtcctcaagcgatggattgattcaccactgatttagatgactcttcttctcaagggacccttcggggtccctttttcgtatccgcagccttccgggaaaatgtccaacccgacacgcccgaaaccgtggttgcatagcaggtggatgacggaaacgaatccgatatcgacgtttgtcgacggccgggcatgtgaagtgttcggacgggatttgttctcctgtccgaccccaccgggagtggggtgaacatctgcagatgaatctctgaaaggagacggaacattgggttccaagaacagtaacggaaggcgaaagacgctggccctgctcgccgccacggcgacattggccggaggcctgaccgccggcaccgcctgggcgggcggcggcggagaccagggaggcaccggcggaggcggctcggccgcgcagttctgggcctacaaggacgacgcgacgggctcgtggggttccgcgacggacctgaacagcgtgagccgcgccatggcctggaaaggcgtgaccatggacgattcggccggcaaggccgccaaggcgttgagcgacgcgaacgcggaatgcgtggccggcttccgccagaggcatccgggcgagggcgacggcgattgccgcgtcgtggccgtgggcgcggcgtccggcaacgggtccaccaccagcgtgtggaacgggtccggcgtctacgacgcgaagatatggaaggacaactggtacaagtacgtcgcaccgaacacttacaactacgctggatctcagtcttatcacaccggcgatggcttcagcgatgatccgtcgaacagcgtcgacaagatcatggaacgccatgtcgactcgacccgcagcatcgtcgtgatcgtgctcgacaaataccagcccgccccgccgaactacacgctgagcgtggccacgaaggcatccggcacgaccaccaaggccggcgacacgcagaacgtggcggacacggtcaccaccagccgtaacggcagctcgatcagtgagaacgtgaccggcaccagcacgctccgctgggccggcgtggacggcaccacccacaacacatggaacggtgataccgaagtcaccgccgaaggctactactacgcatccgaggacgaaaccatcctccagcccgtcgcacgcaaagacggcgaaaccgtcgaccagatcaccagcacgctgaggtgactgtgaacgtcccgaatcttccagctactggaagattcttcccgctgacgagcacatgagcgcaccaaattctccagtgggtggaggaatctgcccattaacggttacgatcgcatggtcggcacatgcgagaagaatcagtggcatgactgaagccgcacatgatgattatcagttgcccgaagaattcgaacactgtttgaaacttgcccctgtacgcgatgcgcctagcgcgttggaccgtgtcaagcaggtcgtacgcattctgcacgaaccaggcggatgcccttgggacggcgagcagaccaacacgagtctgcttaagccgctattggaagaaacctacgaatacatcgacgccgtggaaacgaacgatcgcgacaacatgcgtgaagaactcggcgacatgctgctgcaatccgttttccaagcgcaagtgtgtgccgtggatgcgcaggatccgttcggcatcgacgaagtgtgcaatcgtctcgtcgacaagctcatcacccgacatccgcacgtcttccaatcagacgacgctaccgacgcttccgcgccagcaccggaaaatgcgcaagatacgttgaaactgtgggaagcgatgaaacagaaggaaaagcatcgcaagtccatgctcgaaggcatctcccacgcgcaaggcgcattgccgcgcgccacgaaaatcgtatcgagagtacacaaatcgcagtattgcgatcagcttgaaacagcattcacaacaagcgcaagtcaaatggacgaacagcatgatggcgatcatccttacgctgacgaaatcatcgccatcatccgcaaagcgcaacgtgacggcgtagacgtggaatccgacctgcgttgccgcctgcgcgacatagaatccgaaatcgaacatatcgaaaggaccatgaaccatgagtgacgtcaaagcactcgaccctgcgctgctcaaacagtattccacagacttcaacgctgaccgcgccaatctggtggcagccaacgcggcagtatcatccggtgtgctcgccgcagccaccgactataagggcgagcgcgtgctgcagaatgatttctccatcgagctgaagcaggggagtatcaccaatcagcgtagttcggggcgttgttggatgtttgcggcgcttaatacgttgcgttatgagttgatgcatcgttggaatttggaggatttcgagttttcggaaacctacctgtttttctgggatgcgatggagaagtcgaacacgtatttggagaatgtgcttgccacgttggatgagccgctggatagtcgtgtgttcgaggcgattaattatggtccggccgatgatggtggttggtggcagatgttcgctgatttggtgaacaagtatggtttggtgccgaagagtgcttatccggagtcggctaattcgaagagttcggatgcgttcaagcagtatttgaatacgaagctacgtgagttcgcgtccgatttgcgtgaccgtcatacagctggaacgtcgttggatgagttgcgtgcgttgaagaatgcggatatggctacggtgtatcgcatgtgtgcgattgcattgggtgagcctccggagcgttttgattttcttgcgcgtacgagcgatgacaaggatgacggcaagaagaaaaccacgggggaggggccgtctgaaaaggctgcgaaaaccggtaaggatgagcgtccgcagattcgtgaattcggtatcactccgatggagttttataagaagtacgtgccggtggatgtgaacgatctggtcacgctatgcaatgtgccgatggagagtcgtccgtttggcaagcggtatcgtattcgtttttccgccaatgtggcggaagcgggtgatatggagtttgtgaacgtgcctcttgacgtgttcaagaaggctgctgtggaccagatcagtgacggtcatccgatttggttcgcttgtgattgcatgcagttctcgttgcgtggcgatggctattttgattgcgataccgtgcgcgttgaccagcttttcggtacgaaattcacgttcgacaaggccaagggattggagtatggcgattgcccaagcaatcatgccatgacgttgactggcgtgaatttggatgctgacgggcgtccgaaccgttggaaggtggagaacagttggggcaaggataatggtcaggatggctattatgtggcgtccgatgcttggttcgaccgttatgttaccgaactgatcattcgcaaggagtatctcgatgagaccacacgcgaaatactggccgatcagccggtcgagcttgaaccttgggagccgctcaccaagcgaagccggtgaaggcttgcgcatatcgcgcatgattcggtttgattgcaataaggaatgagataaacagtggagggcgtcgattgacagattcggcgccctccacttattgcagtatttagtcattatttaattgctattcggcagtaccaaggcatgcttcgaaggaacggcgggtgaggcgtccacggttgacgacgcccacgagcttgccttgttcaaccaccggcactttcttgtactgctgatagccgaacatctggcagacttgcgcgatattggcatccgattgcacagtgacggccggctttgcggcaataaccatgacgttcatatcaagcagttctgcgtgagacagttccgggaattcgccgcgggccatgccagtgaccagcgtggaaatgtcggaaaccggcgcgttgtcttgtgcgaagcggcgcagtacgtcgctatcggagatgaagccgaccacgtggcgttcgtcatcgacgataggcatgccgctgatgttcttttccaacatcatgcgcactgcgtcacgtacctcggcatccgaggctaccgtgtaaacgtcatgctgcatcacatcggcaacggtcttgacatccaaagcgggaacatgctgttgcgcggacttgttccatccggcggcatcgccgatggcgtgaactatcttgccggacaatggtgcgacgatcagcatctgaatcggcaacgcgatggtgaaattgtaggggaacatgcgccagaatcccgtgaacgcgccgaatgtgaaaccgaatgccatgatggcgccgaatacggtcatcagcaccaccatgaggaatttgaccgtgatgcctttccataccgcacggtcggttgccgcgcagaatgtattcataatcgcgcgggagcttggcgtgcagatgcacaaatcgcaaatcatgccgaccacgtaggccaacggccagtcgaacaatgcgtagctccacgccgccgcaccgacgtcaccgatacgtacgccgtaattgagtgccgccatcacataaatcatgatcgcggacatgatgaaactgaagagaatgccctccttgccgttacgtggcatggaacttcctttcgctatgcgttcgatgtgttgctgcatcggcccctctggtctgttccgcacgtcatgttccaacaggagcgcggaaggctagggggcgcataacgaaatccgaaaaggttcggacgatcgcaatggcgacttcctggcaaacgaatcgactcaagccctcaatgggcatgcaagatgcgattcatgagtcggggccgcttgcaaatcacagattgttcgcagaccccaagacaaatacggaaataccgaacgtgctcgaaacgcatgtggaaagaaaaagccggacgttttcgcgtccggcataaatacaatccgaataaaactcgaattactcggcttactcttcggcgaccaattccagataggaatcgttccacaggtcttcgtcgccgtcaggcatgagcagcacacgttcagggttcaatgcctgcaccgcaccctcatcgtgggtgacgagcacaatggcaccctcatacttggcgatggccttgagaatctcatcgcgtgaggccggatcaagattgttggtcggttcgtcaagcagcagcacgttcgcacggctcgtcaccaatgtcgccaacgccaagcgggtcttttcgccaccggaaagcacgcgagccggcttcaacgcatcatccccggaaaacaggaacgagccgagaatcgaacgcgcctgcgtatcattcagttccggagccacatgaatgaggttttccaacactgtggcattcaggtcaagcgtgtcatgttcctgcgcgaaatagccgattttacagccgtgaccgtagtccacggaaccggtgtccggctcttccaaatgcgcgagcagacgcagggtggtggtcttaccagcaccgttgtatcccaaaatcaccacacgcgagcccttgtcaatagccagattcacgccggcgaatacaatgttcgaaccatacgctttcgacacatccttcgccatgatcggcgtgcgaccgcacggagccggctccgggaaccggatatccgccactttctcctgcttttgcgcttcggacgtgttctcgagaagtttctccgcacgacgcatcatgttctgcgcggccacggccttggtcgccttcgcatgcaggcggataccctgctgcatgaggcgttccgccttcttctcggccacttcacgttcgcgacggcgacgttcctcatcaaccacgcgctgatgcaggtaggctttccaaccaagggaatacatgtcgatctgtccgagctgcgcatccagatgccataccttgttcaccacttcgtccaacagttcggtggagtgggagatgaccaggaatccaccctcgtatttcttcaggtatccgcgtaaccattcgatggagtcggcgtccaaatggttggtcggctcgtcaaggattagcgtatccgcgtcagagaacaggatgcgggccaattcgatacgacgacgctggccgccggaaagcgtacccaattgctggcccatgacctcctgcggcaggccaaggcttgccgccatcgcagttgcctcggactgtgccgcatagccgccggccttttcgaaatcctgcatggccttgtcgtaacggttcatcgctcgggtcatgacgtccggatccggatcggtcatctccttttcggccttgcggatacgactgatgatggaagcgatgtctcgcgcgctcatcatgcggtcgagcgcggtctgttccggatcggcagcatgcgtgtcctgcggcagatagccgagcttgcccgatacacgcactttgccggcggtgggcagcatgtcgccggtgatcacgcgggtgagcgtggtcttgccggcgccgttacgtccgaccagaccgatcttgtcgcccttggcgacgtggaaattcgtgggatgcagcaacgtgcgcgcgccgatctgaatctcaagctcctgcgcttcaattgccatgcctcaacacctctgcactttcgttactgtcgttccaaactggctgtgccgcacataacggcctgcccatcatttcataaggccaaacgccaatcgaacatcataccgaacgcctgtaaccacgtgaatcccaccgcgtggtacgcaatcgcaaatggaatagattgcgcggaagcgtaacaatcagattattctggtgagcaggcaaattcggaagggagcaaacatgaagaaagctttgatcattgtggatgtgcagccgacattttgcgaaggcggcgaactgggtgtagccggtggcaatgccgtcgcggaacgtatcgcggattacgtgaatgcgcatcgcggcgagtacgaatacatcgcaaccacgcaggattggcatatcgagcccggctcacactggtcggagcaacccgactatgtggatacgtggcccgtgcacggcaaggccggcactcccggcgccgaacttcatccagcgatcgccgcgctgcatgtagagcatcatttcaagaagggacagtattcgccgtcatattcggggttcgaaggatacgaggataatacggattcgattccttcccgcgaacaggtcgcctctgacatggctacagggcgtacgcttgtcgttgcattggaatccgcgggtatcgaatgcgtcgacgtggttggcttggccgaatcgcactgtgtcaaggaaaccgcgctggacgcccgtaagcttggacttgaagtgcatgtcatcgaaaacctgaccgaaccggtcagtgaagaactcggcatcgcagcccgccagcaaatgctctccgccggcgtcatcctcgactagtttcttgaggaatgggacaacgaatggagaagggattgttcagcaggcgtgtttatgaggtggtgcggcgcattccgaagggtaaagtcgccacctatgggcaggttgcggctttggccggagcgccacgcaacgcgcgttttgtcggctatgccctgcattcgaatcctgagccgggtgtgattccatgtcatcgtgtggtgttccgagacggctcgttggcacccggattcgcgttcggcggtccggaaagacagcggcttctgctcgaagaggaaggcgttgtcttcatctctccgaaaggtatgcccgaactaagcgagtcaggcaagatgaaagactcgaacgccggagcttccggactgcgagtcgatctcgcccgttgtcagtgggacgcctagtcgctttcaatccgtgtcaaccgcttacgcccccaacgacatttgctttatccgccgtggttggataatgggtgcctgccataaggcgaagaaagcaacggggacgcaaaggtggaacggcaaggcatgtggcaacaggacgcaccaggggcgatatcggtcggaatgccggttgtatcgttggcaccggctccgcgaaccatggcataacatcggcttaagtcgttggaaaatagcgcgacacgccgcgatttgcggagttggcatgcttcatgtatattttctactcgttgcccaccacggtggaaacaacttgcggacatagcttagttggtaaagcgcaaccttgccaaggttgagaccgcgggttcgagtcccgttgtccgctccattcgaaagcttccggaaggaagcttttttcatatccgaccgcaaatccgggcgtcatcctcaattcatcccgaccgaaatccgaactggaatcctcctctgttgagaaaacgtttgaccacaatgtgaacgttctcttgaaaagagataatccatgcgagaggctaggagaagttccgccaaaacaggcaacgatgccgggggagagcggaacggacggaggcaaaacaaatgaacgagaacagcgacattattttcgtgccggacgattccgccagccacgagtggacggaacgggacagcgaactcgtagaggagtatgcggcccagcttatgagcatgagcatctagccggaaattagatggggccgggttccctcttccatgacaggaaaagacgtcgcattcgtactgtaactgcggcgtcttttccttgttttcgtttagaatggagacttgccgccaaggcatcgaacacatggaaaggcgtattgttggctgagatcagacgggagatggaacggcttcgacccgtatacgaaaccggtgtcctacggttgctgctgcgtaacaattccatgctgtacgtcgcgttgttgcgttccacgttcgacccgctgacgggggagctgccgcgcgaaatcgtcgaagaacggttcgcgcgcagtctcaaccggctcatcgaaaccggcgattacacgctgaaagacgggcagactgcgcgcgaggccgcgcattcggtcctgcttgacctcgcccgcgaaggggaaggcgactacgcctggctcgccaattccatggacgtggcctcgcaccgctacctgtaccgtctcacagcgcgagcgcaccgtgccatcgaagcgctcgaccggcttgaggacaccacgaaagcgctgtccggcgcgcaggccaacagcatcatcatggaaatcgagcatgctcgcatgcagttgaccgccgatccgcgcgaacgcatccgcctgctgaagagggacattgaggaacggcagaaggaaatcgacgagctggaacatagcgaggccttggaaaagctcacgtccgaacaggtcggcgacatcatcggcgtgattcacaacactctgcgaggagtgcccatcgacctgcgcgagctcgccctttccgaacgggacaacggcgacgcgctccgacggcgcatgcaggccggcgccatgagcgtggaaagcatcctcaccgcataccatgacgaataccgacgtgcgttccgcgaatccgacagcggacgtcgtttcgaagacgcgttccaagtcatcgtcaccgacgaaggccggcgcgagatcgacgacgcggtgcgggacatcgccagaaacccctatttggatggcgagccgagcgtgctgctcaaccaggtgcgttccgaactcaaacgcatctatgaaggcatcgaggacgtgcgccggcagatccgcacgtccgacgaggcggtcagccgtctcgtacgccagcagaccgacacgagctaccggaccatgctcgccaaactcaaccagctgttcgcaaagaccagcgccgaagccaaagcccatcccaatgaccaaagccggccctaccatacggacgccgggcaggcgaaattcccgacattgccatctcgtccggccagatcaatggcgcgcgccgcatcatccagcctgaacgacgccccagcggcgaccatcgaagcgccggacctcaagaacatggtcgaaatatgcgggccgcggctgacgcgcatgatcaggcttatccgcagcaatccggtgacgacatcggacggcatgttcgtggacctcgcggcaagcttcaaccagctgccgaaagccgaacggagggaaagcgaactggtcggcttccttagcgccctgcgcacgcaggacgactcgtcatacgtgacatggcgctgcatatcgatcgacggcagcgaacgcgtatggcgcaccaaacccattctcatcaccgaaacgacgctcgacgacatcatcgaggagagataagcatgacggactatatcgaagccaacatcgaggaaacgatcctgacagaaggggagccggtattggaagaggccggcagccagcaggcctcgaccgcgctgttcaacggcgacaccggcgacatgcccgtcgaagcgcgcatggccgcgatcgcgctcaaacgcgaacgctacatcgacggcagcctgtatgacctcgcctgcgagaaccgtgaggtcgtggaacgttcgctcaacaacgacatgctcagactggtcgacaacacgaaataccgcatcatgtacgcgtcgccggtcaccgactcggagacatgcatccgttcgttgaaaacacgtatgagcctcacccgcgaggaggccgccacgcttgccgcgctacgcatcaaagcgttggaatacgaaaaccagaacgccgaaccatgcgactggcttatcagcttcgacgacatccgcgcattgctcgccaccggcgcgggattcctcaccgccagcaacgacgaggaaggcactgcgaagaaaatcacgtccatcatctcacgcatgcgcacctacgggtatctcgcgccgatcgaagacgacgacatgtacgtcctcacgccactggtgcccatggtgctcgaccgcggcctcgccgaccagtggctcggatccgaaaccacggacgagaacgcattcgccgacggccgcaccaacgccggcccggacgacaggcccatggaagacatagaacaagacgcattcgatttcaacaccgacgacaaccgtttcgacgaggaggaacactgatggcagacggcatgaagatcgtttccgacaagtggatgctacaaagccgacaaatcgtcaactggggctcatacggcggctggcacgaattccgcccatccatggacgaaaccatgccggtgaccctgctcgccggcgccagcgaatcaggcaaatccacactcgtcgacgcgcaaatctcactcctctacccatccggaaccccctacaacaaggcgtcgaactccggacgttcggaacgcaacgactacacctacctgcgtggcatgatcggcgtaagcgatagcgaaaacggcgaaacgccgatcttcctgcgcggcaaagacgccgacggcaccccacagaacatctggggcgcaatcgtcgacacctacgtgaacaaaaccgacggaggactgctctcctgcggcaaattcctctacctgaacgccggagacggacaagacggactacgccgccgctacatcacctggaaccgaaccatcgacccacgactcatggaccagtaccgcaacacaccattcacccggtccatgttcgaaaaaacctatccggaatgcaccacgcacaccaacgccgcggcattccacgcctccatctggcaggacatgggcctaagcgccgacgcctgccgcctcctgcacaaaatacaatcggcggacgccccctcaaaactcgacgacatcttcaagcaaggcgtgctcgacatacccgaatccatccgcctcgcccacgaaaccgtcgacgactacaaccggttcaacgaaaacttccacagcatggaagacaaaatggcccgcgtcgccatcctgcaaaacatccagacacgctacggcgaatacgcaaagcaaaccaccgaacgacgcgaatacgaacccatcaaccccgacagcgaacatggcaacgcaacactgtccgcatgggcgcgctcgcgcatggccagcgaagtgcgcgctggtctgccggccgcgcagcgcaaggtcaaggagtcgcaggaggccatcgatcgggcgatgcagcgcgtcggcgagctcaacacgcgaatcgacgccgtcaaggaacgtatccaaggcatcgacggcggcagtctgcagcagctcggcaaggatcttcaacgcgtgcgccaggacatcgacgaggcgagcaggcaacgtcatgccatagccgaacgattcgaacaggtcgaaggcaggcttcccgacagcgagcagacatgggacgccaaacgcgccatgctcgccgaaacgctcgacacatacgaggaacggttgaaggacgcgaacgccagattccagcagctggtaggggagcgtcacgaccgccagcgcgaccgtgacagcctacgacgggactatcagcgcaaactcacgcacaggacgcgcatcagcgatgacatggacgacgcgcgcacgcttatcatgcgggcgaccggattggacgcgtccgaactgccgtatgtggccgaactgatggacgtgaacgaacaggacgaacagtggcgtctggcaatgaacgtcacctacgcgcccatcgcgcagaccatcctcgtcgacaaacgccacgagcaaggattcgcggcgaaaatcagcgccatcgacccgaaactcatgacacgacgcacgtggcggttcatcgacaccggcatgcaatacgaatcctctgccagcgaaggctggatgtcgtcgaaactgcaataccgggaggactctccgttcgccggatggctgaaaaaccagacgacgtcgccacggttcgacgcgcgttgcgtgcacgccatcgacgacatgaaccatgacgaacgacaagtgcaggccgacggacaaatcaaatccggcgaccgtggattccacggcagcaaaggactacaccaggtcatcggcttcatgaacgaacaatacctggccgaactgaaaaaccaactcgacaaggcggagcaggcgttgcagaacgccgaccgtcgaagcgaacaaatgtccaacgccatcagcctgctgcaagacgagcacgagctcgcacgaatcgtagccgacatgccatggagcaaaatcgacgtgaacggactacgggaacaggaaacgcgaatccgcaggcagatcgaacgcatcgaaaacgacccggaactcggccaactgcaaaccgaactgaaacagctcaaccaacaggccaccgccgaaaacagaaaccagtaccaagccgaagacgacctcgacaaggcccaacacgccgtccaagccgaacaagcatggctcgacgcctacggcaacgacgacttcgacgatgccacactatccagcatggtatcgaacctactcgccgacgcatacgagaactgcttcggcgcatccgtacgcgcgcaagaccggccaaaactcatcgcaggcctcttcgaccatgaaagcgaaacaccattccacgcgcgcgcgctacgcaacatcgcacgcatcgcacgcacacgaatccaagaaatcgacgccagatccaaccaactgcgcgccgacacggaacgcatcatggacgactacctcaacaaccactccacagatgacaacaccgtcatggcaagcgtggaagactaccgatacttcctcgacgaactcgacgaactcaacatgctcgtcacccgcgccgcaaccgacgaagaatacgccaacagcgtcaaaaaactctacatgagcttccaacagctcaaccgcgcgctacgcaccgacgaagaaaacatcaaagaacaactcaaccgcatcaacagcatgctcaaaggacaacaattcggcccacaaggcggcagactatcactcgacgtgaccttcagcccaatcgaccgacaattcgaaacaaccctcagccgcatcctgtcaaaactggaagactggacgcgcaacgcaagcgacaatcccacggaaacacgcaaagcattcaacaactgcgaaacattcgtgaacagactgcacaacgaactcgacaaaatacacgacaccaacggcatcaaagcatacggcgcacgcaacctcgacccacgcgtacgcagctcattctacgcaatcgtgcaccacgacaacgcccccgacgaacgcatcagctccaccggcggaaaatccggcggagccctccaagaactcacctcattcgtctacggcgcggccctcatctacctcctcggcggcgacctcaccgcacgccccacctacaccacgctcttcctcgacgaagcactcatcaaagccgacggccgctacaccaaacgcgcgctcgccgtactaccccgactcggcttccaaatcatcgtctccgccccggaaagcaaaaccgcggaaatcctcaacgtcgccaacagagcatacgtcgcatacaaagacccatccaccggcaactcatacctacaggaactcgacagcgaaaccatcacacaggacgaaacacagcccaccaccgcacccgcgaaaccaacaacggaggcataacccatggcaacggccagaagcaccaccaacagcgacatccacagccaactcaacggatacgtcaccgactatctcaccaagcacatgtatgacgccaacacctcctggccattgcgcaaaaccatccgactacccaaacaagccgaactcgaagcccattacacgcacatccgcgcccaagacgaagccatccgcaactgggcacaacaacaccactgcgaaaccagcgaaaaaaccaaaatcatctccaacggaatcgtccgacaaaccagccaactcatcgactcggtaaccatacccgacctcaacacggccctcaacatcaccacaccacaaacacgcaaactctaccaacgcgaacaccaacgcgcacacaccatcaccaaccaattcaacctcgactccaacacctccataaacatcgccaaaatcctcaaaaaccacgacgacaccgacttcaacctcgtcatacaagccgcacactacttcgccaaccacaacaccgaaaacatgaccccacgcatggtccccatccccggattcagcgcaaaatggctaggcaaaacaacatcaaaccgctgcaaagcaatctgcaaactcctcaaacgagaacaactagccctcaacgaccgccacggagaaatccgactccgactcctcgacacacaacaccacaaccaaccagacctcatcgtgacacaaccatggacagacggcgcgccacacgacatcacccacatcatcatcgtggaaaacaaagacacctaccaagccatacccacaacagaacacgccatctgcatattcggcagcggacacgcggcgacccgaatcaaaacactactaccttggatcacaaccacaccccacatcatctactggggagacatagacgcagacggcctcgaaatactctccgaactacgacaaaccggcatcacctgcgactccatactcatggacagcacagcatacaaaacatacgaaccatacggcaccaaactcgacaccaaaaaacaacccctcaaaacacgcgaccccaaaccaacaccaggactcacacaacacgaaagaaacttatacgaacaactctgcaccgggaaaaacacaacctacctacgaatcgaacaagaacgcatccccatcaacgacgcaatgacaatactccacaaccaacaccaatggaacacaacacaccacaaatagaacacctgttcgaaatcataacgaaaatgaggtatcctaaacaactagaacaaagaacaaccaccagcggaggcaagccgtggcaaccaaacgcaacaacgcagcaaacggcgacgtcatagtcgaacgcgttctcaccagcgacgcattcctcgcaagagaaatcaaaaaagcccctctcaaaacgaaaaacggttcacttacagccgacctcaagcacctgcccaacgacctcaaaatcaccatccaaggcgctcgcgagcataatctgaagaacgtggatcttgagtttccgcgcaatcgcatggtggtgttcaccggactgtcgggttctggcaaatcctcgctcgccttcgatacgttattcgccgaaggccaacgcagatatgtggagtcgctgtcggcgtacgcaaggcagttcctggggcaaatggacaagcccgacgtcgatttcatcgaaggtttgagccctgcggtgtcgatcgatcagaagaccacgaaccgcaatccacgttcgactgtcggcacgattaccgagatttacgattatctgagattgctgtttgcccgcactggcattccgcattgcccggaatgcggcgcgttggtcagcgcacagacgccgcaacagatggtggacgcgttgctgcagtatccggagcgcacacgattccagattctcgcgccggtcgtccgtgggcgtaagggcgagttcgaggatctgcttgaactcttgcggggcgacggctacgcacgagcgctgattgacggcgaaatgaagcagctgtccgacgacatcaaactcaccaagcagaaaaagcacaccatcgaagtggtggtggatcgactggtggtcaaggacggcatccgtcagcgtctgaccgattccattgaaaccgcattgaagctcgccaagggtatcgtggtggccgattttgtggatttggatgagaaggatcctgaccgccgtaagcctttttccgaaaaacgcgcatgcccgaacgggcatcagcttgaacttgatgagattgagccgcgcacgttctcgttcaacgccccgtacggtgcctgcccggtatgcacgggcatcggatacaagctggagattgatccggaactggtgattcccgatcccagcaagacactgaatgagaacgccatcgaaccgtggggcatgaccaaaggcaccggcgaatattatcgccatgtgcttgaggggctcggcgatgagatgggtttcgatctcgacaccccttggaaggatcttccggaagaggcccgtcaagccattatgtatgggcgtgatttcaaggtgcaggtctcgtatcgtaaccgttggggtcgtatgcgcgaatattccaccggtttcgaaggcgtggtgcgtacgctgatgcgtaggcatgacgagaccgactccgatcagatgaagcagtattacgaatcgtatatgcgtgaagtaccttgtcaggcatgccaaggccgtaggcttcgtccggaagtgctggcggtgaccgttggcggggaatccattgccgatgtgtgcgacatgtccgctgagacaagcctcgcatggatggacggcttgcagcttgaagggtcggccgcgcagatcgccggcgaggtgttgaaggagattcgtgcccgtcttggattcctcaacgacgtcggactgaactatctgacactgtctcgtgccgccaaaaccttgtctggcggcgaggcgcaacgtattcgtttggcgacccagatcggttccggtttggtgggcgtgatgtatgtgctcgacgaaccatccatcggcttgcaccagcgtgacaatgagcggctgatcaccactctgcatcatctgcgcgatcttggcaacacgctgatcgttgtggagcatgacgaagacactatcaagaacgctgattgggttattgacatcggacctggagctggcgagcatggcggcgaagtgatctattccggtcccgcgaaaaagctcgttgacgctccgcgttcggttacgggcgactacattgccggccgccgaaagatcgaggtcccgcagtcccgtcgcaaagtacgtaagaccaagcagttgcgcgtggttggagcccgcgaaaacaatctgaaggatttgacggtcaacttcccactgggagtattcacttgcgtgacgggtgtttcgggttccggtaaatccactttggtcaatcagattctgtacccggtgcttgccgacaaacttaacggtgcgcgcatcgtgcccggcaagcatacccgtgtggaaggtgtgggccagtgcgacaaagtgatccacgttgaccagaatccgatcggacgcactccacgttccaatccggccacctataccggagtatgggataagatccgcacgctgttcgccaaaacccctgaagcgcaagtccgtggatacggtccggggcggttctcgttcaatgtcaagggtggccggtgcgaagcatgccatggcgacggcactttgaagatcgaaatgaacttcctgccggacgtgtatgtggactgtgaggaatgccatggcaaacgctacaaccgcgaaacgttggaggtgaaatacaatggcaaatccgttgccgacgtgcttggcatgccgatcgaagaggctgcccagttcttcaaagcgtatccctccatctcccgctatctcgacacgcttgtgcaggtcggacttgggtatatccgactcggacagcctgctccaacgctttccggcggcgaatcgcagcgtgtgaagcttgcgaccgagttgcagcgaaggtctacgggcaaaaccgtgtatattcttgacgaacctaccacgggtttgcattttgaagatgtgcgcaaactgctgcttgtcttgcagggattggtggataagggcaataccgttattgtcattgaacacaatctcgatgtggtcaagtcggccgattggatcatcgaccttgggccggaaggcggtgacggaggcggcaccatcgttaccgaaggtacgccggaacaggtggctcaatgcgaacagtcttggaccggcaagttccttaagggcatgctgtgagcgcacccatcgagcggcacagccaggaggtttggcgcaaaaccgccgaacagttgaacggcgacggtttcagtgtcggtggtgatgattctcccggcaaagacgtaaacaagaacggcgcgctgggggattcacgtgacctgtttcgtccgaaaacatccgacattccggcgcagccgggcgtatacaagtggcgagatggtgaaggcagggtcatttacgtaggcaaggcgaaaaacctgcgcaaccgtttgaccaattatttccaaccgttgtatcagctgcatccccgcactcaaaccatggtattgacggcccgtaacctggaatggacggtcgttggtaccgaacttgagtcattgacgttggaatacacgtggatcaaagagtttgacccacgattcaacgttgtgttccgcgacgacaaaacctatccgtatctggcgatctcatccggtgaacgcgtgccgcgggtgtgggtgaccagaagccgcaaacgccgcgatacaagatatttcggcccgtacgccaaagtatgggatctgcgtcacagtctcgaccgtctcctcaagacttttcctgtgcgcacctgttcgcagaacgtttatcataaggcggaaatcactcatcgtccatgcttgcttgcgtccatcggcaaatgttcggccccttgcattggacgtatcagcgtcgaggaacaccggaagatgtgcgaacagcttattggcgtattaaccggtcgcatcggcaaatcgtatatcgcacagctcacgcgtgaaatgaaggaggccagcgacgagttggagttcgagaaagcggctcggttgcgcgatcagatccagatgctatccacagtgggtgagcagaatgccgtggtgttcgattccgatgtcgatgcggatttcttcggcgtcgattcggacgagctggaagcttccgtgcacgcgttttacgtgcgtgccggttccatccgaggtgaacgcaattggagtgtggaacgggttgaggatgtgacggatgaggagctgattgccgaccttattgtgcaggtgtattcggaaaccgcaggggagacgattagggcttcgcagtcgactgttgtcaccgaacaacgcaatgccatcggatcgacgcaaatcgtgacggcgaccgatgcggtggcacgcgcgcaagctaccagggaacgtaacgagcggcaggatcagaccggtcgtgcggatttgttggctcctatctctccggtgccgcgcgaggtgattgttcccatcgagccggcccggcgtgaagagcttgaatcatggcttagcggattgcgcggtggtgccgtgagcattcgcgtggccagcagaggggataagagacggcttctggaccgtgccaacgataatgccaagcaggcaatgcagcgcagcaagatgagtcgcatcagcgatatgggcgcccgcagcacagccatgaatgatgttgccaaggctttgggacttgaacaggctccattgcgcatcgaatgctacgacatttccaataccgtcggcggagcgttccaggtcgcttccatggtggtattcgaggacgcgattgccaaaaagtccgaatatcgtcgtttcgccattcgcggagcggacggacagggtgcactcgacgatttgagcgcattgtacgagacgctgacgcgacgattccaacatggcaatatcgccggtgactccggcgaaagcatggataatgaacgtcgggcatccgagcatggtgaccagactcatgaaccgactgtccagcagaacaccaatcggcatcatttcgcatacaagcctaatctggtggtggtcgatggcggcaaaccgcaggtcatggcggccgcgaaggcgcttgaggattgcggtgtggatgacgtggccgtgtgcggattggcaaaacgtttggaagaggtgtgggtgccggatgacgactatccgatcattctcaaacgtcaatccgaaggcatgtatctactgcaacgcgtccgcgacgaatcgcatcgttttgccatcacctatcatcgtcagaccagaaggaaaggcgcgttgcgttccgccttggacgatattccaggcgtcggcgaggcataccagaagcgcctactgagccatttcggctcggttcgtgccatgcgtgaggcggatgtcgaggatttcgagcaggtcaaaggcgtcggaaaagccaaagccgcagccatttaccaagcgttgcacgcccacgacgggcaaccgtcgacggaaaatgccatttcgtcgaatagtccgaaagatgaaatggaataagattgggtagcgaaaaaagacaatcggattgctagcatgatgacggtgaatatatagggagggaatatgaccgaggtcaaccaccggtgcgcggttctgggcaagcccatcgcacattcattgtctccggtgctgcacaatgccgcttatcacgcgttgcatcttgacgactggtcgtacgacaagcatgaggtgggcgagcctgatcttgagggctttcttgaatcgcttgatccgacctggtcgggactcagcctgaccatgccattgaagaaaacgatccagccatacggaacaccgtgcaatacatgggccaaagagcttatggttgccaataccgcggtgtttgattggaccaaaacctgcgtcaatggcaattcgaacatccccttcatcaggctatataacacggacgtacgcggcatcgaactcgctttcgaacactcgtatcagacacgtgcgataacgccgaagacggaccgttctggaacggccgtgatcatcggcaacggcaacaccgcaacgtcggcgttagcggcatgcgtggagatgtctgcgatcggacatgtcatcgttgtggctcgccatcctgagaagaacgccgatctcaagccacttgccgaacggtatatgccatcggaacagccgatcagcattgtcggcatggaccacgccatcgaagcgttgcgccaggctgatgtggcgataaacaccattcccggattggctgcggacggtattgccgaatcattgagaatgccaggtgtgcgcatgcatggaacattgctcgacgtcgtatatgacccacgccctaccaagctgatgcaggcatggcgccaacagggaggaatcgccattggcggcgagcagatgctgttgtatcaggccatggtgcaggtctggttgatgacgggaatctgggatgacgatccgccgagcggtatggttgatcaggattgcaccgcgcgtttggaacaagccatgcgcatcgcgcttgaggaggctctgtgatggcacagaaagacatcgacgtacaggcgaatggcacgcatgccagcgccccttcgccggctgaaggttttgaagtattgctgatcaccggcatgagcggtgcgggccgttcgcatgctgccgacagcattgaagacatgggttggtatgtggttgacaacatgcctccaaaactgctggtgcccttggtggacatgatgaccacgggatccaatattcacaaactcgccgctgttgtcgacgtgcgttcccgcgactatttcgatgacctgtccgcggtgctcagccatctggacgatcttggtgtgaaaacgcgtatcctgttccttgatgccagcaacgaggtgctgatcaaacgatatgaatccgtacgcaggcctcatccgttgcagcagggcaatcgactgattgacggcattctcgaggaacgagatctgcttgagaatctcaaagaacgtgcggacatcgttatcgacacgtcatcattgagtatccatcagctgtccacgaaattatatgaggccatgctcggatccggtccgaccacggtttccgtgcacatcttcagtttcggtttcaaatacggtattcccatcgacgccgactttgtggccgacgtgagattcctgccgaatccattttgggttcccaggcttcgctcgctgactggacgcgacaaagaggtgagtgattacgtactttccagcgaaggggccgcggacttcctcgactcgtatgaaaaggcgctttcgattgcgattgaaggatatgcgcaggaagataagcattatgtgactattgcgattggttgcaccggaggccagcatcgttctgtcgcgatgagtgaggctttggctaagcgactgcgtgcgagggggttgtcggtttccgtttccgcacgcgagcttgataagcggtcagcggaaaaatgaccgtattatgagagaatagtgtccatatgtaaagaaacctggctgtgattgtccaagatattcggtatcacagtaagccgtggcagtgcggaatgattccgcgactcgcctgaaatttagggaagaacagcaaggtaggaggttggctcttggctcttctggatgacgtcaaaagcgagctggccgcaatcgataacgaactgccgatcgccaaaaaggcgcaggcgacagcgatgattcgattcggcaatggtttgcactcggtggatcaccacattctcgtgcaggtgcagctcgactcccaagatgcggctgcttggctgcaggacaccatcaagaacctgtatggtcatgaagccacgcttactcctgtctctaggcagacgccaaccggcaccgtgcagcgttatgtgattcgcgtgccgaagggcagtacggcgctcgtgctgcagaccggcctgtacagccgttacaccaagaacatggtgcttggtcttccaagcgatatcatcaacggcaaaatcgcgcagatcaagtccgcatggcgcggcgcgttcctcgccaacggacgtctgtccgatccaggcaaggccagctatcttgaaatcgtgtgcccgaaccatgaggccgctctggcactggtctccaccgcacggcgtctgggcatcaccgccaagccgcgtaagctacgcagctccgaacgcgtcaccctgcgcgatcccgacgccatcgaacgtatgctcattcttatgggtgcgccgcgctccgcacgcgagtggaccggaaagcgttccgacggcgaagctcggggcaaagccaaccgtctggccaacttcgacgacgccaacatgcgtcgcagcgccaaggcggctgcggaagcatgcgacaaggttcgtcaggcgtttgagattcttggagatgacattccagacaacctcaaatcggccggccagcttcgtctcgaccatgctgatgcgtcgctggaacagctgggacgtttggccgatccaccaatcaccaaggatgccatcgcgggccgcatccgtcgacttctgcagctcgccgagaaaaccgaaaaggcgcgccgccagtcggcttgattgaatcttttatgcaaaacaccatgcctgttttcgaacagtatggtgtttttgttcgtttgggcttgtattattcgtaaatggcaatatggccattccacgcttacaagcggctaggaaaggatatacatgaagacactcaaggatcttggagatctcaagggcaagcgcgttctcgttcgcgccgatttcaacgttccgctggacggcaccacgatcaccgatgacggtcgtatcaaggccgctctgccgaccattaaggccctgcgcgaagaaggcgcgaaggtcattctgatggctcacctcggccgtccgaagggcaaggtcgttccggaactgtcccttgccccggtcgctgctcgtctcggcgagctgctcggcatcgaggtcccgctggctgaagacacctatggtgaggatgcccaggccaaggtcgccgcaatgggcgacggcgatgtcgttctgctgcagaacgtgcgttacaacccggaagaaaccagcaaggatccggaggagcgcgccgcttatgccaagaagattgctgcgctcggcgaagcgttcgtatccgatggcttcggcgtcgtgcaccgcgcacagggctccaattacgacgttgctgccgatcttccggctgctgccggcctgctggtcgagaaggaagtcaaggctctgtcccgcgctaccgttgagccggaacgcccgctgaccgtcgtgctcggcggttccaaggtctccgacaagctcggtgtgatcgaaaacctgctcgacaaggccaaccgtctggtcattggcggcggcatggtttacaccttcctcaaggccaagggcctcgaggtcggcacctccctgctggaagaggatcaggtcgagaccgtcaaaggctacatcgagcgcgctgagcagaacggcgtcgaactcgtgttgccgaccgatatcgtggtgaacccggtcttcccgaagtccgatgaggacatcgctccggaagtcgtggctgccgacgccattccggctgacaagatgggtctggacatcggtccggattcccagaagctcttccacgacaagatcgtggattccaagaccgtcgtttggaacggcccgatgggcgtgttcgaggttccggctttcgctgccggcaccgaggccgtggcccagggtctggtcgacgctaccgcagctggtgcgttcaccatcgtcggcggcggtgattccgcttccgcagtgcgtaacctcggcttcccggaggatggcttctcgcacatctccaccggtggcggtgcctccctcgagttcctcgagggtaaggaactgccgggcctgaaggtgctcgactgattgcttaacgcataaccggaggtgctcccttatcaacaaaaaaggtgggggagcacctcttgttttcactaacccgaaaccacggcgtacgaacactgaatgaaataagaacggaggcaggcaaacacatggcatcgcaacgaattccactggtcgccggcaattggaagatgaacttcgaccatcttgaagccacctatttcgttcagcagctcgcatggaaacttcgtgacatccatttcgactaccgccattgtgaaatcgcattgatgccgtccttcacatcgttacgcagcgtgcaggtgttggtcgaatccgacaatttgaagattcactacggcgcacaggctgtttccgtaacatcgcagggcgcgttcactggagatgtgtctgccgatatgatcgcccacctcggctgttcgtatgtgattgtcggacattccgaacgacgaaagtaccatccggaagatgatgcgaacatcgtggatcaggtacgcgctgttttggcggccggaatgcagccgattctttgcgtcggcgaaagctacgaggaacgtcgcaaaggcattgagcttgatttcgccgtggggcaggtgcatgacgtcacacgcgatctttccgacgaggaagcgtcgcgtctgattgtggcgtatgagccgatatgggccatcggctccggaatggtggccactccacaatccgctcaggacgcggccaaggcgattcgggatgatttggctgaaactttcggcacgcatgtaggagagtccgtgcgcattctgtatggtggctccgtctcctcaaagaacgccgaagaattgattggcgagcccgatgtggatggattccttatcggcggtgccgcgctgaacgtggatgagctcaccagaatctgccagctcaccatgaatgcgacagtatgatgctcgcggagtaatgtttttatcgagttggcctttcaaggtgtggtcattattcggttttctcaataccttgcgctattgttaacagcagtgtttacgaactggaggttcactcgtgtccgctatggccatcgtcaagcttgtgctgcagattattcttgttattttcagcctcttgctcaccctgttgattctgatgcacaagggtaagggcggcggtctgtccgatatgttcggcggcggtctcacccagaatgcgggttcttccggtgtcgcggaaaagaacctgaatcgttggaccgtcatcatcgcggtgctgtgggttgccatcatcattgccctcggtctgatgacgaagttcgatctcatctgattggctttttgcttcggcccatgactggattacagtcatgggccgaagtgttttttatcgtagtattgtctacaacatacgagctaaggattgatttgacgtctttgaaaatcgagaaaacccaagaaaccacgatggtcgtcgcggatttggacggtactttgctgcatgatggcgaaacgttcgaggaacgttttcttacacaacgttccatcgatgtgattaaccgcatgcacgataatggcgtgaccttcgttgtggaaacggcacgtccggtcagcacaggcttttcgttcgtggaaaaactgccggttgatgccgttgcctatctcaatggagcattgatcgatttcaatccagcctcatcaaattatgaaatgctcacttcgccgatgctgccggaagacggccatctcaagaaaatcggattctcctcacagcgagcatgcgaagtctgcaagaatctgttgaatgaactgcccggtatggaagtcggcattgtcatggatgatgtgagatacaccaatttcgatgttacgaaatattggaaaacacagacctggcgatacactgactttgacgatgttcctgaaggcatcgccgataagctcattatcttccctaacgatgagcagcggaatcaggtcggttctcttgtgcccaacgattttgacgtacatatctctgagggatcgctgtggatgttgatgaatcctcaagccaacaaggagcatgcgttggatttgctggcagaacattttgagacgccgatgagcaataccgtctcattcggtgacgatttggtcgacattgccatgctacgtaaatccggcaggggagtggcggtggcgaacgccaatccggatgtgttgaacatcgcagatgaaatctgtccatctaataatgatgacggtgtggcgcagtggattgaagataatctgctgtgatgtctcgtgatattcaagagttacatgagttgaacttcgtgaattgaacttttgtcgcaaaaggatgcgaaatagttacatttgatattgaacttccgcaatttcgttagttggtttgtgttaggatttgaactagcgcttgatgaaaattgaactgaaaggactagtatggcggaatcgttctccaaccggttgaacgtcgctatggcgttccgcaatgtcaaacaaattgactttgtgcatgctgctgagaagttcaatatcaaacttggcaaaagtcatatgagtcagtacgtgagcggcaaaaccgtgccgcgtgccgatatcgcccattttcttgcggcttttctgcaggtcaatgaggactggctgatgggaaaggacgttcccatggagcagaacgtcgccaccttgcccgcaatcaagtctgatgaagcccaacatgatagcaatcctgcatcagcgcaatcaacagaaggaaagactatgcgcacctttacgaaatctcataagctcgacaatgtgctctacgacgttcgtggtccggtggcggacgaggcagcacgcatggaagccgcgggaacgcatattctgaaactcaatatcggcaatcctgcgccattcggattccggactccggatgaagtcgtgtatgatatggcgcaacagctccctgaaaccgaaggatattcaccgtccaagggtctgttctcggcacgcaaagccatcatgcagtatgcacagctcaagaatattccgaacgtctccatcgatgatatcttcaccggcaatggcgtcagcgagctcatcaacctgtcgctgtccgcgttgctggatgatggcgacgaggtgctggtgccttcgccggactatcctctgtggaccgcctgcgtgaatttggctggcggtaccgccgtgcattacatctgtgatgagggatccgaatggtatcccgatatcgacgatatccgctctaaaatcacggataagaccaaggcaattgtcatcatcaatccaaataatccgaccggagcgctttatccaaaggaactgctgcaacaaatcgtcgacattgcccgagaacatcagctcattattttctccgatgagatttacgatcgtttggtcatggatggactggagcatatttctatcgcatcgctggctccggacctgttctgtgtaacgttctccggtctgtcgaagtcgcatatgattgccggatatcgcattggatggatgatactttccggcaacaagcgtattgcgaaggattacatcgagggcttgaacatgctggcgaacatgcgtatgtgctcgaatgtcccagctcagtcggtggtacagaccgctttgggcgggcatcagagcgtcaaggattacatcaagccaggtggccgtgtgtacgagcagcgcgaactggtctatcagatgctcaatgaaattcccggcgttaccgcagttaagccgaaagcggcgttctatatcttcccgaagctgaacgtcaagaagttcaatattcactccgacgagcagtttgcgttggatctgctgcatgacaagcatattctgatcagtcatggcggtgcattcaactggcagaatccggatcatttcagggtggtatatctgccacgtatcacgatgttaaaggaaaccgtaagtgagatcggtgatttcttgagcacatatcatcaggcatgatgaccttgattgcttgaagggctttcatggtgtgaagtacgcgcagcatcgcgacactccgtccccaaatacttatagtcatactgaccataagtagggctacgatggctccggccttagggccgagccatcgtttcattgtgaaaggggatattgtgaacgatttgctcaaaggaatcggcaacgtcgtcaatccgaagcgtgtgttccgcgagctgactgacttcaagccgggggagtttgtcctgatcgcggtcatgctgttggcgcagttggtgtcattcttcgtgtccaaagattttccgcggcaggttgaattggtctgatttccggcctatgcatcgtgttcaatctcattctcgtcgaccgtgggcgactgaccaactatctgtggggcttcatcggttgcgccacttggctgatcgttgccatcatgaaccatctcgtcggagacatcttcgctcagatcttctacgtcaccatgcagttcgtcggcgtatgggtgtggcagcgccagcttgatcgtcaggaaaaaaacgagtatgaggaagtcaatgcccgcatgttcacatggtggcaaggcattctcgccgtcatcgcaaccatcgtgatctatctgattgtggtattcgtgtcgagccatactggcggtgtacaggttcggcttgacggcacgctgctgccgcttggtatcgtcggacagattctcatgacatacggctaccgcagccagtgggtcgcatggattattcttgacgtgatcaaggtggttatctggttcaaccagctttccgccggaggtcctggcgccatgtcgatgttcgttcttcaggtggtcatgttggccaacggtttttacggcgcatgggtctggttccacaagagcagcactatggccgtatcggatgatctgcaatcaagtatttgcacggaaagcataatcgcaaatggtggccgctgatcaatcaatcgttccgtcgcgagttcacaacgatcatattggttgttgggccggcttccgtcggcaaaaccacattggtgacacgcttgtcgaaattgtatgacgctccgatcacggtcgagtatgcccgtgaatttgaggaagcctgcaatgttgacgatgatgaacttaccgctttcgattacgagcggctgattctttccaagttctctcagaacgagcatgcaatagcatcgcatgccaatcatggcatcgttttttcttgatactgatgccatggttacgcgtgtctatgcggaacgctatctgccggccgatgagaacgccaagctgcaagccgacattcgatatggtgattgaacaggagaagcctgatctggtgttgctgattcctccgatcaccgaatatgtggatggtgggttccgtgcaatgcggtgggcttcggatcggtatcggttccatgagactttggtacgcgtcattcaggagtcaccgtatgccgaccgtgtggtgacgcttgacaatccaacttttgaagggcgcaaaacgcaggcgattcaagcgatccgccaggccactggttttacgcctcgtaccggaataagctgaaaacatgtagagcaatagcagattccccctgccagaattctggcagggggaatccttagcttagatcgctaacacttaagcaagaagctcagccgttgacgcggtcgatgccagcctggacgtcagtaaggacggaatcccaggacttgatgaaggaagcgacgccgtcggcttccagcttgtcggtgacagccttgaagtcgatgcccagctcagcgagcttggccatgatggcgtgggactcttcgtaggtacccttgatggtcggagcgccgttgccgtgatcggcgagagcgttcagggtcttctccggcatggtgttcacgatgagcggggcaacgagctcgtcaacgtagacgcaatcggaataggccgggttcttagtgccggtggaggcccacagcggacgctgcttcttggcgcccttggcttcgagagcagcccaacgcggatcgttggcgaacttgttctcgaacagctcgtaagcgaggcgagcgttggcgatagcggccttgccctcgagagccttggcctcatcggagccgatctcctcaagcttgttgtcgacggcggtgtccacgcgggacacgaagaaggaagcgacggaaccgatgtgcttcaggtcatggccgttggcgtcagcctgagcgatgccttcgatgaaggcatcgatgacctgctcgtaacgctcgagcgagaagatcagggtgacgttgacggagatgcccttggccagggttgcagtgattgccggcaggccttcgagggttgccgggatcttgatcatggcgttcggacggttgaccttctcccagagctcgacagcctgctgctcggtggcttcggtctcgtgggccagacgcggatcaacttcgatggaaacgcggccatcgacgaaatcggtggcttcggcgatctcacggaagatgtcggtggcgttgcgcacgtcggtggtggtgagctcgcggatagcggtctcaacgtcaaccttgccgagctccttgagctgtgcatcgtacgggccgacctggctcagagccttctggaagatggacgggttggtggtgacgccaacgacgttcttgtccttgatgagctcctgcaggttgccggattcgatacgggtgcgggacagatcgtccagccagatcgagacaccggagtcagaggtgcgctgagttgcttcagtcattgtttttctccttgatacctttttggatcaaatctttatttattgtgcggtaaaaggggagaggcacatgcatcatgcccctccccgtcgaatcacttggcggcttcgacttccgcaatggaggccttggcggcttcgacaacatgctcggcggtgatgcccaggtcgatcatgttctgagcaccgtcgccctgcaggccgaactgctcgatggaaaccggcttgccgtaggagccgaggtacttgtaccacggcatggcaacgccagcctcgacggagacacgagccttgacggaggccggaagcacagcttccttgtactcggcgtcctgctcctcgaaccattcgagggacggagcggacacaacgcgagccttaatgccttcaccagccagggtcttggctgcggagacggcccactgcacttcggaaccggtggccatgataatgacgtcaggggtgccctcggtgtcgacaagcacgtaagcgcccttcttgacgccgtccttggccttctcagcggtttcggcaagaaccggaacgccctggcgggtcagcaccatggctgcaggcagagtgttcttcttctcgaagaagtaacggtaggcttcggcggtctcgtaagcgtcggccgggcggacgacctcaagctgcgggatggcacggaaggaagccaggtgctccaccggctggtgggtcggaccatcttcgccgacggcgacggagtcgtgggaccacacatacaggttcggaatctgcatgagggcggccagacgcacagcggaacgctcgtagtcggagaacatgaagaaggtgccaccgaacggacgggtatgggagcccagcaggatgccgttggtgatggtacccatggtgaactcgcgcacgccgaagtgcagctgacggccgtacgggctgcagaccggccactgcttggtggcgcactcggcaggagcgaaggtggcagcgcccttaagatcggtcttgttggagccaccgaggtcggcggagccgccccagagttccggcatgacagcggcgatggcgttcagcacggaaccggaagcgccacgggttgcaacgcccttgccgacttcgaaggtagcctcgaggtcatcgatggccttgtcgaagccctccggcagttcgccggccttgaggcggtcatacagggcagcgttgtccgggttggccttgcgccatgcgttgtacttctcgtcccattccttgtgggcttcgaggccgcgctcggcaaccttgcgtgcgtgagccagagcctcttcgtcgacatggaaggactcttccggatcgtagccaagcagttccttgaggcctgcgacggcttcggcgcccagcttggagccgtgagaggacggatcattggtcttgcccggggtcggccatgcgatcagggtatcgaccttgatgagcttcggctggttcggagcggcctcgcgagccttggcgatggtgtcggccagaccctcgacgtcctccttgtaggagccgtcaggctggatgaagctgaactcgtcggtgtaccagccgtaggcctggaagcgcttgagcacgtcctcagccagaaccagattggtgtcgccttcgatctggatgcggttggcatcgaagatgacggtcaggttgcccagctgctggttggcagcgagggaggcagcttcgccagagataccttcttcgatatcgccttcgccgcagatgacccagatgttgtggtcgaacggggattcgcctgccggagcttccggatcaagcagaccacgctggaaacgctggccataggcgaaaccaatggcggaagcgaagccctggcccagcggaccagtggtcatttcgatgcccggggtcagaccatattccgggtgacccggggtacgggtgtcagcaccgccgcggaagttcttcaggtcatccagagtcaggccgtagccggagaagtacagctggacgtactgggtgagggaagcatgaccgccagaaaggatgaagcggtcgcgaccttcccaattgggatcgttcggatcatgcttgatgaaatgctggtacagagtgtaggcgataggcgccagggagacgggggaacccgggtggccgtgtcccgcacgctcaaccgcgtcggccgacaggaccttggccatcttgatggcgcgctcgtccagctcggtctccttgaattcggtcatggattactttccttccaattggtcgggccgcgtatccggcttgtgccgagcgctcgacgccctcacattgcgttttccatagtagcgatgtgaggtgacgttgtggtggatttttggcgtgttttggtagtttgtgttctgttaacgctcacagttaacattctcgtgcgattgctctgttcgattggtggtatgacgagcatttcgggagattgctatcgggaaaaacgagaaacgagtactctggaagcgaacgtattagcactcgcgcctcgcgagtgctaatacaatgggagaagtatttacggaagacggtttctcctaatatcgcagatattccgaaaaccggctcccgctgaatcgtatcgtgtatacataaagaggaggcacgcatgacgcagtcaagacgtatgttggtgctgcgtgccgtcgtcgaggactatattcgctcgcaggagccagtcggttcgaccaccttgaccaaagatcatgatctgggcgtcagctcggccaccgtccgtaatgatatggccgccttggaagatgagggatatcttattcaaccccatacgtcggcagggcgcataccaacggaaaaagggtaccgatacttcgtggaccgcttggccacagtggtgccgatgtctgaagcgcaacgccgtggcatcaacagttttctgtcgggatccgtcaatctgcaggacaccttgcagcgcgcagcccgccttctggcacagatcaccggtcaggtcgcggttgtggcggccccgtcgttggcgaaatcgacattacggcatatcgaaatcgttcccgtatcaatcaacaccctgttggccgtcgtcatcactgacaccggccgagtggcgcaacatatactcaacgtttccgagttgccggacaccacagtgctgtcgcatctggtcaacgaaatcaacgcgcagtgtgccagcgtttctttgacacgaaccgcggactatgtcaggcagatgtcatcccgcaaggaataccgccccatcagtagactggcggaaacgcttgctcaagctttcgatggcatggccgacgacgagcgcgcgagcgaactctatatggcaggaacctcacgactcgcgcaccagcgtgccgtggccgatcttgcaccattgttcgatgcgctggaagagcaagtcgtgctcatgaaactcatgagcacgttgagcgaaaccacgcaatccgatggagtcggagtggccatcggctccgaaacgcacacgcccggtctgctgcatgcatccgtggtgaccagcgggtacggtcgaacctcggcaaccgctgacgacgtaacaaaaggcgagactgcggaggagcaggggagagagacaagcaatcacaccactgcagcgcaggattccaccgagcccatcgccttcgtcggatccataggaccgacgcatatggactatgctgcgaccatggcagcagtgcgtgccgttgccagatatctgaccgcattcgtggctcacgacgaaaaccaaaacaacagctgaccccgccttatggcacaatgacacgcgaaaagcaatagggagaaagaacaaccgtgacggactattacgaagtgctgggcgtagaccgctccgcaagcgacgacgagatcaaaaaagcttatcgaaagatgagccgcaaatatcatcccgatatcgcaggtccggaattcgaagacaaattcaaggaagtcaataacgcctacgaagtgttgtccgatccacagaagcgtcagatgttcgacgccggcgtggacccgaacgatccgaacgccggcggcatgcatggcggattcagcggcggattcggcgacatgggtgacattttcaacatgttcaccggaggtgctttcggcggtggcaacggcggtccgacccctcgtacacagccgggacgcgatgcactggccacagtgaccatcgacttgaagactgcggtgttcggcgacaccgcacatgttgaaatcaaaacgttcggtctgtgccaggaatgcgccggcaccggctgccagaaaggtacccagccggcacagtgccccgactgccatggtcagggctacgcacagcgcgtggtgcgcaccatgcttggccagatgatgaccaccgctccatgcgagcgttgcgagggacatggtaccgttatcgaaaatccgtgtccgtcctgccttggtcatggtcgtgtgcgtatcacccgtaatgtcggcgtgtccgtgcctgccggcgtgacgaacaatacccgtctgcgtctcgctaatcagggcgaggtgggtgaaaacggcggtgttgccggcgacctgtatgtcgacatccgcatcgctcaggatgacaccttcactcgtaacggtgatgatttgcactgctggatccaagtgccgatgagctgggccgtactggggcatgatctggaaatcgacacgttcgatggcaagcagtctgtgagagtgcctgcaggaagccagcctgacgacactgtgaccttgaagaatctgggcgtcacgcatcttaacaacaagagcgagcgtggcgatctggtggcgcatatcgcagtgaagattccgacaaagctcactgacgacgagcgtgccttgatggaacggtttgccgaaaagcatgacacagatgcccaacatgttgcggtaagcgcacgcccgacttccggaacgaagaagggcttcttctccaagctgaaggatgcactgcgctgaatttccctatcctcatgtcgtacatccgatgagaaaacgttagatcgcatatcaaatagccggttgcttcaaaaacgaagcaaccggctattttgtcaatgtttctgctgtagcaagcggattgcctcacgcctacaacagccaatcattaggcatatctacgtgtttatttgagcaatgaccggcacatagcgcgatactggttcacatagccaccgccgaagaacacgcagtggcctgcgatggggtagagctgccacaatgtggtgcgctcctgccatcctgctttcagcggatgtacggactggtatccgtcgagaatgtcccgcaagtacgacatgccgaataggtcaagcatggcgagatcctcttcacgatgcccgccgtgcgcggctgggtcgatcagcaccgcttccacggatccggaatcggccgaccacatgacattgccgctccacagatcgccgtgcactcgtgctggcttgtcattggccgccttgcccagtatttcaggcaacgcttcaatgacggcctcagtcagttccatatcgtaatcagtgagttcacggcgcttcataccaagctgtaccatcgggcggagcctgccttcggccaaatatgtcgccacatcatcccattcgcctgcgtccatgggaacgggatcctgcaaggggccgaaataacaagttcccgtatatccggctggggcagatccaaagtaatcggctccggcatcatgcatacgcgcgagagcagcgccgaaatcatgcgcggcctgcaaagtcggaccacaggcgttcactcgttcaatgttgagataatccttgccccagtcgtacacgtctaccacacgtggcccgcctttggattgcgcttcgccaagccactgcaggccacggccctcgcattcgaagaaaccttcaggactgaatgccctgctcttgcgatatttgctcatgctgcccgacctttccttgcatgatccgccacatttgcgagaccttatggaatcgttagtgaagctccgatgggttttggcaccattgtgtgcatggtttgagacaactcaaggatccatagcgaaaaattagacccctctcgctagtcttggatgcggaaaagcagacgaaaccattgatacatataaaagagggttcatgaatttcttccaagcgattttccttggtctggtgcaggcattgaccgagtacctgccagtttcttccagcgcgcatattcgcattatcggcgatttgatgctgggatccgatccgggcgccgcgttcaccgcaatcatccagatcggcaccgagcttgccgtgattttgtatttccgacatgacatcatccgcattcttggagcatggttcggttccctgttcggcaaagaaggcaaggatttcaaaagccgtatgggagcgcacaatccagacacgcagatgggctggttcatcatcctcggcacgatgccgattctgattgccggcctgctgttcaagcatgcgatcgaagggtcactgcgtaatctgtggatcaccgtcaccgtacttgcattgttcggcgtgctgctgtgggtggtcgacgcccgttccaagcaggtcaagaccatgaaggaaatgacctggaaggatgcgctgatcttcggcatcggccagatgctcgcattgattcccggcgtttcccgttctgggggcaccatcacctttggacgcgccatgggatacacccgtgaggcagccgttcgagtgagcttcctcatggccattcctgccgtgttcggcgcaggcattctggaagccgtatcggccgtcaaggacgttgccgcgggggatgccggtatgttccccggctggggtcctaccatcgccgcagccatcgtggcatttgtggtcggctacgtggtgatcatcggcttcctgaagtttgtttccaccttctcgtacaaggcattcgccatctaccgcatcggcttggcgatcgtcgtggcattgctgctgattaccggcgtgctttcgccgctggaagccgcagctgcagcgtgaatctaattcgataatcgaataacaaaaaagtcgggccgatcatcctgcgatggtcggcccgacttatatattcactgcttatcgccaatcacaacttaattgccacgcaagaacgattcagcctcacgaatcagctcttcgcaagcgggcatgccattcgacgcgatacgttgcgcttgagcgttcaaatcgtagtcgcgttccagacaggcaagataatcgccggcatgcgtctgctcgacaatctcgtcggcagccttgcgccattcggcggcttttctgttcaaatcaccttcagtcagcggatgctcaagtaaaagagacaatgcgcgaaccaattccagcgtgccctgcaagcactcggtattcgcacagtaatggggtacggacacccacatggatgtggtatgaaatcctgcgtccgccgcaaatgcgtcaagaatgttggggatgcccacagggccgttatattccttgtcgggttcgctttcgcagtcatttttggaaatgtcaagcggcaaaggcctggtgtgggggcaatcgtcgaacatggatccaagcgtgacgataccgctcacatcgtagtcttctgcgatgcgcaacgtctgcctgcagtattcctcccaacgataatttggctcgggggcgatctgagcgagaaaatgcagcgagggggagactgcaatgtcatagaacgtggtctgtggccagatgattcgtttacgaccttgtaccgagcaaatcatcggacgggctacctgatagtcgtagaaaccctcattgtcgatatgatgcacctcctgtgaatcatatcgcgacacaagatgccgtatgacgttcgtcgcagcctggcaggcgtcattccacccctcaaacgcggagatcattattgtctcgcgttttttcgtctcctcacacatgctttaaatgtataacgaaatcatatttccgcaaacacgcttccgccatcggtgaatgtgacgagcagggcatcccgatctagacaacagcatctcaaaatacccgaatgtcaagaaagctcaaaaccttttttcggtagataaaagccctttgaaaacagcaaaacacgaacacgacacgcggacttgcaaattttgagaatgcggatatagtagatactcgtgctcaggcagtagtactgcggagaacaggcggacatagcttagttggtaaagcgcaaccttgccaaggttgagaccgcgggttcgagtcccgttgtccgctctaaggtcccgattgattatcgacctttagggtgggttagccaagcggttaggcagcggcctgcaaagccgtatagacgagttcgactctcgtacccacctcttgttgtgcttgacatgtgcgagtgcgacgcatgacccgggcggttggcgcagaggtagcgcacttccctgacacggaaggggtcacaagttcgaatcttgtatcgcccactggaacgtgagttcctatataacccatcatcgggtgattggcgcagcggctagcgcacttccttcacacggaaggggtcataggttcgattcctatatcacccaccatcgggcggcacgtcgtgccgccttttttgttggtttcgttgggtttccgccgtttcgtgcggcatgtcggaaacgggtggcgcgtggtgttggttttgggcgccatagcgattcatggcgcctatacttccaggcaacgcaacatcaatcaaaaagtcgagcaggatctcagaggtaagctgggactgccggccacaggcgaaatctattacgtgcaggatcgtccgttgtatcaggagtacgagaatctcgttctgaccacctacgacaaatggttcggataccatccatgatggaacgattttcgacaaggccaacgttcctgcaacagaggagggcggtgattatgttcaccagtatatggtgattttgactgactacaaagaatcggttgatattggatggtatcaaatgtcttccagcaccgatgaacctgatgatctcgttcaggcaggcatcgacgaattccagaattatgagaaccagttcctgaaggatgaggatcttgtacggcctattttgatgctgttgtaaggcatgagttgtctcacagggaaatctgggcgcgctgcggaaccgctggtccgcctgtcgcgggcaacttgattggagctgcaaccaactcctatgcagtgaaatacatgggtgcggataaatcccagatcgagtccacgcagggagaagactataagatgacgcagcagagcgacgcggtggccgaggccattcactccggcgatgctcctaattcaagaagagccgtctgcaacaaggcattgcgggaaatgatcgacgagcagcgctgaaatcaatccccgcgaatataacttcgaatacagttttaaatccggaatacacactatccgggctttttccgtgttctttcaaggtgtacggctacaatggcagcttgtgagtgacgaagcattgaatctcaatcagccggtcaaagacatggggccgaacgagttgaaggcttatgccaggctcggcaaacagcagcatgacgaggcgaatcgtgagctggaacgccgttggcgcagctatgatgacatgttgccaaacgaccagttcgtgtcaattatcgacaagactgagggataagacccactttacggtgtatgattcgtgaccatgccggtctcaataccggctatttgcaagggtaatgactagaatggcgactatgactgatccgattccaagcgcaggtgaaacgaccatcattggccttcctgcaataaccgtaccggtgacttccaccggagaccgtcctctgacgaaagaggaccttgaaaccatcatgcgtcttgccgatggcacggcattgctgatctcgactaggggagcggtgtcggggtcgcggtatcttcttgacgaggatgagattaccgtcggccgtgatccaagagcggacattcttttggatgattccacggtttcccgcgcccatgcggtgttccgcaggtctgacggcaggtattccgttattgatgcgggcagcttgaacggcacctatgtgaaccgccagcgtgttgatcagcaggagctcaagaatggcgatgagattattcttggcaagttccgtctggtttatttcgacaataaagccgtcattgccggttgatccacgttatgcgggatagactgtgtacaacagcttcgcgcccatgagcttcgcacgaatgctcatgggcgttattgtagatgtcgtaggagagcgtgatgaacgaagcagagccaacaacgcggttgcgtctgcatgtgtcgactgcggtgcagggggagttattccccgcgaccggcactcagccggtgacgcgcggctacaagggtacggtggcttcaaaagtagcaggcatcacttatcgtcaacttgactattgggctcgcagacaaatcgtggaaccctccatcacgccgtcgcatggatccggttcgcgcaggctgtactcgttcaaggacgtggtgatccttgctgtgtcgaaaagactgcttgacgcgggcatcaatctgcaaaatgtgacgactgccatcagttttctgacgcagcgtaccgcggaacaacttgagaatatcacgattatgtgcgacggtcagcaagtgcacgaatgtacggatagtgagcaaatggtggcgttgttgcaaagcggtcgggcggtattcggcgtatcggtgggatctttatggaagcagatcagagagactcttgcccacgaggaatacgtcgatctgaccaccatgccttccatgatgggtggaaaccgacctgttgacgatatcactgcaatgcgcatgagaaagaacttcgaggcgcaacatcagacacgcgccgccgcgtcactgtaacataccagaatgcatgccgtatggttgatgcggactaagacggatgtacgagtcgttgatatgagatagatatgtacagacagacatacaacaggggagcaatacatgtttgatattctgccggcattgctgtggattgtcgcagcggtcatatcgttgaacatttgttcgattactgcaattcgaggaaatatcttctcaaaaaccaagagtgacgtatatccggtacgctggtcaattgtcggattgcatttcacatcgctgatcatcggagctctgccgtatccgatatatacgatgttcaaacccagcttttccttgaaatttcagcatttctacgaacaggttggttggccgtcggcagcactgatggttatgctcatcgccacggaactggtgtttatgtatctgcaggcccgaaacggcatgaaaagcgaaatggaaagaaaactcagccaagccattaaggactagccaaaaagacatccatcgaagcgaaaacgcagccgtgtggaaaaacgtccagcgaagcgaggacgcaccatccatcatgccggtgggttatgtcgagcaaagtcccgaaagggacgtgctggcataacccaccgatgttatgtacagaaaagagcgtcagtcgaaaactgctgtagcttttctgacataacatacattatcggacaaaagtgggagcaggtgcagggggtatttgagatgtacgcgatctctcaaaaccccaggtatgcaaatgtcatcgctggcatgcatacccaggggtttctttgtctttatgcacaagatgatccgctcgtgcatcagccgttatctatcaggcgaaatagtcttcgatggtttgcgcaagctcactaaccgaatcgatcaccttatacgcgccatgttctttcagctcgccaggctcggcataaccccagccgcatcccaagcaatccagaccgcacgctttggctccgtcagcatcggtccaacggtcaccgaccatgagcgccttatcgccagcggcttcgtcaaacccaatgtggtcgaacgcccattgaataacctgatctttgtcgagacgcgaattatcttcgctggcaccgtaaatgccgttgaccatggtgtccaaatggaaatgctcgcaaatcggaatgcactgatactgcggcttgcagcttgcgatcgccaagtagtatccgtcagcacgcagtttggccaactgttctgggataccgtcataaatggtattgttcaaacggcccggaaccttttgacccggattattcggatcatcgaacaccgcttcctgcgcataatacctgcggtagatggcaatgccctcatcgagtaagtcgtccggaatattattgcgctgcaacgactcgacaattgcaggaccaatgaatcgctgcaactcctcatcatcaggcactggataccccagttcctcaaataccttcaccacacaaccaatgatgcccggatcagacttggtcaatgtgccgtcaaggtcaagcagaacgactttcttgggttgcttggtcttctcggacatgagattaatgcactccttgttaaatgctcgatgcaatgtgaactgttcagataacaattatgcccggtcttactgaccgggcatgcagttcaagtgtcgttcaactactggttactcgtagtctggaaaccagccgtcgcgatgcatctgcagacgcttttcaagcaacgtcttcagctcgtcttcagtacggcgttccaatagcatgtcccagtgtgtacgggtcggcttggaaatctcgtcggcctcacgatcctcgtcgccttcacgatgcgcggtcatgccgcaccggcactcccattcctccggaacctccgcgccttcagcgaacggcagaatcgtgcggtgtccctttgggcacacatatgcgacgtcgtttcgcgccgcgaaatccacattgtcatcagattccaacgactttgcgccgatgctcatgcctcgcaggctgcgttctgccatattgcctttgcctccttggattgtctgctctgtctaagctacagaacagttcggacgtgtcttttattccttattcgtctgcttgatgttcgattttagtcgacgccggagtatgcgacgatgccacgattgatgcgatcgtacgcctgctttgcgactggcgccaacgtttcggcacgatccgcaagatacggtccagccacggctatctgctgaagcacgtcggcaagccgtttgccgttacgcacgaaatcgccgcccgtcagatcggtgccgtacagcacctgcgacaggctttcaccttgcgcccaatcgtagacgatatcggtgatgccaaaatcgagttggcgaggctcctcaagcatgtgatcctcacataacatggcaatcgacgcatggacgcccttaagctgcgctgcgcacacggcgacgttcccttgaatgcctccagggtaacgacgcggctctcccccgcctcccctgcgggcttcgaacaccaacgatgcgacgacgctggccaattcacaggcgttcaacccgtcaaatgcgccatcgtcaatcgcctgcgccaatactagatcaagctcgctgtacaaatgccgcaacagctggccacgttccgtgagctgataatcaccatggcccgcggattcccgtaccggctgaagatagccgagattggaaagcacagcgcaaatatgatcaaactgacgtgccacggaaccggttcgcgaatcgtaacgatgctgtacccgttccaactcgcgcatctcacgagcccaacgatgtccccatttcaagtgcttctgcacatcagggcatttacggcatggatggtcgcggtcttcttctctgagtttcttgatgcgtttgtcaagatccataaacgcctggctgcgttccttctgcgtacggaacacctcatgcttgagtttgcgacgttcgttcttctccaaatcactcaaacgcatccgcaaacgcatgaattttttgaaatcgccgaattcacactggaaagcctgctcgtatccttccagagccttgcataaggtttccatctgtgcttcaagctgccatgccgactcgttggcttcccattgcgcaaaggagtggtcaagcgtaacgcgagctgtttcatagtcgctggaattcaatagattgacagccatattgaaggtcggtctgaagcttgagtgaagcggatacactcgtttgctggacaaggcggccgcagtggcgggaacaaaaccatggtggtccaccacaacggcatgtccgatggtgtcgatgccacgtcgtcccgcacgaccggtcaactgggtaaactcgccgggagtcaacccaacatgcccggtgccgtcgaatttctcaagcttttcaaccaccacacaccgtgcgggcatgttaatgcccaaagccagcgtttccgtggcgaagaccattttaaccaagccttcttcaaacaagcgttcgacaatctggcggaacaatgcgaccattcccgcatgatgcggagcgaacccttcttccagggcgaaacgaaattgcgagaaatgcagcgctttcaagtcttcttggctcaactggccttcgaccatctcatcgacgatccgtctgatttgttgcacttcgtcgctggtggtgagttccaagcctgcgttgatgcattggtcaaccgcttgatcgcaaccgtttcttgaaaaaatgaagtagattcccggcagcatgtcaagaaaattcaactcgtccacaaccgcccagcgtcgaggcgtatggcgttcgaccttatgcgggcgatcgtcccatcgtccacctttacctttggccctacgcttatcaggacgtcgctcgcccttgcgccgttccgcctgacgatcaagctgatcaagtctgtttatcagctgcgcattgagtttgaccgtctgttcgccattggcgtcacgccgatataggtcgatgagttctggttcggtatggtcatctgcctgtacgagcacatgctgctccaacggtaccggacgctgttccgacatgaccaacgtggttttgccacgaacagattcgatccattcggaaaaatcctcgacattggaaaccgtcgcggaaagacctatgatgttcacgtttttcggcaagtggataatgacttcttcccagaccggccctcggaaacggtcagcaagatagtgcacttcgtcaaggatcacataacgaagcgcttcaagcgtcacggaatgctcatacagcatattgcgcaacacttccgtggtcataaccacaatatccgcctcagagttgatggacgtgtctccggtcagcaatccgaccttatccgttccatactggtcgaccagatcatggtatttctggttgctcagcgctttgatcggcgtggtataaaaggctttgacattccgcgtctgcgccagatagatggcgaaatcggctgcgacagtcttgcctgctcccgtaggagctgccacgagcacattatcgccagcctccaacgcatcgttggcttgcatctggaattcgtcaagctcgaatggcatggatcttgcgaattcggccgcaaccgtgcgctgcttggcctgcgtttgtttgaatgcggcataccgttgcgcgggagacaactccacggtctcattgattttcgacgggtcaataccgttattacggcgacgatgatgggtcatgattccttaatatggttgggtcaatcgttacaatgacgccattgtgcccactgttgagcatgacggcttcgcttcgcttcatgcctctcaatgactccggcatgggcatccgcataacgatctgcagcatcctttaaaggtctggtaaagaaaggcgcttcattctcgttgttttggggcaatggtttgcccatcgcctcgattcgttttgccgtccgttcacccagcttcgccacgtccttgaatgctcgatagccgtgtaaacatgcgtagacgactccggaaacaaccattgcaagcatgaacagagcgagcaacagccaaatccaccaaggcatagtctctcccccgtcagccttcattctcacgatcgccaatgctcagctcatgctgggcacgggcgacaatcatggtacgcaacgtttcgggagctacggcagtgatatgccgtgcgtgggaaatacagaatgcgacataccaggaatcggacgagacgatcagatgcaccttctcgccctctccgcacttttcgactgttgctcccgacagcccgtcaataaatgacagatcatcctgattggtgacgaacacagctggagttccattatcgaagctccatttgcgcaattcggatgcgggaacgtcgggaatgtcgattttcgcggtaggttcaaccagttcggccttttcaatgcgggaaatgcgaagcacctgccagatgcgaggctttcctgtggccttgttgatcgtggtgtctttcttcacgtacttagctttgtcagccggtgcagcggcagcgacgtcagtccatacggcaacgtagaagactccctcatcgacgaagatcttatctggcgcgacaagcttacgctgggtccttccggcgccatccgtatattccatgtcaagcagcaagctcttggagatcgcgctcttcacaatggagaaattacgcggttccatctcataaccggtcagactcagccaaggcatgtcccccggctcaacatgttgacgaagacggctgtacaacgattcagcctgttcacgcaacttgtccggcagcaacgacgaatgcgcaagatagctcaccgatgcggtaagcatgctcaaatactgctgggagatacctgccaagcgttccagcccaagcgaattcgtggcggaaacaatgccttcagcgtcaagcaacgaccagtcgatgtcaaagaactggcttcctgccatctcaccatcgtcggaaaccgtagtcagcgtgttgatgtctttatgaatgacattgacgaacttcttcagctcgtcatcggacttcggtttgccaatgaaacgttccgcaagttcctcaagcgaatattcttcgccgaggtgcgccgaaaggaacagcatcagacgcagacgacggtcgacttcactacccgtctggaatgcggaattcttcttcggacgccccttgcactcctctgcatcgtcgtcagcgctgttgcggttgatttccatggctgtgacagtggagctatcgcctcctgtggattcgtcggcaggcacgaactgcgtggcggcattcaaacggcggttgaacgcgtcgacagcctcctgaggactgacgatggaagcacccggatgagaaagcacgaacatggccagatcatcggaatcggtgtaggcgacgttcaaatgctcgccgtcaacatctacagtcgccgcgaaacgacgctggtcaacgaccttgaccaattcgtcgggaatggattgcgttcccagacccggagcgatggaatcaagaccaagccctggagtcggagtctgagggacgcgaggcgcggtacgggacgtatgctgcgtctcatgtgcgggagctgaggaaatcgacatggaacgggccagatagttggccgcggcaagaatcggcaaatcctcgtcgccgaacagcagacgaacgcgaggctcatctccaagctgcagacgataggatgcgaaatcctggccttccgacttagatgaatactcaggctgcctcgattcgatggcgatgcccatggccgcaagcttggcacggtcacgctggaattgcttggcaaaagccgccttcgccgcctgatcagccagctccccataggaatcggcatacgccttcacacgctgggcaatctgacgggaagtgagccattgcgggaaagctgaggaaagcacagccaatacatcaagttcgtgcttgccccatttgtcggagaaacgacgccttccgttactgccctctgccattagtcctcacgtctcgttaacgtttcatcttaagtgcctagccggttcaggctctgcacacacctctctatgatagagggttttcgttcagattgtgtctattttacgaaaaaatacagtttttcgtgttgaggctacccctcgaatcagacccaatcatcaggctcaacaccttgcgggccaacgtattcgccattcggaacataactcggctcacttgtgtcggtcagccgcgcgtcaccgaacagtatcacgtccctgccgaaggtccagtcaccatcgatgtcgacggaattggccgcggcaagcgacggaacgccataagggaatctcgtatcgaaatcatggatgttcttgtaataccgcgcatccaagtgaacatccgggaagacgtaattgccatcttccatctcgtactggtccgtcagatggaatcgatcggatcgcatgataaacaaatcgtcggtggttttcaccggcaggaaacgcatacggtcaacgcatacgcaggtagccccgtcgaacaacgtcaccgccgctcccatggctgtttccagctggatgaccggctcgctcgtcggatcggtcggatcgacggtcttgttattgcgaatcaccggaagaggaagcacgccatcatatgcggacagcttggccttcagagcgtcgatacgcacccagatgctgttcgtgttaaaatacggatgcttttcgatgttctgcgcatcatccttatcgtccggatgcacctggctcatctcacgcaacatcaagcggccggtcgccttgtcccgcacgatatgcccgcccttgcgatcagctggagtacgttttgcgacctcgatcatgaatggcgcaccggtattttcgaagtgctgcgccagcgtgcgcgaaggacgtgcgccgagattgtcggaattcgagatgaacaggtatttgaagcccttctcctcgaggacgtccaataggccggattcccaaatggtggagaacaggtcgccatggcctggcgggcaccattcaagttccggatttgccgggaagctgacaggaagaccggtttccgcaccgattttcggttcctgatgctgcacgatttccagaggaatgtcctcttgatggaactttttgttggcacgcagcaccttcatggtgtcattcgacgtgcggaaggagttcatcaacgtcaatggcagttccacacccagacgagtgcgtgcagtcagcacctgaccgatgatgatgtcgatgaagcgcatctgacgtgccttatggcgacgcactggcagcaaggacttggcgcaatccaagcccatggacgtgccgaggccaccattaagtttgaggaacgcggttttggcaaaagcatcgacggctttgtcatggttgatggtctcgtagacatcatggaagctaggcactcccaccagaggctcaacatcatcctcacggatccatgtgcttgcttcctcactgcgccaaacctcgtacagtcgtttgaattgcgcaatggccatatcggtcatcccgttgtcccgcatctttgcggcggaatgttcaaatgcgtcctcagtcaatgtctttccctttcgtgcgggcgtcctgttctcatcgtacctaggcaatactacgacaaaattcccatgacgggggcttttggtggcaaaaagggaaaattcttgacaaaaatgacatcccaagaactcttttatcatgtttcgcgaatcgtgcgacacgatgaatttgaaaaatagagcaggttgtgctatgtttcatgttcggtgctttttgcatcgttcggaccatagcgcagtttggtagcgcacttgactgggggtcaaggggtcgcgggttcaaatcccgctggtccgaccagaaaaacccgaattcatgcgatttcgggttttcttttttaggatgtcagtcttacgcatgcaggtaaggggtgattgtcttgaagtcgatggacgcccagccacagtttgacgacgttgacggctttgcccacgtgtttgactcatccgagcttgaggatgagtggaagatacgtctgtcccgggaacttggcgtagcggccagggagcgggcgaagcatgatggcatcacccttaccgaactgacgcgcaaggcgcttgaatgcgacgatctgaatgagaccacggacaccgtccgccctggacgaagaccgaagaacaccgacggtcgagaacagctcggagacgaatggaaaatcaaactcccctatgccatcggcaagatggcacgggagcgcgcgtccgaggaaggcatatccttgagttcgctcgcgcggcgtgcgatcagcggatatctacgtcaacgggatactgaggaacagccgctgttttaagcatgtgacaatgagtcacgcatgattggcgtgcactgatctagcaaatatggatggtggccgcacacccaaggaatggtgtgcggccaccatccatagaaacttacttgcgtttcttcttctctcgaatattcaccgaaatctgaatcggggaaccttcaaaaccgaattcctcgcgcaggcaacgttcgatgtatcggcggtaaccatgctcaaggaagccggtagcgaaaatcacgaaacgcggtggacgcgtcgaagcctgcgtcgcgaacaagatacgcggctgcttgcctccacgcagtggatgcggatgggcggcttggattttacccaagaacgcattgagcttaccggtcggaatacgcttgtcccatgattccagcgctccacgcatggctctggccagacggttcgtatgccatccggttttagccgacagattcacgcgctgagcccacgttacacggtcgaattctgtcttccacaagcgttccattcgctgacggtcgaaatcatccatcaaatcccacttgttgaacaccaaaacgatgcatcgaccggcgtccactgcttggctcatcaccttcaaatcctgatcggaaatcggttgggaagcatcaaacagcaccagcgcaagttccgaacgctcaatcgcggcctgagtacgcaaggatgagaaatattcggcaccagacagcttatgcaggcgacgcttgatgcctgcagtgtcgatgaacagccaatcctccccatcaaccgtcaccacttcatcgactggatcgcgagtggtacctgccaaatcattgaccacagtacgttcctcgtgagccagctgattcagcaaagacgacttgccgacgttcggtcgaccgaccaacgccacacggcgcaaatgggacggagtaaggaaaccggatgttttctcagccttcttcaacgaatccaaggcagcgtcaagcagttcgccaataccgcgaccgtgcatggcggaaatgccatacggctcccccaagcccatcttccagaattcagcggtcaaatattcgctctcacgatcatcaaccttgttcaccgccagcgtgaccggcttgccggaggcgcgcagcatcttgacaatgcgctcgtcggtgttggtaagaccaacctggccatccaccacaagcaccacagcgtctgcaagctgaacggcgatctgcgcctgggatgcgatggcggattcgataccttcgacgtcggcttcccagccaccggtatcaaccagcttgaaatcggtgccggcccattcggcatcgtagctcacacggtctcgagtcacgccgggagtgtcttccaccacagcagcgcggcggccgagaatacggttcaccagcgtggacttgccgacattagggcgcccaacgacggcaagcacgccaaccggcttcgggccggaccggcgttcgccgccaacgaacgacgatccatcgatcagtccttcatcgccctcatccaactcataatcgtcaagattggaagcgtactggcgatactgctgctcttcgatggcatcgtcgacaatgcgcacaagcacatcaagcgtttcgccgaaattcaaatcggaattatcgacggtcagcacgccttccgcggcagatgtgaaattcgtgaccttggaatcagctgcatctcgcgccgcaacattttctgatccgacaccatcagttgactgaccggaacgacgagcctgtcgcacctcttcacgggcggtgagcaacacacgcacttcagcatccggcgcaacaaccgtagtgatgtcacggccttcggcgaccactccggcaccctcagaaaaagagtcagacgcagcttcgcgtgcgatgtacgcgcgttgagcggcaatcagcacgtgacggacgggaatgatgttcgacaccttggacacatgggatgacacttcggaggaacgaataacgtcgctgatgtcttcgccgtcggcatataccttcgaatcgtctggatcgacgctgatgtcgaaatgaccttcggtaaagaactctcccacggtttcggtgaccagttgttcatcgatcgtctccgcgtcaaggtcaatgcccttgttcatgcaccaccatgcgcaggcacgatacatggcaccggtatcgaggtaagcgaaaccgtaatatttggccaacgccttggatgtggaagacttgccgacacccgcaggtccatcaatcgctacgcgaatcacaggcccaccgccttggacagggaacgcacctcggtctgcgaaagcacacggtacgatccggatttcagatcgccaagcttaatcgggccgatctgggtgcgtaccagacgcttgaccgggaatccgatcgaaccgaaaatgcgacggacgatacggttcttgccggaatgcagcacaaccttgaccagcgtgctgtcgcggctggcatcaagaatcgcgcaacggtcgagcttgatccaaccatcgtcgagctgcacgcctgtagtgaccagtcggcggcacacctgaccgctgatgcgaccttccaacgtggcgatgtaggtcttctcaacctcgtacttggggtgcatgacgtgctggctgagctcgccatcgttcgtcatgagaatcaggccttcggaatcataatccagacggcccatgtggaaaatacggtcatacttgtcgccgacgatatcgctcagggtgtagcgtcccttcggatcctccatggcgctcagcacacgcttcggcttgttcaaagcgagcgtgacatgattgggattcacgcgaacacgggagccgtccacacggacttcctgatgtttcggatcgacgcgagtgcccaattcggtaacaagctcgccgtcgatttcgacacgtccttcagtaatgatctcttcacatttgcgacgggatccgaatcctgcctgagcaagaagcttctgcagacggataccttcattatcgtgtgtgtgcgccttcgcggcgcgggaatatgcgtttggcatcgttctcccaacgtggccggataatacttatagggactgctggtactatggcagtcgtttggcgatttcccaaaatcgcaacttgtccactatatgacagaggaaagactatgactgctgttgaagcaacgcccataaccaaggaagaacaaagcaagccgttgacacttcgtgtcggagcggaacttgtgggaagcttcatcatttgcttcgcgatttatgcgatctgctcgcttggttccgcggtgtatggcattaacatggcgttcatcgccctgttgacgggcatcgtatacgccgccgtcaccgtaatcttcggttccatttccggagcacagttcaatccggccgtatccgtcgccgccatgctcactggcaaaacccacgtgcttgatggcattctgtacatcattgcccaagtgctcggcggtatcggcgcgggtgccgctatccggttccttctgccgacttccgagcaggtgacattcaagatctggatgacaccaacggtcaacggtttcgataagaattccgtctcctactccaccctcggcaattatggagtgaccctcggcatcactctggccatcgccgttgaagtcgtcgcaggtatcattatcgttgcctccgcactgcgcaccacggacggacacggcgagtccaaaacaaaccacgccgttgccatgggccttgcctacggcatcggcaccgctatcacctatccggtgaccggagccgcactgaatccggcacgtgccacgggcattgccattttcgcacagaatcaaggactgaatgaagagccgctgcaacagctgtgggtcttctggatttgccctgttcttgccgctgcagttgttgctctcgtcgtcatcgtcgccggcatgattggtacgaagaagaacgtgccggatactgtcgagacaatcgataaggtcgaaggcaataccgttcttggcgaagcgtcagttgccgacgggaacgatggtgagcaggatgaacagtcctacgcccaagccaatgccgatgaaagcgtcgaaagcaactgaccgaaccttccatggactgcgctcacgcaatgccagtctgaccagtccagtcgctatggccgtcaccgcaatcgcagcggtggcggcttttgtatatcctgcgaccgcaagcaccgtcgcaacaatcactaccgcggcgacgatccattcgaaccacggtttgccctcatgatcttcggaaacgtaaggatggctcattccggggcctttcatcttgcttgctgtacaacaaccgtaatcataataaaacgtggcgtccgaaaccaatacggaatcggacgccacgttgaccaatacccctcacatgagaggcggcgtatcagtggaagaagtgacgggtgccggtcacatacatggtgacgccggccttacgagccgcttcgaacacttcctcgtcgcgaatggaaccgcccggctgaacgatagccttaacgcctgcattgatgagaatttccgcaccatccgcgaatgggaagaacgcgtcggatgcagcgacagcgcccttggtgcggtttgcgccatcagccagcgtgttggcgcgttcgacggacaggttcgcggaatcgacacgattcacctgacccatgccaatgccaacagtggcctgatcgtgggcgatcaggatagcgttcgacttgacacagcggatggcccgccaagcgaaaaccagatccttgacggtctgctcatcagcaggctcgccggaaaccagtttccaagcgttcggatcgtcgcccggagcatcgataagatccgtggactgcaccaacagaccgccgtcgatctgacggaactgcgtcttggacttcggcggctcggaaaccttcagaatgcgtaggttctttttcttggtctgcagcagttcgagagcgtcggcatcatagtcgggagcaacaatcacctcggtgaaaatcgggcggacgctttccgccatttccatggtgaccttgctgttcgcggcgatcacaccgccataggcgctcatcggatcacaggcatgtgccttcttgtgcgcttccgcaacagtggcgccaacggcgaggccgcacggattgttgtgcttgaccacggcgacggcaatctggggagcaaaatcccatacggcacgccaagcagcatcagcatcaacatagttgttgtagctcatcggcttgccaccgagctgttcggcatgcgcgaaaccatcctggttcagcggatccagatacagcgcggcctgctggtggggattctcaccgtaacgcagcacgtgggcacggtcccaagtacgagtgaatgcggccgggaacttggtctcattcacttccggctcgtcttcggcggttggctgctcaacggtcaaaggcttcggccagtgctttgcagtccactcgttaatggtggcatcgtaggcggcagtatgggcgaacgccttgccggccagccaacgacgttctttgagagagaagccctctccgttttcgatgcgcgcagctaccagtgcgtaatcgttcggatcggtgatgatggccacagtggcgctgttcttggccgcaccgcgaaccatggacggaccaccgatgtcgatcttctcgatggtggcagcctcatccgcgccagaacgaaccgtatcggcgaatggatacaggttgacgaccaccagatcgaacggcttgatgccgaacttttccagctgtgccgcgtggtcctcattggtcatgtcagcgagaatgcccgcgtggatatgcgggtcgagggttttgacgcgaccgtcaaggcactccggaaagccggttacttccgagacttccgtcaccttgacgccaagttccgcaagacgcttcgcagtggaaccagtggaaaccacttcagtgccggccttgatgaacgcttcggcaagaacctcgatgccttccttatggaagaccgataccagagctcgccgtatcggtcgattcgttgttgtcaccctgatcctccttgttattgatggttgaggtcactgtgcgggccgcattggcgacctcacgattatctgattcaagagccgcagtggacgcaccactcctgctctcgcggacacgctttactatccagcgtattccaaaaaacatggatacggccaccaaagtcagcagccatgacgaaaacagtcccacggcagtaggctgtccaatcttacgggtcgatgaaatcacgtcgacgccgatgtgcgcaagatgttttgagcccaacgctccactggagatggcaaaaagcagactcgaacataccgatacaacggtgcaggaaatgcagaacgctcccgctggataggcaaagccaagcactaccctcttgacatcaatctgctgatcggagttgcctactctgatatgaaagcccttgttgaacagcatgaccaccatgcccgcggcacaagctaaagccaaaggaacgcacatcaacgcgatccgaatccaattcgtttcaatcgcttgaggaagcaaaccgaatatcggcagagacggcaatgccgacccctgaccgctccacatggtgaattccgctagatcgccaatcgaaaaaccggccccgaatacccaggaaatagcccaaatcgcgatatttggaatccaagcgatcatggcgatcgtggtgaggatgcgagaaccgttctgcattcccgatagctcatacaacttcaccatggccgactggttgctgaatgcccagtacaagaccacaatcagtccaatgaccagatagaccgtgatcaacagcacacccaaggcaacaccaatggtgacggttttacggaccggagacgaaacatgctcgctgatccaatccaaatctcgtttggtcagtggtgattcgggaatcgcggcaatggcatagccaagtacaaagacgatcgctgttttcacagcaaccacgcccgtcgtatcaacgagtttgatgtcaaggctattggcgaagaacacattgatcaacacccagcctatggttcctgccacgcatccggacagactcgttccgacgcgtttggcgagcgatgcgataagagcgatcagcaaaaccgtaagcagcaacggcataatcgtcaaagtgatggatccggttttgaaaccgttcccttggctgagaagcacaaccgcctcggtcaaggaaacagagaaggcggagagattgtcgccgccttcttccatggaaataaccagaagcatcagcgcaatgtagcagcctagggcaccggcatagacgaccatggacaatgccgccacggcaagccccttcaaccaatacttcaggttcgccatcatatcgacttggaagcgagcacctcgcgcatgatttcagcggtctgccccggagtgcgtccgacacgaatacccacggcttcgagcgcttccttcttatcttgcgcagttcccttgcctccggaaacgatggcaccagcgtggcccatctgcttgccttccggcgcggtgaagcctgcaatataggcgacaaccggcttggtcatatgctcggatgcccacttggccgcatcctgttcggcactaccgccgatttcaccgatcatcacgacagccttggtggcatcatcgttttcgaacgcctcaagcgcctcctgcaacgtagtgccgacgatagggtctccgccagcacccaaacatgcggtaaaaccaatgtcagacaactctcccatcagttgataggtgagcgtaccggacttagacaccaaacccaaaggtccacgggagacgatgccgtccggaataatgccaagattgcaaccattcacaccttccgtagaaggcagggtaagcagaccagggcagttcggaccgacaatacgcacatccttgcgcaatgcgagttcaacaaagtacgcgctatcggcaacaggaatgccttcggtgatgacaacaatcagcttgatgccggcttcaatggcttcgaccacggcatccttggcgaaacgcggcggcacgaacacgacgctcgcttgggcgccggtgacttccacggcttcggcgcaattgccgaacacacgcaacgtaacatcctcgccgtctttggccgcggggaaattgacttcctggccggccttgcgggcgttgacgccgccgacgatattggtgccggccttcagcatgcgggcggtatgggtcatgccctgatgtccggtcataccctgcacgatgacaggtgcgccatcctcaatgaaaagcgtcatttcagcgaacctccttgccattggccgcaagacgcgcggcctgctgtgcggcttcttccatggtctgtgcaacatgcagattgacacgatcggcctgagccagaatatgtagaccttctgccgccgcgttgccgtcgaaacggactaccagaggcttggaactgccaagcttgtcaagggcttccagaatgcccttggcaacttgctcgcaggatgtgatgccaccgtacacgttgatcaacaccgattcgacttgcgggtcggacagcacgatctccaaactgccgcacatcacttcggcggacgcaccaccaccgatatcaaggaagtttgccggtttgacattggtgccctgatcttctccagctccggaaaccgcgtcaagtgagctcatcaccaaaccagcaccgttgccaatgacaccgacggaaccctgaaggtgcacatagtgcagaccatgctctcgcgccttctgctcaaacggatccacatgcactgggtcagcgaagcgcttccagccatcatgacggaacgcagcattgtcatctaaagaaatcttggcgtccagggcgcacaatgtcttggaagactcgtcatccggatcgccgatcttggcaagcggattgatttccacaagcgtggcgtcgttctctttgaagcactgccacatcttcagcagaatctgtgctgcctggttgacgtcggcatgatagaagccaatgctttccgccatcttggtcgcagcctcgatatcgaaatcctccagagcgtcgatatgcagacgcttcacagattccgggtgttccttggcgatctcctcgacctcggttccaccattcgcagtagcgagcacgtcaaaatcgcgagacgaacgatccacggaaatagagacataatactcgtgaagaatgttctttgcctcggccaccaacacgccgctgaccttgtgcttgtgaatggtcatcggcaggatgtcttcggatgcaagaatggcctcatcacgattcttcgccagcttgacgccaccagcctgaccgcggtggccaatcttcacctgagccttaatcacgttggggtagccaatctgctcggcagcctcagccacttcgtgagagttctgcgcgaacactgccttaggcgttggaataccctgctcttcaagcagttccctagcctggtactcatagagatccatggattcttttcccttgatgctattggttatttacgaagaatgtacttaactcacgcaggcatggtgatcagtgaacttgtcgggcagtctcccagcgatgccatgccaccaatgccgacaagctccatgacgaagctgaaacctgccaccgtgccgccacacttttcgatcaacgaagcagccgcacgcgctgttcctccagtggcaatcagatcatcaacgacaagcacacgagatccctcatgcacgatattcgtctcgatttcgacggtggcctgcccatattcaaggtcatagctttcgctaacggtttccggaggaagcttgccagccttgcgcactgcgatgaagcccttgcccaggcgcgctgccaacgcaggaccaaaaaggaatccgcgggcttccaaacctgcgatgatatcgaattcatcggcagcgaccggcaacgcggcttcgagtgcgtcaagtagcaatccgaaggcacgcgcatctgccagaacaggcatgaaatcacgaaaaagaataccttccttggggaatcccggaatggtgcgaatctttgaaacaaggtactcggcgttttcgtttccaatcttgctaagaccggaaacggtaatatccgacgatgccatgactgtattgtccttcttttgtagtgctacggcactttgcattataggtttccgtcaggaataaaatcggcgaaaacctcaaaaatgagattttcgccgatgccttaatgagcttgtcagctgttcttctgctcggtctcagtctgcgccgcttcgatttcgccttcaatcggctcctgagcagcctgatcttcgtctgtggaatcggtggaaagaggattaccgttttcatcgacctcatcgtcgtgtacgtacgcaggacgcacgtattcgcggctgatggcgttgaaaccgaaacgaatctgagagccttcggaatcgatgacgatctcctcgtattcggtatcgacggaaacaaccttgccgatcacaccaccaatggtgatgacctcagtgcccggctgcaggttggcacggaaatcctgacgctcggcctgctgctgcttagccttcttggactgccagaacatcatgccaaacatgacgacaatgatgacgataagaaacatgtaatccaaagcacaactccttgggatggacgctcgaacaggactctatgtccagaacaccgagtctaagctagcttgctgacatcaacctgagattcgtcagaagtcaagccgagatgatcccatgccttgcgcgtcgccacacgccctttcggggtgcgcacaaggaatccttctcggaccagatacggctcgcacaccgtttccacggtctccgattcctcaccgaccatggccgacaggttgttcagaccgaccggaccgccgttgaaattggtgacaatggctttcaataccgcaatatccaaacgatccaagccctcggtatcaatctggtacagtgccaacgcctccttgacatcgtccggatgcacagtttctaaatcgtgcacaatggcccaatcccttacgcggcgaagcaatcggttggcgatacgcggcgtgccccttgaacgcatggcaagctgatgggccgctccctcttcgagactgatgcccagcaccgaagaggatcgttcgatgagcttttcaagctcctcatgcggataaaagtcaagatgcgcggtaaaaccaaaacgagccctcaacggtgatggcagcatgccttcgcgagtggtggcgccaatcaccgtgaatctcggcaaagtaaggggaatggaggaagcacccggccctttgcccaccatcacatcaacacggaaatcctccatggcgatatacagcagctcctcggccgctcgtggaaggcggtggatctcgtcgatgaacagcacctcccctgcgtcaagggagcttagaatcgaggccaaatcaccagcatgctggatagcaggtccggaagtgactcgaatcggcactccaagctcgttggctacaatcatggccaacgtggtttttcccaagcccggaggccccgccagcaggatgtggtcagggggaacgtcacgtttacgggcagcatccaaaaacagctgcaattgcgccttgagtcttggctgtccaataaaaccatcgaggacgtgaggacgcagttcctcatcgcttaccggctcgttgccgacaggcgacgcggaaaccatgcgaagcgattcctcattggcaccggtattcgactgttcgaatgcgacgtcgttcgtcatgatgatgcgtttcacctacctcggtcaagagaagccaatgcaagtttgagcacgcggggcacatcatcgtccctcaatggaacattgatatgattgctctcgcagactgtctgcacggcatgcaaggcatcctgctgacgccaccctagtgacatcagaccttccacgacctgttccgaaccggcatcttccgcagaacgaacctctttggaagccccctcgatctgactgagatcgatggaccccttgagttcgagaataatcttctgcgcacccttcttgcctagaccaggcgccttcgccagcgcggtggcatccccgtccgccacagctttcgccaaacgttccggaggcaacgtcgaaagcaaggaaagcgcgactttcggaccaattccgctgaccttctgtaattgcaaaaacatgcgtttcgaagcaagcgaggaaaacccatacaatgtaatcgcatcctgcgaaacattcaatgacgtgtataccttcaccgtctgcccagcgtgcatggacgccaaatccgccgaaggcatacgggtctcatatcccactcccccgacctcaataatcgccgaagcggcgtcaatgaaatcgacctggccatgcaacatgcctatcatgccgtcacctcccgcatacaactgtagaacatctgttcgatagtctacattcccctacggacgccgcgttgtcgcgccgccttctgtgaggccagagcccattgacgctgtgcatcggtcaagtgttgttcacgctctcccccctgtaacgcgcctgcggggcgaagcgcatgacaaatcgctatagccaacgcatcggcggcatcggcgggcttaggcaaggtattgagccccagaatacgggcgaccatgcgttccatctgaatcttttcggccttgccgttgccggtaatcgccatttttgattcagtgggcgtatgcaaggcgacgggaatgcccctctgggccgcagccagcatggccagtccggcggcctgtgcagtccccagtacggtgttgcgattctcctgtgcaaacacacgctcgatggacaccgtatccggtgcgaaccgttcgatcttttccaccaaaccgttatagatggctaacagacgtaagtcctgcgacattttcggatcggaacgtaccacgtccacatgaataaaagaaagccggcggtatgcgccggcttcgatcacgccgaccccgcagcgagtcagcccggggtcgacgccaagaataatcacgcttgattactcctcgtcaagctgagccatgacctcgtcagaggcggtccagttggagtagatgttctgcacgtcgtccagatcatcgaggttgtcgatcagcttggacaccttctgggcatcttcgagagtcaattcgacctcgttcttcggcatcatgaccagatcagcggaatcataatcgaatccagcgtcctgaagggccttacgaacgtcgatcatctcggacggaccggtgacgacagtgaacacgtcgccgtcgtccgtaacatcttcagcgccagcttctgcggccttctcaaacagatcatcaaaatcgacgccctcggccggaacgatgatctggcccttgcgctcgaagttgaagctcacggaaccggaggtagccaaagagccattgcccttggtcagggtggaacgcacttcggcggccgcacggttacggttatcggtaaggcattcaatgatcagaccgacgcctgcgggagcgtaaccctcatagacgatatcttcatagttggcaccgccggcttcttcaccagagccacgcttaactgcgcgcttgatgttatcggcaggcatggaagccttcttggccttgtagatggcgtcgtacagggacgggttgccgtcaggatcgccaccacccatacgtgctgcgatctcgatgttcttgatcagcttggcgaacagcttgccacgctttgcgtcgatggcggccttcttgtgcttggtggtcgcccacttggaatgacctgacataatgctcctaggcaggttgcggatgtttcaaacgaaacgattctaaagcggttctaagacaaagcgcccgacatacgtatgtcaggcgcgtcaacggccgtttcatgcagccggttcacaactgatacgtcttatgaccgacggccatctggcaacgagcctcaagaatgcgttggaatacggtaatgagtcccaaaaccgcaagcaataccatggcgatggccagccataacccttggtgcgtgagcccggtaatcgccatgcccaccagaatgatgaccaatctgtcggcacgcgttgcaatgccgtttttcacttcgaaaccgacggattcggcacgggcgcgcgcatacgacgtcacgaacgacgtcatcatcgacaccatggctgcggcgataccaatccaactaatgcaatccgggcttgaccggttgatgtcataccaccaatcggcatgcaggatgaagaagatgaccactccggcaagcaatgcccaatcagcgatacggtccaatgtggaatccaaaaaagcaccgaattgggtgcctcccgtggtcagtgccgcaattgagccatccagggaatcggcgagcaccagcaacgtcagcaccaccgctccggcgaacaaccatcccgtaatgccagtggcgaaagccaccacaatggttccaatagcgccaataaccgtcaccgcattcgctgtcaggccaagggataccagtgccttggcgaatggctcgataagtcttttgaatggtgcacggagatgttctaacatgcgaattcctgttcttcggaaagcaaaagggcgtgcaagcgtcagtatgtgatgcttgcacgcccccataattcataaccgtatgcgaccgaacgtgaacgaatcagatcagtctgcgatggcggccttgaaatcgtcgacgttgttgacctgaacgcgcttcttcagcacggtcatgatctgcgccttggcctcatcgaccggcacaccgttgagctggctgccgtcacggaagcggaagcttaccgcgttgttgttcatgtcttcctcgccgacgatgaggatgaacggcaccttcgacttggaagcgttacggatcttcttgccgaaacgatcatcggacatgtcgatttcgcaacgaaccgtctcctcttccaagctggcaatgaactgctgcaggtgtggggcgaattcgtcggcaacgggcacgccaagcacctggacaggagcgagccacgccgggaaagcaccggcataatgctccagcaacacggcgaagaaacgctcaatggagccgaacagtgcacggtgaatcatcaccggacgctggtgggtgccatcggcagcgatgtactccaagccgaaacgttccggaaggttgaagtcaagctggatggtggacacctgccacgtacggccgatggcatcgcgagcctgcacggagatcttcggaccatagaaggctgcgccgcatggatcgtcaaccagttcaagtccggattccttggcgacttcagccaacgtattggtggcctcttcccagatttcgtcggagccgacgtacttgtgcggatccttggtggacagctccagatagaagtcgtccaaaccaaagtccttcaacagaccaagcacgaaggtcagcaggttcttcagctcgtccttcatctgctcgcgggtgcagtagatgtgggaatcgtcttgagtcaagccgcgcacacgggtcagaccatgcacttcgccggacttttcgtagcggtacaccgtgccgaattcaaacagacgcaacggcaactcacggtaggaacgctgacgggatttgaagatcagattgtgcatcgggcagttcatcggcttcaggtagtagtcgaagccctgcttgacgacgttgccgttctcatccttttcctcgtccaaacgcattgccggatacatgccatccttgtaccaatgcaggtggccggaagtctcatacagaccgcccttggtgatgtgcggagtctgcacgaagctgtagtggtgcttgcgatgcatttcgcgggagtaatcctccatcgcgttgatcacagcggcgcccttcggatggaacacagccaagcccggaccgatctcgtccgggaaggagaacagatccatttccgcgccgagcttgcggtggtcacgcttggcggcctcctcaaggcgggtttgatatgccttgaggtcctccttagtggcgaaagccgcgccatagatgcgctgcagcatcggattggcttcgcttccgcgccagtatgcggctgcagaacgctcgatcttgaacgccttgatatagcgagtgttcggcaggtgcggtccgcggcacagatccttccacaccacattgccgtcacggtcgacgttgtcgtagaagctcagttccttgccgctgatttcggtggcggcttctggatcgaggtgggcttccttgtctttgatgagttcaatcttgtacggctgatcggactcttctgccagagcctcctcttcggtcaccacgcggcggcggaaggactgggaggacttgataatgcgctgcatgcgcttttcgatctctttaagatcgtcaggagtgaacggagtctcgacatcgaaatcgtaatagaaaccgtctttgatgaccgggccgacgccgagcttggcatcaggacggatctcctgaacggcctgtgccataacgtgggttgcggagtgacgcatgatggccaggccatcttcgctgtccaatgcaatcggttccacgacgtcgccgtcgtgcagttcggtatacaggtcgcggggttcgccgttaagacgcactgcgatgatattcttgtcttccgcgaagagctggacgccagtctgatctgctgccacctccttcgcttcgccgttgagtgtaatggagatggtctgttcagccatgagttgtcctttgctatcggggtccgcggtactaatgtgcaggcctggactgtatgtcaacgatgaacaagatagggttgagtgcagacatcggcacgctgaaagagtgaacagcatgctacagcgcgattatattttaacggatcgtatttgatgctattcgacgacatgcgcgtacgtgtattgtggcgcgcttcgtgtcgacgtgatctccaccttatcggatggcacgatcgacacggtggctccgtatttcactttcaaacgtgaaccgacgcctccagcgagattgaccgcgttctgcagattgtcgctgtctccaatcgccctgatgatgaacggcgccttgatattcgtaccgtcgcaatcgagaccgtccgccgtatcgctgatgtatgtactggtaatcacgcgaatatcgttgatttcaatgacttccgcgccgctattgcgtagttcctcaagtagggtgaataaaatcgacgcgtcaatatctcgctttgatcctttagaaatacggatgaccacgccttcgccggatactggtaaacgcccggaaagaatgccattcgattcagcgttctgcctggcgatttccgctgccttctcgttcttgtcggcggtatccttcagagagtcaagctgattggatagttcgcttttacgctgttcgagcttttgcacctgcgtactcgtttcgctaataagcttggtcagctcgtcctcgctcatcgtctcatatgtggaggtcgtgttgttcagctggatagcgtagctgaagcccagcaacgcgcaaagcacggttacgagcacgcttgaatacaggcgcgcgcgagtggccttcgcattcagcgaaaccctcttcggtttgcgcctgaccacaggaaacgatccggtttgggtgctgtcgttgttttggtctttgacgatctgctcgtggatcttggagagtacatccttgttggcatcgttgcgtctgctcatacgccgtcatcccttgaagatgaaacgtcggatggatgacacattggtgaagattcgaatgccgagcacgacgatgaccgcagtctgcagctgggaaccgacgccaagctggttgcctaggaaaaccaacaatgttgccgtaataacattcgagaagaaggaaatcacgaagaccttatcggaaaagctacgctgaaaataggctcgggcggcaccgagcagcgcatcgagcgccgccagcaccataatcggcagatacggctgaagcgcaatgggaatgtccggccggacgaacacgccaatgaccacgcctatgataagtcccaagaccgctgccattacttgaccttccttgcatatgtcacttcgccggtcaccgccgcttccagcgtaatcgatttgcttctgctcacctgcggatagataccggcttctttgaaatcatcgtacaaacgtttttgcgttttcttgctcaccgcattggcaagcgcactggaattgccgatcgcctcgatgcgataggggctttgcacggaattgacgccgataaggatcgtcgtccctgccgttcgtatggaagtctgcacaccgagacgatacccgttaatggcgatcgcctccgcaccggactgccaaagcagcgagacaagcacctgcagatcggaatccgtgaccacacggacttggctgccgttttcccttggcagtgacgaatccgcgttgtctccgctcaccgatattggattggcgatggtgagcgtgatgccttcgccttgcacaggaagtacgccattgaccatttcgtcatcctgtatggtctggttcagagaccagttcgacacggatttcgattcctcctcaacccgggctcgcagcgcgttcacgtctttggtgagggtttcgacgtttttcgtttgatcagataactgacttgacagttgcttgcgtacttccttacgtggatcggtactcagctgtcggacgaacacgcttcccgccgtgcctacggcaatgcagataaggaataccaaaacccgggtgaaccagaccgaaaacaatgacggagttttggtggccaacctcgagtccgtgtacatcacgtccatcggacgattggtcaaatcgtcaataagccgcaatgagtcatcatccagattccgccttctgcgcgaagtggatgtcacgatatcaggctgcacatgatgcgaagtcagcccggcgaaggacgccgagaaaacggcgcgccgcttcgtaggcgtattctccggagacaccgggaacgacgcacgttccggagcatcatgcatcatgtgagtcaatccttatcgttcttcagaagctggattccctgacgtatgtaaatatagccggcaagccagtacaatcccacaccccatatgccggtggcgagaccacacaaatgcaaagtatccgtagccgaattagaccagatatctgcgaaaatcaaggcgacaatggcaatcatcagcatggcggtgcctgcttttccaacgaaatgcaccggcagcggaccgtaatcacgctgcgccaaaaccagtacaagaatcgccatgatcaaatctcgcaatccgacgacgatcagcatccaccatggaatgatgccagcgactccaagcgcgagaatactgcagaaaatcaataatctgtctgcaataggatcgaggatctgcccgattttgctcacctgattgaacgagcgtgcaatcagaccatccaagccatcggacaccgccgacagcgcaagcacaatcaatgcaagcaccatctcatggcgagagaccaataccgagatgaagggaatcgaaatgattcgcaacaggctgataaggttcggaaccgtgaaatagatatcccgcggttccggactgtactgttttttgataatcagtttgctcatacttcgagcaatattacattctcgaggcctgcaaagcggtgacgattatgccacgagcaccaacttcatacaactggtccatgagttggttgaccttggccttcggcacaacgacacgcacggccgcccactgcttgtcatgaagcggggaaaccgtcgggctttcgaatccaggcgtgatgtccacagccgcggaaaccttctcgactggaatatcgtaatccatgagcacgtaacgctgagcagtgagcacgccctgcagacgacggctaagaatcgtcaaacgatcatcatcttcagcaagacgcggggaacgaatgagcacagcttcagaatgcaacagcggttccgcgaaaatacgcaggccggcgttacggagcgtggtgcccgtggataccacgtcggcgatcaaatcagccacaccgagttgcactgacgattcgacggcaccatcaaggtgtacggtttcagcgttgatgccatgctcagccagataatcatgcacaagcttgtcgaaactggtggcgacgcgcttgccttcgatatcttcgagcttgctaatcggagaatcattgggggctgcaaaacggaacgttgaagcgccaaagccaagctccatatgctccttggcatccgtaccggagttgagcagcagatcatgaccggtaatgccgacgtcgatggtgcctcggccaacgtagacagcgatatcgagcggacgcaggtagaacagctccacgtcattgtcgggatcctccacaaccagctgacgcggattgctcctcaggcgatagccggcctcggccagcatgttccatgcaggttcggacagcatgcccttgttgggcacggcgattctcagcattttccctcccaaaaaggccacgcctcctatggcacggccaaaaactcacagattcttgtagatgtcttcgagtgtgatgcctcggtcgatcatcatgacctgcagatggtagatgagctggctcatctcttccgcagtacgatcggcgccttcgtactcagctgcgatccaggtttcgcccgcctcttcgacaatcttcttgccgatgaaatgcgtgcccttgcccagttcgtcaacagtcaacgagccagcctgcttggctgcggccttctcgctcaattcagcaaagagagattcaaaagtcttcattattcgtatctatcctcgaaatattggtaggttcaggccttgaatgcggcttcagccttctcacggatggaatcaatggcttccgcaggatcctcggcaccatacacggcggaacctgcgaccagtacgtcggcaccggcctcggctacaatgtgcgcggtcttcgggctgacaccgccatcgacctgaatcttggtggcgaggccgcgacgggtaatctcgtcacgcagacgacgtaccttggccatctggttgtcaaggaacttctggccaccgaagccgggctcgacggtcatgataagaatcatgtcgaattcgtcgagaatatcgaaaatcggctcgacaggttcggccggacgcaccgcgaagcaagccttgcaacccatctcgcgcagctggcgcgccagacgcaccggagcgtgggttgcccccatgtggaagcttacggatgcagcgcccaacttggcatattcgggtgcccaacgatccgggtcctcgatcatcagatgcacgtcgaccggaagatcggtgacttcgcagatacgagccacaatcggctcgcccaaggtcagattcggaacgaaatgatgatccatcacgtcgacgtgaacgagatctgcattggagatggccttgaggtcgcgctcaaggttgcagaaatcagcggacaggatgcttggtgcgatttgaatagtcatggctcttattctatgaaaggtaatcgacttgctgttatttgatgccgggctgcttgtcggtattcgagacagtttcggcatcgttggttttgatttcatcaaccgtttgctcggggaaagacaccacggaatccgaagaatcctccgattcaccgttttcaagacgctgctcgatttcggtgacggtacgaagcttctccgccaacaggtcagtgtctttgcccatttgctgcacgacgatgaatgacaccgcgccgagcacgaacaccgccatggagacccacacattgatgcgcacgcccaagaattcgtgcgcataatcgatacgcagggattcaatccaagtgcgtcccagggtgtaccacatgatgtacacggcaaacagggaacctgccttgagtttcttcatggctttggaaccgatgtatacgataatcgcggcgccgatgaggttccagatcatctcgtacaagaacgtcggatggaacagcgtgccactcgggcatgtggctccgtcatagcactgttcgctatgcccgatggcagtgccttccatgttgagtttcaaaccccatggaagcgttgtcggagcgccatacagttcctggttgaaccagttgcccaagcgcccaacagcctgcgctaccaacaggcccggagcgatggcgtcagccagcaaggccattggatagtgcttatgacggcaccatgcccatgcggccagcgctccgaacagcacgccgccccagatgccaagtccgccattccaaatgcggaacatttccgcccagtcgccatccggtccgaagaaacgttcaggcgtggtgatgatgtgataaagtcgtgcgccgataatgcccgcaggcacgctgaccagagtgatatcaagcacttggtcgaaattgccacccaactttttccaacgtgtggtggttatccatactgcaaggacgattcccatcaaaatgcacaacgcatagatatgaatcgttactggaccgatggaaaactgcgaaatcgttggcgatggaatgtatgcaagtgtcatggtttcctgatggtagtccacgcatccgatatggtgcgtggaccaccgaaatcgtcagaatggtttactttgcgacacgcgcgttatggacgccgtccgcaagctcttcggctttggcggccaacgccttgagacccgtggcctcatcgactgcgtttttcccggattcgtcaagcatggtgtgcaccaatgcggatccgacgatgacgccatcagcgtatgagccgactcgcgcgccttgttcggcggtggaaacgccgatgccaacgcagacgttcttcgcgccggcattgcgcgtgcgtgccaccaactcttccggagaagcatcgatggtggaacgttcgccagtgacgcccatacgggctgccgcatagacgaagccgcgagcgttgcctgccacgaccttcaaacggctgtcggtggagtccggggacacgaggaagattcggtcaagtccatgacggtccgaagcttcgatccattcacctgcctcgtctggaatgagatccggagtaatcaggccggcgccaccggcattttcaaaattgcgtgcgaaacgttccacgccgtaatggtagatgaggttccaatagctcatcaccagagggactcccccggcgttggccacggtttcgacggctttgaacacgttcgcgattttctcgccgttgtcaatggcgatctgcgaagccgcttggatgacgggaccatccataaccggatcggaatacggcagaccaatctcgacggcatcgacgccatgctcaaccatggtgcggaatgctttcaacgaatagtcagaatcagggaatccatatggaagataaccgatgaatgcaggcttgttcgccgctttgaattcatcgaacatggcttccgtcggactcggcttatggctgatgccgagaggctgcccggacggcgtggttactgttgcgttcgtcataatggatactccttctttcactcgccgtccgcgttattgccctgggctccattggcttcgagcgctttggcttgctcgtcggtcagataaccgaaccatttgccggcagtgttcatatccttgtccccacgaccggaaatgttgatgatcatgaccggatgctcatatcccttggccttgagatcctcagccgccttgtatgcgcctgcaacggcatgggaactttcgatcgccggaataatgccttcggtctcgcagagatccttgaaagcgctcatggcttcctcatcggtcgcccaagaataattgacacgtccgatttccttgagccatgcgtgctccgggcccacagaggcgtagtccaaaccagcggagatggaatacgtatcgagggtctggccttcggaattctcaagaagatagctcttggcaccttggaacatacccagttcaccggttcccggtgcgaagcgaatggcatggcgtccggattccggaccattgccgcctgcctcatagccgtacaggttcacgcgttcgtcatcaaggaacgcattcatgatgccgatggcattggaaccgccaccgacgcatgcacaaaccgcatccgggtgatcgataccataccaatcctgaagctgctgcttagcttcctcgccgatgatcttctggaaatcgcgcaccatagccgggaatggatgcggaccggcaacagtgcccagcaggtagtgagtgtcttttacattggtaacccagtcacgaagagcctcgttgatggcgtccttaaggatgtgatcgcccaaggtgacttccacgacttccgcaccaagcatgcgcatacgtgcaacgttcagggcctgacgacgcgcatcgatttggcccatgtagatacggcacttcagtccaagcatggcgcacaccgtagcggtggcgacaccgtgctgacctgcaccggtttcagcaatgacccgagtcttgcccatgcgcttgaccagcagggcctgaccgagtgcattgttgatcttgtgcgcgccagtgtggtttaaatcctcacgcttgaggaacacgcgggcgtcaagaccagtcttttccctcagacgctcggcaaagcgcggcgcatcggtcaacggtgacggacgaccgacatactgctggttcaatcgagccagttccttatgaaattccggatcagccttggcttcctcgtagacacgttcaagctcgtcaagcgctgtaatcagcgcttccggcacatagcgtccaccgaactgaccgaaatacggtccttcatgacttgccaacggggtttgttcggatgctttcactcttgctcctgcctttactagtcgctccacagcctgttcatggttggatgcggttgcgacaccttcgccaaccagcaccgcgtcggctccggcgcgggcataatcctcaagttccaccgatccgaacactccagattccgctacgcggatcacatcgtccggcaaatcggcggcaagctcgttgtatttgttcacatcgaccttgagatccttgagatttcgtgcattgatgccgatgactcgcgctccggcattgatcgcgcgctgaatctcctcgcgagtgtgcgtttcgaccagcaccgtcatattgaggctatgcgccagttcaagcaaagacttgagcttgtcgtcatccaacgcggcaacaatcagcagcaccaaatcggcgccatgcgcccgtgcctcccaaatctggtattccgtgacaatgaaatccttgcgcaacactggaattttcacggctgcacggaccttatcgaaatcatcaagcgatccaaggaatcgacgaccttcggtcagcacggaaatcgcgctggcacctcctttttcgtattccctggccaatgcggcaggatcaggaatgtcgctaaggtgccctttcgatggcgaagcccttttaatctccgcgatcaccggaatgccatccgcttttttcagccactgtcgcgcatcaataggggccggcgcttcgaatgtctgacgcttcacctcatcaagggaaatgttctgttcacgtgctcgttggtcttcgacagctcccgccaccagttcatcgagtacagacatggtgttcctttcagcattttactcgattggttagcttgatttgactcacaactggcgaagctgcgaggcgatctgcaccgcttcgacgctggcctcggccttgttgcgagtctcctgccactcactggccggcacggaatcaagtacgattccggctccggcctgcacgctcgcttcatggtcgcggatgaatgccgttcgaatggcgattgccatatcgaggttgcctgaaaaatcgaaatagccgacagtgccgccataaatgccacgatctgcgggctcaagctcgtcgatgatttcaatggcacgtggttttggcgcaccggaaagcgttccggctgggaatgccgacgtgaacacatcgaacgacgtcatgtcggggttaactcgcccggtaacggtcgaacagatgtgcgtaatgtggctgaatcgtttgatatccatcaaggatacgacttccacgctttccggaagacatacacggctcagatcattgcgggaaagatcaacgagcatgatgtgttcgctacgttcttttggatcggcaagcagatccttggcaagttgctcgtcttcctcaatagtggtgccacgaggcctcgaaccggcaatcgggaaggtcatggcatggccattgtccactttgatcagcgtttccgggctggatccaataacgttgaagtcacgcccctgcgcatcggtcaacgacatgaaatacatgtatgggctggggttgagcgtacgaagcacgcggtacacgtcgaatggatcggctggcgaatcaatgtcaagacgctgggaaatgaccacctggaacacgtcaccatcgatgatgtgctgcttggcgatttcaacggaacgctcataatcgctcttctccgtacggaaacgaagctcgggctggctaatggtctcatccaacacattgatgcgagcttcaccttcgacaggcgtggcggccttacgctgcatatcatccaatcgcgccaccgcctcgtcgtatgccgcatcggcacgggtggatcgatcgtctacgttcaccgcattggcgatcatccataccgatccggacacatggtcgaccacagcaatatccgtggccaatgccagaactgtttccggctgcccggtctcgttcggcgcctcggcacgcaaggtcggttcccaatggcgaatcgcatcccaaccgacggtaccgaccagaccactggtcaggttcggcagtccttcgacatgcggcgctttcagtgttttcagcgcagcatgcgcgacttccatcacatcgccttcggtaggcacgcctgcgggaacctgacccaaccaatcggccttgccgttgttggaacgcaactgagccatggaattcacaccgatgaagctgtatctgttccacgtgccgccaaattccgcggattcaagaatgaatgtgccggaacgtcctgcagcaaggcgttcatagaatccgacaggagtcaacgaatcagccagaagtcggcgcacaatcggaatcacacgatatccctgatcagccaattcgtggaattgttcgcgactcggccaggtggcgccccacttgagtgcttgtacgctgcattcactcatcgctggccctcctgttccttggtacggtatcctacgaccacgggcagttgcccgccttcttcgaagcaggatcgtttgccggtatggcaggccgctcccacttgatcgacttcaaccagaatggcatccccatcgcaatccagtgcgaaggacttcacatactgggcatgtccggaagtgtctcccttgcgccagtactcctgcctggacctcgaccagaacgtgacgcgaccagtcatcagggtgcgtcgtatggcttcgtcgttcatgtagccgaccatcagcacttctttggtgtcgaattgctggatgacggctgccaccagtcctttatcgtccctcttgagacgttctgcgattcgtgggtcaagaatagtgctgttgtcgtatgcttcgttggtcatgatggtgttattgatttgtttcttcgattattgattacgttattcgcctgttttgcggttttcggctttcatcgcacggtatagccggcggccttgatggcatccttgacttcgccgatggtgactttgccgtaatggaagatcgacgcggccaacacggcatccgctccggcttcgatcgccggggggaaatcggcagccttgcccgcacctccggaagcgatgatcggaatcttcacttccttacgcacggctttaatcatttccaagtcaaaaccctgttgggtaccatccgcgtccatggaattcagcaggatctcccccgcgcccaactcctgagcacgcttgacccaccagatagcgtcaatgccggtggatttgcggcctcccatggtggttacttcaaagcccgactgagtgtgtcgctcgccctgctcacggcgtgcatcgacggataatacgagcacttggttgccgaatcgttctgcgacacggccaatcagcgtcggatcattgatggccgcagtgttgactcctaccttgtcagctccgcaacgcagcagagaatccacatcttcaggggcacgtacgcctccacccacggtcaatgggatgaaaatctgttcggcagttcgactcaccacatcgaccatggtctgccgatgcgagctcgaagcggtcacatcgaggaaagtcagttcgtcggcaccctgacggtagtattccgcggcaagttcaaccggatcgccggcatcgcgaagattctcgaaatgcacgcccttgactactcgtcccgcatcaacatcaagacatggaatgactcggactgccagtgacatgctattttactccttcgcgcataatcatgtgtgcaacgaatgcaagagtaaccgttttacgttacgcatgttcgtcggaagtccgagtagcggacagaacaagcatctttccttgaaatctaatcttgttccttagctgcgagctgcccgcatgcaccatcgatatcctgcccgcgcgtgtctcgcaacgtcgcagtaatgcctgctttatgaaggatatcaaggaactgctgttcatcctcaggcttcgaagcggtccatttcgatccttcgatgggattgagcggaatcggattgacatgagcccaattgtcaccataatggttcaatcgcttagcaagtaatttggcatgctcggcttgatcattgataccgcgcatcagagcatattcgatgcttacgcgacgtttcgaagccaagtaatagtcatgtgccgcatcaagcacctgcgtagtattgaaacgcttgttcattggaacgagctcgtctcgcaactcatcgctcggagcgtgcaaggacacggccaaacgcaccggaatgccttctgccgtgagtttcttgatacctggtaccacaccgaccgtggagacggtgatgttgcgtgccgaaatgccgaaaccttcaggtggcatggcgctgatttggcgtacagcgctcaatacggacttgtaattgcccataggttcgcccatgcccatgaacacgatgttgctcaggcgcccgagaccaccagcgacttcgccgtcgtgcatggctttcgcggccacacgaacctgttccagaatctcgcctgccgacatgtttctcgtcagacccaattgacctgtggcacagaacgggcagcccattccacagcctacctggctggaaatgcataaggtggtgcgggtgggataccgcatgagcacggactcaataagagaaccgtcgaacagacgccatagcgttttgatagtagtgccctcatcggccacttgacgggtcacttcggtaatgagcgttgggaaaaacgcctctgcggcttcggctcgtttcgctgcaggaaagtcagagaactcttcggcagcgacgtcgaaatgcccatagtaatgattggcaagctgcttgactctgaatttcggaagtccaagatccttggctttcgcgatacgttcgtcttcagtcatatcagcaaaatgcagcggcggcttgcctcgacgcgcatgatctttggaaagcacgtcgcggaaggcaccggtagtgcctcctggagtaataccggtttccggcaaatccttcgtggaattcacggagtcgctcatgcttgtgtttgcctttctcacattccagttgcccacagcagcacgcacacgaacggcgcgcacagcagaatggaatccacacgatccatcacgccaccgtgtcccttaagcaggtgtcccatgtccttgatgccgatatctcgcttcaacatggatgcgcacaaatcgccaaacgttccggcgatgccgatcatgaaaccggccacgacaggaacccaccagcgggaaatccacacatccgacccgtacgtgcagaacatcacggcaaaagatccgatcatggagaacagaatggaacctgcaagaccctcccacgatttcttcggcgaaatgcgggggcttagcttgtgcttgcccagccatgccccggcgaacaaaccaccggtatcgctcaacgcgggcatgaataccatcataatagcatgcgcgacgggatgatcattgaatgtcaacggcatgatgaggcaggaagccagaagcggaatgtacagcacggtgaacatggagaccgcgacatggctcagcctgctatggcttacctctccctgctcatggttgaaggaggattcaagtcttgcgcctgcatcggtgtgggaaagcttatccgccacggccagagagatgcggctgccgaacgtcactttagcgctggcggcgatcgctacgaccaccaaagacaccagcacgcataccgtcatggcgacgatatgacgttcgctgtaataggtggacagcaacgtcgccgccgaacatacccacaacaccgccacgggaatatgaagtcccgcagtggcgaaatcgacgcgcagctcccaaagggcaagcaccatgaacagcacaaccagatagacgaacaagtcaatgctgatcagcagacacgccaagatgaggatgacgagcaccgcccctgtggcgatggcctgcggcatattacgccccgtcttcttgttgatggcgttgatggcctcttcggtttctttttcgagctgttcctgatgttccatcatgttccctgtctggctgtgcgtcgattcttttcaggagatgaaggtctctcagacctccatgatctccttctgcttggcttcgagcagggtatcaagttcatcagtggtctgcttggtgatcttgtcgagctccttgagcagacgatcgccctcgtcctcacccatctcgccgtccttgatggccttgtcaagggattccttggccttgcgtcggatgttgcgcactgcgaccttgccatcttccgccttgcccttggcgagtttgacatattccttgcgacgttcctcggtcagctccggcatggtcaggcgaatgacgttgccgtcgcgacgcgggctggcgcccagatcggaatcacgcaacgccttctcgacggcattggcctgggacgcgtcaaacggagtgacggacagggtacgcggttccggcacgccgatggtggcgacggccttcagcggggtcggagctccataataatcaacggtgataccgttgagcagcgccggattcgcgcggccggtacgaatgccggagaagttctccttggtggattccacggacttggccatctgtgccttggcctgttcgacaatagttgccatttgtactccttgttgttggttgtttgatcgatattcgacgttgaatgtcgttattcagcgagtgtggactccgcggtggaaaccatagttccgatttcctcaccgagaagggcgcgggtcacattgccattgccttcgagcccgaaaacacggatgcgctgcttgttgtcgcgggccatggaaagcgcggatgcatccataacggcgagattgtcgacgagggcacgattatagctcaatgtggcgaaacgcttggcgttctcgtccttacgaggatcggcggtataaacgccgtccacgccgttcttgcccatcagcacctcatcgcaatggatttccaaagaacgctgaatggacacagtgtcagtggagaaatacggcataccggcaccagcgccgaaaatcacgacacggcccttctccagatgacgaatggccttgagcggaatgtacggctcggcgacctgacccatggtgatggcggtctgcacgcgcgtggcctgtccctcctgctccaagaagtcctgcagagcgaggcaattcatcaccgtgcccagcatgcccatataatcgccgcgggagcggtcgattccagcctgttgaagttccgcgccgcggaagaagttgccgcctccgacgacgatggcgacctgaacgccctgctgcaccgcgggaacgatttcctcagcgatacggcggatgacggacgtgtcaatgccgactttgccgccgccaaacgcctctccggatagtttgagcagcactctgcgtggattatcaccagtgttttcgccagtcatgaaaagcctttcttgcccgagaactcacgaaatttaccgctctcaagagtatcggcaaacacagacaccacaccgcaacgacacagcgtcgagaagaaaacaaagttggccatcaccctgtggatgatggccaacctcatggaatctctagcgtctaacgcacggattcaccattgaagccgaattcactcagcctcgcccttgccgacctcgacacgagcgaaagccacggctgcgccgccgacttccttgaacaggtcgccaacggtcttggacggatccttgacataggactgctcgagcaggacgttctccttgtagaaggcattgagacggccttccacgatcttcggaacgatcttctccggcttgccttcggccaaggacttctcggtggccacgcggcgctcggactcgaccacatcggccggaacgtcctcgcgggtcagccactgggcacccattgcggaaatctgcagagcggcttcgtgagccacagcagcgccggcctcatcggtggcgatcatggccacgatgctcggcggcatctcagcggacttcttgtgggcgtagatctcaacgtgtggaccctcgaccttggcgaactggccgaccttgacgtgctcaccgaacagagcggccgcctcttcgacggcttccttcacggtggcttcgccggaagcggctgccagcacttcgtccacagaagcggcctcggctttgacggcgtcttcgagcacgctgtcagcgaactccacgaacttcggagtcttggccacgaagtcggtctcggaattcagttcgacggcgtaaccggtctggccattggcggattccacgacctgggaggcgatggtgccttcctgagccttgcgaccttcgcgcttgccagcggcctggatgcccttggcgcggatgatttccttggcgcgagccacgtcaccctcagcctcggtcagagccttcttaacgtccatcatgccggcgccagtttcctcgcgcacctgcttgatcagagctgcagtgattgctgccattgatttgtctcctctgaaaaatagtgatgccccatatgatgggaggcacaacacctcccatcatagtggatattttcactcagccttggcttcagcttcggcttcggcttcagccggtgcatcggcggccggagcgccctcagtgaggagctccttctcccaagcggccatcggctgctcggtctcgccctcagccttagcggccttgccggaacgctccagcaggccttcggccactgcgtcagccatgaggctggtcagcagttcgatgccgcggatggcgtcatcgttggctgcgatcgggtactcgacggactccggatcagcgttggtgtcgacgatggcaacgaccggaatgcccagcttgtgagcttcctcaacggccaaagcttccttgttaacgtcaaccacgaacatggcggacggagtacggttcatgttgcggataccgcccagctgcttagccagcttgtccttctcgcgctcgagaagcagcagttccttcttggtcagaccggaaccacgcacgtcggtgaagtccatctcttcgagttccttgagacgggagacgcgcttggacacggtctggaagttggtcagcataccgccgagccaacgctcggaaacgtacggcatgttcacgcggacagcctgattggaaacggcttcctgagcctgcttcttggtgccgacgaacagcacggtgccgttgtgagcgacggtagccttgatgaagtcgtaggccttgtcgatcatgtcgagcgacttgaacaggttgatgatgtggatgccgttgcgctgggtgaggatgaactgcttcatcttcggattccaacgacgggtctggtggccgaagtgcaggcctgccttcagcatgtcgctcatattgatctgagccatggtattactacctctttctgtcggttcttgcctggtcatgcgttcctgcgtgcagccaaagccttgcggcgtcggccgaccgacacaggtcgtcgcgaacatgacgcgaattggttgtatgccggttgacaatattgggtggctcaggactttcacgacaaagcccttcgccggatggcacacaaggcataaaataccatggggtcacgtcttttcgcaaagacgtgaccccaagtcgtcatatcggtgagatgcgaacaatcacttgtggtgattgcgcatgtagcgcatcgcctctcggcgttcctctttctccaaacgatcaagatagacatgaccgttcaagtgatcggtttcatgctgcaacatgcggcccataatgccacgaccttccagcacgaccgtcttgccttccaaatcgatgccacgcacacgagcgtaatcggcgcgacgggtcttgtaccacaatcccggcacagacaggcatccctcatctccgtattgttcaccgcaggtctcttcgaggacagggttgagcacatacccgatcttgccgttgatgttataggaaaatgccctcagattcacgccaatctgattagctgacaagccagcccttcctggatcgtcaacggtatcaagcagatcctgtaccagatgacgcacggccggcgtaatttccttgataggatcacagggggtacgtagcaccggatcaggtacgactcgaatctcacgaattgccaagattatcgctcctcgttcatggttgtttcctcagtttccgatgagtcttccggcgtttggaactcgccggcgtcttcggtctgcttcttaattttctcctgcatggtatcaaatgcctgccgaaccttcggacttacggattcggaagcctgacgcatggattcggaagcctgcttgaccgtttcggtggttcggtcaagaatctgcaccgtctttggcagcggtttgttggatggcttcggcgcatacagcacattgtcgatgacattttcgtaccgcttaagcaccttcggcctgacaactttcaggctcgccgtcagagtgcccttctcctggctgaactcctcgtcgaggatttcgaacttgcgaacggattcagcacgagagacattcgcattcgccttttcgacatactgctgaatgaatgcgcgcacggcatcgttcttcgcgatctgctccatgggcatgttgctatcaagtccctgctgtgcaagccaggaacgaaccatctcctgatcaagctcaatcaaagctccgatgaacggcttgccatcaccgaccaccacaccatgcgacacgatcgggcaagtgttgatgacatcttccataggtgccggactgacgttcttaccgccggccgtaatgatgatatccttcttgcgacccgtaatgtacacgaatccgtcgtcgtcgatggttcccaaatcgccggtcttcagccagccatcagccatcctgacatcggctgtcagctccggcttcttgtagtagccaaggaacacgttggggcccatcacctgcagttcgccgtcgtcatcggtgcgcacgcccatgcccggcccgggcttgcctacggaaccgacgcggttggcgtcctgccagttgacaatcatgggagcggcggtttccgtcatgccatagccctgaatgaaggtaatgccatccataccgttgaagaaatgggcgagatcgacgttcaaaggagcgccgccacaagccagatatctcatgttcggacccaaagcagaacgaatggatttgcctacgacagacataaagaacgaatgttcggcacgagccacaatggaatggcgtccggtttcctgctcgtccttcgaccattgcacaaaatgatcgaaagccttggcgaacactcttccacgaatacccgctccggccttttgcgaagccgcgttatacactttctcgaacacacggggaactcccagcagataggtcggcttgaagctacgcagatcggcaagcagatgcttggctccgggcagatagccgaccaccccctgcccgccaatcgcaacatactgaatatagcgagcgaagcagtgcgccaacggcaggaacaacatcagacgattcggctgatatagcatttcatcgagaatgatgtagccgttcagcacgatatgcgtgaaattccggtgagacagcatcgctcccttgggcttgccagtggaaccagacgtgtacacaatggtgagcatgtcatcggccttgaccctggaaatcacctgatcgagcgtgtcctcgccgacaccttctccaaaatcagcaacggcatcaagaccatccgccttgaagttgaagacgtagcgcaggctgctgtgctcatcgcgaatctgttcaagcgtttgtgtatgcgcgaaatcaccggcaaaggcgatgatcggatccacctcttcgatgatggacgcggcctgcctggcggaatcggtttcatacacgggcacgcttaccgcgccgattgcggcgcaggcaaaatcgatgactccccattcgtagcaggtaggcgaatagatgactaccatgcttccggccttgacccctaggccaagaagacctttcgcaaccgcgcgcacacgctcaagcatctcccccgccgtaacgtcatgccatcgacgagtctcgtcgtcctgccattgggcgatgagatcatcaggatcacgtttagcgcgtctggagagcagtgcgaaaacggtatcctcatccgtagtgctatacgcaggttccggtacaaattctctcaacatgagtccctatagtagttgcagtatgctcaaggcacgctgaaaacccttgaaaacggctgaattcagccaattccaagggttttgaatggttacttgttatacgtcacacgccgaaatcagcgacttcgcacttccaagcagatcccttgaggacgcacttcaaattgctgcacagccttcgtcctccaatgcccatcagcacggtgctttcgaagcatgtcggagagaccaaccagctgtcaacgtaatatacggtgatcggaagcagacccaactgcgcgtatatcctcacatccttcttcatctgtgctgcgatctgagcggaggcatttctcagctttctcatgcaggcctcgctcaataccctttccacgcgtgcttctttctgcctgccacggaagatatcgacaacattgcagatcaactgcgccgcgaacatgttcatggagtaggcaaattcagcatcgcacggcccaggcattatctggatgtaatggaatggtattttcctgccgaaaagatctgaattaagaaacccatcatacgagggaagcgttttatcgtaatcgaaaaccggctttctgccaagctcaagagatatcctttcccactctgtcaggttttctccctcgcgtttcttcccacttttatcagcgcgcttcgcattggccgctgatccctggtcagaaggtggaacctccgagaagggctcgttagcctccggcggcggaacatcattttcacatgaatcatccatgatgaatccctttcttattcgcccgactcatcgttgagagggggtgtaagaaccattaaggcacaaaagccatcccccgtcaagttgacatttgattcttgtggataagtggataacttcagatatttcaaacactttagaacaccctaaagataaattttatacccctaaaacattacaaaaaaggtggcatatcgttgaaaaagcaaagagaatccttctttggcgaaaaaccctaagttcgtctcaaaaacgcttagtaaaaatgaacggcattagccttcactgaaagataatgatcatgtttgttcgtatatgctcacataaagttatgttaccgggcatacactcctctaagtgcgctcaagaaaaataaaaaaaattggctctgcggcattcgccgcagagccgtctgagaatgggctcccccacctggactcgaaccaagacaaagggttccaaagacccgtgtgctgccattacaccatgggggaatggcggaaaaccttgcggttaccgccaagtgtctattatgccacatgtcgccaacaccgcgtgtctcgacgtgtcgcactaataaaaaacgttgtttaaggtgcacaaaaagtgttatgcgcaccttaaacaacggtactcgcttcactgatatgggagttaccccacaaacatgcggaacgtacgctaagcatgcccgcacaacgcgtcatcaggcgaacaagaagccctgtccgtgatgctccggatatgtgtcgaacaactcagccacagagccgtcttcgaacacagcacggatggcgctggccagcagcggcgcgatcgacagcacggtcaaaccgtcccaacgcttctcttcaggaatcggcacggtgtcggtaagcacgacttcgcgggctccgctgttcttcaaacgttcgacggcgggaccagacagcacgccatgtgtggcgacgacagtcaccgacttggcaccggcatccttaagcacgctgcatgcaccggcaatggttccggcggtatcgatgagatcgtcgacgagcacgcagtccttaccttcgacatcgcccacgactcggttggcgaccgcttggttcggacgggtgatgtcacgcgtcttgtggacgaatgcgagcggaccaccgccaagacgctgcgcccactgctccgcaacacgaatgcggcccgcatccggagagacgacggcaacattgtcaagctggttggagaaacggtcgcgaatgtagtcgaccagcaccggcatagcgataaggtggtcgacaggaccgtcgaagaagccttgggactgcgccgcatgcaggtcgacactcatgatgcggtcggcacctgcggtcttcagcaggtcgaacatgagacggcaggaaatgggctcgcggccgcgatgcttcttgtcttggcgcgagtagccaagcagtgggcagaccgcggtgatggaacgcgcggatgcacgcttgagcgcatcaatcatgatgagctgttccataatcgattggttgatcggggctgcgtggctttgcagtacgaacacgtccgcgccacgcacggattcggtgtagcgcacgtacatttcgccgttggcgaagtcgtatgctgtggtttccagaacatcaatgccaagttgttcggcgacttccgccgccagtttcggatgtgttctgcctgtgacaaggataaggtttttatccggctttccttcaaggattgcgctcaccatgtctccaaacgtctgttttcgcgtcaagtggacgtgacccatattaaccatctgcgcagaccgtctcacccgcgcgtgttcacctgaaatttaccggtacagtccgtgcttgccaatatattgcaccacgccgtccggtacgaggtaccaaacaggctccccatgctccgcacgtcgccgcacatcggtcgaggaaatcgccagtgccggtatttccaacgtatcgaccttgccttccggcagtttcaccccttccggcgatgagtacccggggcgggtcacggccacgaagtgggccagatcccacattttgtcggcgtctttccattgcatgatttccgcgaccgcgtcagctccggtgatgaagaagagttccgcgtcgggatgttgcgcacggatgtctcgcaacgtgtcgatggtataggtgactcccggacggtcgatgtccacgcgtgatacggtgaatttcggattggacgcggtggcgatgaccgtcatgagataccggtcttccgcgttggtgacgttcttgtcgagtttgaatacggggcgtcccgtcggcacgaagatcacttcgtcgaggtcgtacacccacgacacttctgaggccgccaccaagtggccgttgtggatggggtcgaacgtgccgcccatgatgccgatgcgaggcctgctatgccagttgccgcgtgctgaacgtcggcctgtggccaccgcggaacctgctgattccacggaaaggtcggacatgcgccgttccggttccaccacatagctgatggcaagttcggaatcggcttcggcggattcgggccgcatgcgtttcgggccggtcatgaggcatcctcgtttttttgttcctgatcggcgtccgcggtctcacggccgatgctgtctgccgttggcgatgcgttgtccgggtcgattttgcccatatcctcatcccactcgtcctgcacgacgcgcctgatctccgcgaaagtcggcagagggaagtccggctgataggcgcgacgcacttccgccacacgttcggtgacgcgaatcagcgtatcggtcatgccgtcaatatcctgttcgcgctccatggcgctgaatttggcgatgtactgttccatgagccgcatctgctcatcgacgcttttaagcttctcttcgtcgagttccaccacgtcttcggcatcgacttccggccaaccgatcagcaccgcgtcggcgtattcgagtgaagcacgctgtgccgccgatgcgatgccgtcctcgatctgcacgagaaacacgtatcgtacgatgcttaatcgttcggatgcgagcttcaatcccagataggggtcattgagatccgcattccatgggttcttagcgtcagtcattgtttcctccatctggccgtcattattgttgtgttcgttcatgcccgtacctggcctgttccgtagccgatccacttggtcgtggtcatttcgcgtagtcccatgggcccgcgtgcatgcattttttgcgtggagataccaagttccgcgccgaagccgaacactcccccatctgtgaaacgcgtggacgcgttgaccatcaccaccgccgagtcgatgcgtgaggtgaattcctcaatggccgaatagtcttcggcgataatggattcggtatgccctgtggagtggcggttaatgtggctgatggcctcgtcgagtgagtcgaccactttgacgccgatcttcaacgcgagatactcggtatcccagtcttcctcagtggcatgtatcagtttcaccccgtcaataccggttttgtcgatgatctcgtaggcctgttcgtcggcatgcacttcgacgtcggctgcggcaagcgctgtggcgatttgcggaaggaacgcttcggcgatgtcactgtgcacgaggagtttttcagtggcgttgcagacgccgacgcgttgcgttttggcgttgagaatgatggggatggctttgttttggtcgccggttcggtcgacgtagatgtgtacgttgcccgctccggtttcgatgacgggtactttggagttttgcacgacggcttggatgaggcccgctccccctcgtggaataagcaggtcgatgtggccttgggcctgcatcatggcgttggcgccttgacgcccgtattcgtcgacggaagcgatgagtgcggcatcatatccgtgttcgtgcaatacgtcggcgatgatgttgagggtggctgcgttggtgcgttcggccgcgtgtcctcctctgaggagtgccgcgttgcctgatttgatgcagagtgacgcgacgtcgacggtgacgttgggtcgtgcttcgtagatcatgccgagcacgccgatgggcacgcgggtttgttcgagtcgcagaccgttgtcgaggtggtatccgcgcacgatttcaccgatcggatcctgtagggtggctacgtggcgcacaccttgtgcggctgcgttgacgcggggtacgtcaaatttgagccggtcgagtttgcctgcgtccatgccatgttcggcggatttctgcatgtcgatggcgttggcttccgcgatttcattggcgcgcgcgtcgagtgcgtcagcgatggcgttgagaagttcgtttttacgctgcgtgttggtttgggcaagttgcgcttgcgcgattcgggcggcgtcggctttggcgcacacctcgttgagcacatcgggctccatggcgttggattgggtctgtgggttcgtcataatttcctagattagcgcgaaatcgcgccttgttccgtagcttcgaccattatttcgtcgtagcatcggaaacagggcgcgatttcgcacgtcacgtgtcctcagagatttatatccgaaaccgttctcgatcaaccgttattcgacatggaatcagtggatctgatcgagacccggatacagcgggaagtcttcggcgagcttgtcgacgcgagccctgagggcttccacgtcggcatccttgcctgctgcgagtgcggttccgatgatgtcggcgacctcttcgtattccttgttgccgaagccgcgggtggcgagggcgctggtgccgatgcgcagaccggaagccacgcttgccggacgcggatcgaacggaacggtgttgcggttgatggtgatgccgcactgggcgaggaggtcttcgccctgctggccgtccatttcgctgttgcgcagatcaaccatgacgaggtggacgtcggtgccgccggtgaggacgctgatgccgttgttcttgacatcgtcggacatgaggcgttcggcgaggatcttggcaccgtcgagggtgcgctgcatgcggtccttgaactccggagaggctgcgaccttgaacgcgacggccttgcctgcgatgacgtgcatgagcggaccgccctgctgacccgggaagaccgcggagttgagcttcttggcatagtcctgcttggcgagaatgaaaccggaacgcggaccgccaagagtcttgtgagccgtggaggatacgacatcggcgtacgggaccgggctcgggtgcagtccggccgcgacaaggcccgcgaagtgtgccatatcaacccagaacttggctccgacttcgtcggcgatttccttcatggccttgaagtcttcgatacgcgggtaggcgctccagccgccgatgatcatggccgggtgggtttcaagcgcgcgctggcggatgatttcaggatcgatgcggaaggtttcaggattgactccgtaggcttcggcatggtagaaacgtccggagaagttgattttcatgccgtgggtgagatgtccgccatgatcgagggcaagaccgagcacggtgtcgcccggcttgacgagcgcctggtagacggctgcattggcctgtgcgccggagtgaggctgcacgttgacgtattcggcgccaaacaggctcttggcacgctcacgggcaatggtttcgatcttgtcaacctgctcgcagccaccatagtagcggcgtcccggatagccttcggcatacttgttggtcagcacggaaccctgagcctgaagcacggcacgcggcacgaagttttcggaggcgatcatctccaagccgttctgctgtcgagacaactcagcgttgagtacctcggcgatttcggggtctgcttcggcgataggcgcgttgaacatgtcgttcggagtttgcgcgagaggcgatgcggtcattgagctctccttggcttggaggataaatacgttgcccgtacgaacgtgcaggcttaacgatgaagtgtacgtgcacaaatcgcatgagggaatagggcgtttcgaaacatggaagcaatcacgaaacaagcaggaaacaatcaccacccataaacacgcatcgtcccattccacggacgccaaacacgcttcttcccgcccataacgctacactcaatattgtttgacgttcattgtccgttctattgctaaggaaatccagtgaccacgttccacagcactcgcagcaccaccgattcactcacctccaagcaagccatacgcaaaggcatcgccgacgacggcggcctgttcgtaaccgactcactgggcgaaacccacgtagacgtcgcatctctcgcaggcaagccctaccagcagatcgcattcgacgtgctgagcgtgctgctgcccgacttctccgaaaccgaactcaaggcatgcatcgatgaagcgtacggcgcgcaatggtccgacgaaaagatcaccccggtcaagccgctcggcgatgactacgtgatggaactgtttaacggcccgacctccgcattcaaagatgtcgcattgcagatcctgccgcgtttcatggcacgcaccaccccggccggcggcgacggcaacgagaaaatcatgatcgtgacagccacctccggagacaccggcaaggcggcgctcgctggtttcgcggatgccgagggcacaggcatcaccgtgttctatccggaaggcaaggttagccaggtacaggaactgcagatgagcacgcaggctggttcgaatgtgaatgtctgcgcggtgaagggcaatttcgatgacgctcagtccgctgtcaaacgcattttcggtgatcgtgagcttgccaatcgtttggcttccgattcgcatgtggtactgtcttccgcaaattcgatcaatgtgggacgtttggtgccgcaggtcgtctattatttctccgcttacgcgcagctgctcgaacagcaggtcatcaatgtcggtgatgaggtcgagtttgtggtgccgaccggtaatttcggcgatattctcgccggatattatgcgaagctgttaggcttgccggtcaagcatctggttgttgcgtccgataagaacaatgtgctgttcgatttcctgacttccggcacgtataaccgtcagcgtccgttctatcagacgatttccccgtcgatggacattcttatctcctcgaatctggaacgcatgctgtattacatgtccgacaaggacactcgtctgatcgccatgctgatgaacgatttgaaccagtggggcgcctatgaggttcccgaaccgatgctggccaagattcgttccctgttcggcaccggctgggccgatgaggatcaggtgcgtgagatgatcgcggattgctggaacaagaaccattatgtgatcgacccgcataccgcgtgcggttattacgtgatgcagcagatgcctcgcgatccgctgacgccgcgcgtgctgctgagcaccgccagcccgtacaagttcccgcgcgtggtcaacgagtccttgggtttggatgcttccggcacggatttcgaatgcatggacgtgcttgccgaggcgaccggcactaccgctccggccgcgttgcgcggtttggagaccgccgacgtgcgtttcgaccatgtcgttgacatcgacggtatggaaggttttgtcgagcaggccgccaaagctctgtaaaaactctgtaagcgaagcatactttcacatcgttaaagccatctccatcggccgtccgcaatatgtggacggccgtttttcgtcaaggctgctacagttgcatgctcggaggcgaacaagcatgacagcaccaacgatacccgcatctgaatcggtacgacagaagcaaccggcacaacaatcgaaccagcccgaacagccccggcgtaagcatgatcgtctcatcacccgtgatatggcgttggtcatgcttgcgacgttctgtttcatgtcgagcaatatgcttgccaatccgatcgttgccggatatgcggaatcgttgggcgcggacggcatgctgatgggtgcggtggccgggtcgatgagtttcatctcactgttctgccgccctatcgcaggcaatctttccgacaaaaccagcaagcgcacacttgtggcggttggcacggtgctctatttcgccgccggactgctgtactatttcgcaaactcccccatcatgctcatcatggctcgcgtgatcaacggcgttggtttcgcatgctgctcggtctgcctggccacgtggatgtcgcttttgctgccgatccggcatatgggtgccggcatgggattgtatggcacgatgaacgcgctggctatggcggtcggaccggcattgggtattcgcgcgcaaaaatacatcggttatcgtctgacgtttttgagttcgctggtgctggcggtgatcatgctgctcgccacactgatggtgaagaatggcggacagccggtacgcaaaaagcagacttccataacggagaatccctccactgccgtagacattgacggttctgctagcgcaaccaaaaagcatcgtttttcgatccgttcgattctagaaccgcgtgtggtgccgttgtcgctgacgttcatgatgtttgctatagcgtatttcgcaaatcagtccttcatcgtgagttatgttcagtctcgtcatctgccggtatcatccgacctgtttttcatgttttacgcggtcgcgttattggtgttgcgactgggcttgcgcgacctgttcgacagcaagggcttccgtttctggctgacggtctgctcgttgggcatgctggcgatgctcgcatgcatgacgttcctgttcaatgattggatgctgttgttggctgcgattttcaccgctgtcggctacggtctgatgagttcagtcacgcaggcgcaggccgtggtaatcgcaggccgcgagcgcagtggtattgcgaatagtacgtattatgcgggtattgatttgggtatgtcggttggtccgtttgtgggtggtttggtgtatgggcatttgcctgctgtgtggttttatccggtgtttatgttggcgatgcctgttgcttggttgatttatttgttgtgtgtgaagcgtgtttcgcggtagttgttggcatcgtgtgcgaggtttctgccgtaaaccagtccaagcgcgtgtcgttctaactgtttttgcggtcggtcgtattttccatatacggcaatatgaccgaccgacgcccatcctggctcgtgcaaggcgtccatgccgaaggggagatgtcaggatcggtccttgccgccgtgttccgttccagcctttccggctatttgacttggtggattttgttgcctttgaccatgtaggcacgtcgggccatgtcgatcatgggctggtcgaatcggctgtctgtgtagaattcgtccactcgaacgttgtctccgtagagttcgcggaatcgtttgggcttgttggtgttgaagttgaggtagtttacgttcaacgtgttgtcgtcgatggtggacgagaccaaatgttgcacgccaagcctgcggcaggcctcgcccacggtgatgtcgaacgaggcggtgaggatcgcatcgtcttcgcgtggcttataccagggtttgatgcgcttcatgttctgatcccagaaggcgttgaccaattcttcgaattccaacgattcggcaagttcgcttatatatccgtggcatagcttgcccacaccgtattccatttgatcgaacgtggctcgtccgagcttgtatttgatggcatagcgcagtaccggggcgatgtaccgcaatactttcggattgtatttggccgaaaacaggtacaggtcgaacaggctttctccgtcatagatggttccatcgaagtcgaatacacgcatgtatgcagctctcacttcctcgtatgcgcgcattcaatacgcgccattgcacctcatgctaaagtccgaaggctgattccttcttacaccaaggtgaacggccggcgaccgcaatgtgcacaaattgcacatctcaatgcacattcggttcatgtcacgtttggaaggaggaacacacagtcggaccgctattcgccccataggagccgttcgcgctgctgatactcctcattgaacaacggctgggccttcgtgtcgatgagcttggcgaattccagatcctcatctcgttccacccgatgctcagccatattccattggtcatggtacgtgtaacgcaatgcctcggcatccgttttcagaacatgcgaccggtaaaggtcccgttcgaatagaagcgtatcaaccagccatcctggctcgtccggaaacttactgatgccattgacgtactccgcacgatacgcgtcatggacaaggacaggcaacgcatcgatacgcaaaagctccttgaacatgataagccgtccgattcgaccgttgccgtccgaaaatgggtgaatcttctcaaacgtccaatggacacgggcgatctgatatggctcgtcctcaagtttcgtgcacatatcaaacagcctgtccataaattcgggaacatcctgcggcagcgcggtccttgtcggagtgacaggattgccgataaagttcggccgagtcttgtagccgcccacgttgaaaagcgagtcggagacctgtctggtgccctgcttgagaatggcatgcaggtgacagaccatatcccggtccaccggctcatcagcatggtcgagaatccaacggaacgcagcaaaatgattacgggtttccaacgcatcatcaggattgacctgttcgctgccatccgtggtataggtaccggtggcaaatagctgcgcggtctgtttggcagtaagggtggaaccttccatatgattggaattccatgcgaactggatttgcgtggtcgtgtaaatgccgtcaccatatcgagtatcacgctctcggataagacgctccacgatacgttccgccataaccccatccttccttcattccgctcgactatcctcccatggtaattcatttaggctagaaaccgtggtggatgtcgtatatcctgcaggttggttccatgtcgaacgtgaccgtgtcgaactgttcgggatggtgtacgaacgtatcgatcagtttccattggcgacggctgatgccgatacgatagtccgggcggaccataagcaccggcgctttcggctggagttcctccaagagctgcgcgcgctgttcgaagcattcatcatcgtcgatccatacgatcggcgcgggttcattctcttcgcattcgatgcgtacgcgtcgttggatggtctgccatttgcctgcctcacgtccccatttggtgacaggatcgtaccaggtgatgacatcgaccagcatgggatcccatccgagcatcgggtcgagaatctgactgcagtatggctgccaggtggacagccaccacaattccacaatgccgtcaactgccaacgcgtacatggcgtcggatagttcgctggaccagtggatgcgccatgagcctacgggcgtgtgggctttttcgttgccgttcaggtggaacgctttttcaggattgtacattttcgcgtagggactgtcgggcttcgcccaggtcataactttgttcacgccgcccctgcgcaaaagcttgtcatccggaaaggcgttgagcaccccatcgaaatccgtgaacaccacaggcttggaaaacattttcaaatccgtcatcaccactcccctttcaatcatcaactatcttcttatattgaccttacggtttcctcattacgttttacctgacaaatactgacagcaccgccatcgttttatttgctatactcggattggttcggcacggacgccgaacgaccgcaggcacgagcataggcaaccgcaaacatggtccatagatgcgcaaaacatgatgcgcggacgcatccaaaaaagcggtcaccatcacgcaaaggagcgaaacatggcagacgaatcatcgaagattccagagaaaaccgtcgaacaaatcttcgacgaacgttatcccctcgacaaatgggaggattcaaactactcgatactcgacaaattctcaatgcgcggccgcaaaggcttcgtcaccggagccgcaggcggtctaggacgcaacgcggcggccgcgctcgcccaagccggagcagacgtcgcactagtcgacctgcccagccaagaagacaagctcaccgaactggcgaaagacatgagcgaacgtttcggcaccaacgtcatcgcgctcacctgcgacgtcaccaacgtcgaacaagtagccgaactcaaaacacaattggtggaacagctgggcaccgtcgacttcgcgttcctcaacgccggagtcaacgtaccgggcgacgatcaagacgccaccgaagaagtatggacgcgcaccatcaacatcaacctcaacggcacctaccgtaccggccgcatcgcgcatgaaatcatgcgcgaacacggtcatggcggctcactgatcttcacagcctccctgtccggacacaacgcgaactacatgatgggaagtccgacgccggtgaacgcgtatggcgccaccaaagcggccatcatggaacactcacgttaccttgctgccgcgctcgccaaggatggtatccgttccaacaccatctcccccggatacgtgtggtctggaattttcaatggccgtatcgacatgcctggccacgacgccatgctcgaggtcgtgccgatgcatcgtttcggcacgaatgacgagattgccagcacggtgctcttcctcgccagcgacgcgtcctcgtacgttactggcattgacattcgcgtagacggcggctacagcgtcttctaatcaccgtaccccatctgataaatggccggtcgcagctaatgtgcttcgaccggccatttatctggtgatggtttctagaacataccgctacacatgcttgcggcgtatcaacgtaccggcagtggttccggctcctgcaaggagaagcatgaccgcgataatgggaacgatgtcggagcccgtgcgaggcaagtccgcagtcggttttccatcggccttgctggcattcttgtctttcgagggctgcttgtcattcggcttggcctcgccaccgcccggctggtcatcaggcttcgtttcccgaagcttcagaccgtccaatgccgtgttaaggagcgtggcggcattggagacaagaccgttctgttcgctgctgaacgtggtgttgttccacagcgagaggacctgctcgtacgcttccgtgagagatgcgaccgtatcgtccgtgtatttgccgaattcggcaagcttggcctgtgccgccgcgatcggagcttcgagcgcgctcttgtcgagttcggtcggatcatcatacatggcctgatatcctgggatggtcagtttggcgagctgatcgtacatcttggagcagaggcgagcgttgaagttcatgacactgaaccctgcgcgggacaagttcatctgtcggatttccagattgtctggatcgtaggcgccttcggcgaacgtcatgtcggccgattcgctgtcggacgcgcccttgcctgttccgctggtgtcgagcgcgctgcccgtggagtagtcgaacggggtgccatccttgccgctccatgcgttgatgatgaggctcgacgtgcggaacgggtcagatccaactcctgcgtagttgtagaccgcaatgtccttgccggaggaaacggtgtcgccgttctcatcgacgaagtagatcgggttgccgtcgacgtcgagcggatacccgtcgggaccccacacgttgtcggtgatcactgcgagaccgtcacggtcggtatagctgcccatgcgggattcgcgatgccatgcgttgccggtcgtggccgtcggatgcagaaacagttcggctccggacgcggcataataacgaccgagttccggatagaagtggccgtctcaacaaatgtcgataccggccttgagcggcttgccgtccgagccggtccactcgggcatctcgaacatgaccggcgtgctgccaggcaacgaccatgcggtttcctcggatccggcgcgatgcatcttctggtaggagtcggtgtgcccgtcagggaacgctatggcggcagaattgtagaccttccgcacgccgtcgctgtcggtgatgagactctcggtgatttcagcttgggaggccgccatcttgtatgctgcggagtctaggtcgcttgaggaaacgtagccggtgagtgccgcgacgaaggccatggtggcgcacaatgcgacgctgcccaccgccgcaaccgccatgttgagctgtcgtttgaaccatatggatttcgcggtgacgttcgctgccgcgtctttgttctccgttgtcgtacggtgcgacgtggatgtccctctcttcaacgcgccatgcttccccgaaatttccccgttctggaaaacatcataggagataaacggaattgtatgacagttcgttttccacttggcttctgaattccgaagagtagctaaagagtactcatgcccgattctgcgagcgcgatcatttgacgtttcctttgttgttgaacaccgttttgctcatatctcgcttatgtatggcagatttgcgaacgtgtccggagatatcttgcttatatatggcaggtcagtccgtcaaagcagtaggtaggggggcatgaaaaacctcattttcgcgaaaccgactgccatatataagcgagatgcctcatgtcacatcccgaaatctgccatacataggcgagatacagcctgctttgctcagcacaaggccgacagatccagaaaatgcgcacgatgacacgtttcaaaccatacttcgcgcaggatctttttccgatttgttcccttgacaggtctgacgcctactgtttggagttcgcggcggcgcgcaacgagtcaacgaactgtgcacacgcaaaggcgggtatgatgacgtttattctcgcttggtatcggcacttgaaatccgaagaacagtaaggagataatcatgtccgacatcaatccgtcagtagcctcggcagcacagaaccctcctgcattcgcacgactcgaagcgggactaacggccccggactttacacttcccagcgacaacggcggtagtgtcacgctctccgcattgcgcggccaaaatatcatcctatacttctaccctgccgcgatgactcccggctgcaccaccgaggcctgcgacttccgcgacaacctcgcacgcctaagctcccgcggattcacagtgctcggcgtttcgaaggatccgctggacaagctcatccgattccgcgagcgcgaccatttgacgttccctctgttgtcggatgctgatttgaccgtgcatcgtttgtatggtgcgtacggtgagaagaaattgtatggcaaggtttacgagggtgtgattcgttcgacttttgtgattgacggtgatggagtgattcgtgttgcccgatacaacgtgcgcgaaaggtcatgttgattctctgctgcgtgcgcttgataagcttgatggttccattttctaatctggaatgcgatgccgctttgtttatagatcagctttttcatgcgaatgacgcaagcagtgtcagtagcgggtagatgtcgaattcctgatagtggtcgtgcagtgtgccgatatcttcgaacatgggctcttcggcgagcctttcgaaggtctcgtaacggcacggggcacggcctcgtaagagaagagaaaaagcgcgatgagactcagacttccgacaataaatcatcgtcttccgacatgtcagcccacggcttgcgtgtgcggtttgcttgatcgtgttggcgatgcgttggctgaggagcgtgaacgtttggagttgaaggcgattgaaatgctgaagggaccgaagtgtcttgtgcagccggagccggtggatcatgcttggtgggatgatggttccggcgtgtacagcatcggctgagggagccggtaggctgggtatgtaaatccagcagagaggaacgtgccatggtgacgcgtcgtaatgatgagcggacggttgcgggaaggcatcgcatgatgaggcgtgccgaccgtgaggtaaccgaaccacagcagatcgatgcgattatcgcaacgtgcaagatcgtgagtcttgcatacaccgatgcggaaggcatcaccatcgtgccgttgaatttcggatacgtgttcgatgcggaatccaatcatctcaccttgtatttccatggttctgcgaccggacgtaagatggacgcggtcaaggccgcaaacaacgcgcttcccgtggcgttcgaaatggcgaccgactgcgaggtggtcgaaggacgtacgttgtgcaattggggcgaggcgttcaagtcgatcgtcggcaatggcaccgcatccatcatcgacgatcttgacgaggcacgccaggggctcgcactgctgatgaagcagcaggccggcatggaacatgcggaattcaccgaccagcaggtacgcgccgtcaccgtatggaaggtggaagcggactatctcaccgccaaagtacgcgaaaagccccagctgcatacgcactgacctcataccgcaccttgacgcaatgatgcgctgcttccaagcccgaggatgggaattgggaacagcgcatcagatgtaaaacgctagaccgaagtccggctgcggccaagttgcaagtcaggccgtaacccggtcgagataaggtttcaaatcaagccttccggcgggaacgccgcgcgtagcttcctccaaaaatcgcggaggacaccatcacgacggtcgccacgatggcgggcgtcacgtttgaaccggttttggcgagcttgaccgcatcgccgccgttcgcggacgatttcaccggatgcttccgctggccgttcgcatcattcgcacccggagccttctgcgaatcatctggtgtcgattcatggcccggcgtttcaggctgaccttcctcatccgtcagtcgggcatcaaccgtggttcccttaccattcaggcagcttttcagctcgctttccttataccaggtcgaaccatccgcaattggcgtgcaggaatcgttgaatccgatttccttctcgttgtacagcattctgaccaacggctgatacggctgccccgagacgtccgtaccatcacgcacgaccacatcccactgcacattcgcagccatcggcgtcacactttcgccacgccacggattattctcatacgtgtacagttcactcgcctgctgctgcgatccaggcagcttcagcaatgccgcaaacggaataatggtttcggcatgtgcgaatcggaacgtcgcggcggtgccggcccgctccctcgtgtcgatcgcattgaagaaatcgtcgagcaacggctgggcaatgcggtaggtctcatcctgacctgcgcgccccggtcccttctcatagaagtcctcggcatcaagcgaccaagcaaacgtcttagcctcctgggcgtgctgaccttggaagtactggtcgaaattgaacgtgtgggatccggtgttctcctgttccatatcggccgcgatgatgtacagattgtacaaatccattgccgcatcctgttccgacgcgatcttcttcttggcgtcaccgcacgcgttcgcatccttggcagggtcggcgccagcagcgcaattggccgcaccctttttcgtgccgtcagccgtgttgtaccagatgcgctggccttcctccttgccgatggacgcgaggaaatcgtcagtgaagatttgagagagcagattatgcgaagcggtggtcatggacggatcgttcgtcacgttttcctcagcttcggcgatgcccccatcattcgcgacgaactgctggtaacgttccgcgcgctccttggcctcgcccgttttctgcgtaccatccggattatcagtcttatggaaatacaacgtggtggtgttcttgtcgaaattcttgccggaattgttatccgcaggattattcggtgctacaaccgcattcgccagcaaaccgttggaagcctgatcgaatcctagtttgaaattctctccggattcggttgcacgaggctcacccgagctctggtatgagacgcgcagtccctgctttgcggcattggcgaacagatcagcatcacgctggtatattctctcaccaatgccctgatgctgtatggcgccctgaccagagagcatgccatacccgttgcccacgttggccgcagtaatggcattgacattgttgatgaattccttgccaacctctgggctaacgaatccagcataattgttttccgcagcagactgagccatcagtgccagcaaagcgtcatacttgtagctcgacaggccacgcgagccatgccttgccacagactcggtgtatgcaagatggtatctgctcggaattgctgaatatgatgtgctcgccggcgcaacatacggctgcttgctgctgtaataccgggcggttccttccccagccaaagccgctggcgttgcgagcatggccgctgccactacagcgcttgtcaacgcgagcatgccaccgcccaccgatttggtaccgcgtttgcgccaggctcctgcctgccgctgttcctttgttgccgtatggtttttcgccattatcctcattcttctacctcttctgctttgccacattgaagctgtcagacaagccagcctgggcgacaaaataggctcggaaggcgaacacgcaacgccttaaacgtgaacgatcgacaaataatccgcgaaccgtcgcttagaactcaagtaagttgcacagccgcaactcccccaccccatggattcacgatgctcgacgtatcacagaacctgctggacaagttccaccgatttcgctgcggacacccccaatcaacgcacatcattatggctggccgattgtcgacttgacacgtggaaacgtccccgcctttcacgtcaggaccgaaaacccaaagtatgcaagaatccggacgttacaggatgcggacgttttcttggagactgaatgaaaggattatcgtatgttcggtcccgaggaacgacggcgcggaggggtccttcggacgcatgaagatggagtccgtccatcccgggcattgggaggaacgtacccgcgacgaggtgctcgtcccggtcgacgactgcatccgttggcacgaccacgagcgcatcaaacggtcgctcggttggatgagtccggtacaataccgtcagagccagggaatggctgcgtgatcatctccaagaaaacgtccgcagcccctctgccatttgcgatcagtcatggcacgctgattccaatgggtttcagcagtacgctggatgacgcattatcgcaaagcgtcgaacacgccatcaatatgattgccgccatgttcgagatgccacgtcaacaagtgtacctgctgctgtcggctgccatcaacttcaacgtgacgcaagtcgttgatatcacaccaaaggcgttcacggtctgattgatctgtcgatgtttcaacaactacccgactatgaacggacgatacgcgatattggaaacagcagatggactgccatgcggcgcatgccttattggcccagcaggctcagacaagtcactgattggtctagccaaagaactctataagggaatggaataacagatggtttccccaacaaacaatcatgcagcaagatagcaacaccacccaggcgacggatcgcgccgaaacggacgctctctccttcggcgcgaagaaaatcgcaatcatgattggcgtgggactcatcgccggttccctacactgcctatgttgatgaccatgccgttggcgtagctgatctacctgtgtttccgccgtatcatccatccgactcgcgcataaccgtccatacgggaatcctcgaacgcaagtaaatgtcgcttccgtcaatcgtcgaccgcaagaggcgttcatggagcggcggatttccttatattccaacaaaacccgtactgttatgcgacacgtaataacagtacgggttttctgtgttactgttatatataacagctaaacagtttgcatctaactgttcagccgggagatatatcacctacgaaacatacagaaacagaggcacagattgaagctgatcatctcatccgtgtccggagaaccgatttacgaacagatcaagaaccagatcaggtccgcgatcatgtcgggtgagcttacagcaggcgaggcgcttccctcactacgcaagctcgccaaggaactgcgcgtcagcgtgctcaccgtgaccagagcgtataacgaactggccgacgaggggctcgtggagaatgtgcagggcaaaggcacattcgtgatggaacgaggcaacgaactcatgaaggaacgtgcgcgtgaacgcatcatggacaagctccgtgaagtttccatcgaggccaaagccgccgacattagcctacttgatctgcttggcatgttcgagaaagcgtacagggaacaatcatgaacgattcctcactcccccaaggaacgcggccaaccttggccttgagcgtaaccggattgacgaagcattatgattccggcttcacattggatgacgtgaccttcgacctgccgtccggctacatcatgggtctggtcggtccgaacggagccggcaaatccacgttgatcaaactgatcctcaatatgaccgcgcgagacgcgggacgaatcgaagtgctcggccttgacgcgatggccgatgaggagcgggccaaagagcagctgggcgtagtgctcgacagcagctatttcatcgaatacatgacggtcgacgcggtggaacggacaagcagcccaatgtacccgctgtgggaccacaatctgttcgacgcatatctcagacggttcggactcggacggaacaagaagatcaaggatctgtcgcgcggcatgcagatgaagctcatgctcgccgtggcgttgagccacgatgcgaaactgctgattctcgacgagccgaccagcggtctggacgtactgtcccgcgacgagctcatggacatcctgtccgattatgttgcggatggcggacacagcgtaatcttctccacgcatatcaccgccgatttggagcgttgcgcggatttcctcgcgtatataacgaacggcatgctgtattacagcgggccgaaagacgagttcgaagacgcgttccgcctggtcaagggcggtccggatgagcttacggatggtctacagcgggcaatggtcggcatccgcacatacgcaaccggcttcgacgcgttggtccgcacgcaggacatcccacacatcggcggcaccgacggtctcctgacacagcatgcttcgattgaggatgtgatcagactgaccaacgccgcggcacatacggcaatcggcaataccaacaaaggagacgtacgatgaacacgacagcgaacgcggacgccatgaccgccatccttaggcagatttccttggactggaaccgcaccatcagctacgggcggtcgtacatagccatcttcttcgcgtacgttccaggcttcacatgcctgatggcggccacagggtccactctcgacagcgttgcgggagccgccatcggcggggcggcctccggcttcctgatgcttaatatcaccctgttctcctatgaacaaatgaacaaccatcattggatgaacggcatcgtgcccatcaaccgcaaccaccagatcctcggacgattcgcattccttatcgcctgcgatctggtggcgggattggaagtggccgccagcatcgcctgcgccggcaccatcatgcacgagccagttaaagtgacggatgcgatcgacttcgccgcgatgaccgtgctgaccctcgtgctgctcaacgccatcgtgcagccgttcctgtaccggttctccccttatcgcgccatggccgccattattctgagcatcggcgtgatcgtgggcacggtcatcggactgcgcaaggcattgccggaattcgaaaagaccgtcgaacagctggccgaagcgatcagccggcaccaagccattgcattagcgacattcttgatcatcgacgtactcgccttggtgttctccagcaagatatcgctgcatatttacggtagcaaggacatctgaaccgagccagccggtagactcttatggaacgtatttggggtcttccgaatcaacggaaagccccaaatgcatatatccccgcacgacgccggttcctacaatacggcaggcgcgtcatggaagtcgaacatgacaccatccgccagaccgcaaatagccggccaatcggcatcggacgaatcgtcgtgcatggcccataccttcatgccaaccgacttggcggaacgcatgccgatcagcaaatcctcgaacacggtgcactcccccggctcgactccgaggcgagatgcagccaacagatacacgtccggctggtctttgccgacgtcgccggcatcatcgacactgaccacttcatcgaagtagtcgaaaatgccaacatgcttcatcgccggctctctcagcatcggcggcagcgatgtggcaacggcaagtttcgctccactctctttcaattgagcgagatattcacgtgcatacggtttagcttcgaccactgtggcatacatgacgcgggccatatgatcccactcatccatcagctcttcgggagtgtcggtaaggctgaaacgcgcaatcgtatattcggcgatctggcggaattgcatggccgcgactttcgtcatgtaatcgtccggcacgtcaatgcctcgttttgaaagaaaatcgatgtcaacctgatcccaaacgcccatggaatcaagcagcgtgccgtcaagatcgaaaatggcgcccttgccttgattgcctgccatcgatatcctcctttattattgtgcatcttacgttaatcgagaaccgatgatttgagcagttcttcggcatgttccagcgacgcttcgctttcactgccggagagcatacgggcgatttcgtgcacacgcgcctccccacgcacttgattgatggtggtggcgattgatccgtcatccatttcacctttggcgaccacgtactgttcgtccgcccaggatgcgacctgtggcagatgggtgacgacaatgacctgcgcggattgagcgagtttcgccaatcgcgcgccaagctccaccgcggttttgccaccgacgcctgcgtcgacctcgtcgaaaatgaacgtcatgggaggtacggaaccgcccgccaccacatgtttttccgccgcaacgagttcaagcgcgagcatgagccggctcagctcgccgccggacgcgcttttgcccatcggcatttgcggcgaacccgggaacggcgtgaacagaaaatcgatgccgtcagcgccggaagcgtccaaatgttcacgttccgatacacggatctctagtttcgatccgctcatggcaagagattcgagttccgcagtgactttggcggcaagttccttcgcggcggcggcacgtcttttgcttaccgcacgcgccgccttcaacgcctcaccgaacagtttttcacgttccgcctgcaattgactaactttttccggagacgcgtccagatcctccaagtcgaacaccgcttgatctcgccacgcgatcacgtccgacaattccgggccccaacgacgaaccaattcgtcaagctcatggatccgcccgttgatggcgtccaagtcttccatgccgagatcattgtcgacttcgcccgacaaggtgaacaccacatcagacaaatcagtgctgatggaatcaagccgatcggccagttccgaaaacacgccgtccacatgaatggcgcgaagcgcttgcgacgcgcgatcaatcagatcggtggcgctggatgattcaacatcgtcaacaacctgcgaagcatccaacgcgctcaacgcacggttcaccccttcggcgatctcggccgcgttctcaatgcgatcacgccgggcacgcaactcggccatctcccccggctgcggatcgatgcggttgattcgttcgatggactcgcgcaggtaatccgcctgctggcgcatggacgactcctggctcgacaatcgctccaaccgctcatccatggcacgaagcgcattccaagccttgccgtatgcgaccaacgccacatcatcgccggcatagcggtccaaaaactcacgttgccgcgccgaagacgcgatacgcaactggtccgcctgaccatgaatcgtcaccaactccgctgcgatcgaccccagtacggaacgaggcacactacgaccagacagcatgctgcgggaacgaccggaggcaggaaccttgcgagacaggaacagttctccgtcttcaggttcgaaacccgcctcgtgcgcggctgcgaccgcggccggtgacgaagcgacctcgaacacgccctgcgcccacgcctcgctcgctccgaccgacacgcgcccaccgtcggaaggaccgccggaaatcagccgaatcgcactgagcagcatcgacttgcctgcacccgtctcaccggtgatcgccgtcataccgccggcaggcgcgatcagcgcggaacggatcggcccaagattatgaatctcaagttcttcaagcatcagtgtttttactcgttcgtttctttatcttccggaaacacatgcccatgatgcactcccccggttttacgcgcctgctcgcgccaaccgacaacaggaagatcgaatttcgtgaccagacgattcgtgaacggcacgccggaaagacgggccaggcgcaatgtgctcttcgattcgcgcacctcaaccctagtgccccgcggcaacgcgcattggcgacggccatcgcagcagatccaaccatccgacgtggaatcctcaaggatatcaatggcgaatgtggaaccggagccaataatcaatgggcgagcgaacagggcgtgggcggccaacggcaccaactgcaacgccttcacgttcggccacatgatcggtcctccggcggagaacgcgtatgcggttgagccggtcggagtcgacacgatcacgccatcgcagccgaaggagctcatttccacatcatccacacgaatcgacagttcgaccattttgccacggtctgcacgctccaacgtgatgtcattcaacgcccaatcctcaatcggctcgcttgctcccggcagccacacatcgacatgcgcaatcatgcgttcgtcaatggaataatcatgctcggcaaccctgcggatcgcctcactcatctggaagctttcaaactccgccaaaaagccgacatgtcccaagttcacgccaagaatcggcacactggtgcagtgcaccagttcagccgctcgaagaatggtgccatccccgccgagcaccaccacgatctcagtgcgttcggaaaccaccggcggctgcttgccgaaatccggcgcctcgatattgtcaatgatcgacacttcgaaaccggcctgggtcagctgcccgacagcctcctcaaccaccgtgccactctccctcagacgactatgcgtcaccaccaccgcatgacgggtaccgaacatcgttaatccctttccagcaaaaggaaacgccctatggaaaacgcccatgaagacgtcaccgacctccagtgtaatcgaacaaatgaacgaaaaccggcaatgcgcgtcgaaaacatgccaaaacccgcgaacacgcctcaaatccgtctccgatgcaagccacgaatcaggaatgtcagccgtcaaatagcctgttagtcgcacatatgcttacaatagctcacaggaacgaagaccgaacatcgtaagaaaaggagagaggaacggcatgtcaaacctcgtctttgacgagtcctcctccaatcgtgaggcctcacatggctacgcatggtggttctcgggagatactttcgagaaggccatggcggaagaccgcaagccacgcaagcgcggcctcacgcgccgactcgtcaaccatccaggccgtctgaccatcttctactttctgacgctcgcggcgttgtccactacgttgctgatgacgcccattgccacgccgaaagacgaaaccaccacgttcaccaccgcgttcttcaccgcagtatccgccatttccacatgcggaatctccatcgtcaactccaccacgcattggaccaccttcggccaaggcgtgctcatcttcgccgtgcagatgggtggccttggcgtcatgacgttcgcctccttgatcgcattggccgtgaaccaccatctcaaggccacgcagcgcatgctgaccgccaacgaactcggcactacgaagctcggtgaaatcaaaggcgtgctcaccgtagtcatcaccaccgcattcgtcatcgaaggcatcacattcgtcgcattgttccccggcctctacaaggtcaaccacggtaatgtgcgccacacattgtgggaatcgttgttcttcgcggtcatggcgtacaacaacgccggcttcacccccgacggcgccggtctgcatgtcaacaactgggcggtcggcctgccgatcctagccagtgctttctgcggaacccttggcttcccggtattgctgaacctgatgcgttcctggcgtatgcgtcgtcctccgaagcgttggagcctgcacaccaagctcacactgaccaccacgttctgcattgtgatcgcctcgttcacgtggttcctgctgatggaatggaacaacaagctgctgttcgccggaaacggcatcgagccgcgcctctggcacgccatggtcgcggccgtcatgccacgaagctccggatttgacctgtcgtggatgccaggcgtcagcgacgcaaccaaagtgttcctgtccatcgtcatgttcatcggcggtggcagcacctcgaccgcaggcggcatccgcgtcaccacgttcgcggtgaccctgctgacctgtcgtgccgcattcaccggacgccacgacatcaacgcattccaccgccgcatccacacgcaggcggttatgaccgccgtggccgtaagcacggcatgtctcatgctggtcaccgtggtgtcgatggcgctgatgatcatcaccggctgctcgctgtgcgacgcactgttcgatacctgctccgcgttcggactgggtggctactcggtgggcgtagccagtgaaagcagccccacggtgctatacattctcgccgcaaccatgttcatcgggcggctcggaccgctcaccatcgcctacgcgatttcgcgtccacacaatctcgaggccgtccgctaccccaccgagcagatcgtggtcggctgacgatacggcttcatatacttgcagttgcctgcaatcacacatgaatatagatttttgaagatggaatttcgaaaggtgcataacatcatggccaacaacaccagaagcgttctcgtagttggtttggggcgttttggcagctctgtggccaccacgctcgacatgatgggccaggatgtgctcgccgtcgacaaagacggcgaactggtgaaccgttggtcttcgcagattcccaccgtgcaggccgacatgaccgatgtgatggcgttggagcagatcaacgcatccgatttcgacacggccgtcgtggctatcggcgacagcgtcgaagcttccgtcattaccgccggtaatctgctcgacgccggcatctccgacatttgggccaagtccgtgtcgaaggaacacgcccgcattctgcaacgcatcggcgcacgccacatcatcaacgcggaaaccgacgccggcaaacgcgtcggacatcttgtgtccggcaactatcttgactacatcgagcttgaaggcgcatacaacgtcgtcaaaatccatacccccgcgcatgtggtcggctacaccatcgaagacgctcgcgtgcatgaacgcttcggcattaccgtggtcggcatcaaatcgccgggcaaggaattcgaatacggttcgaaagagctcatcatgcaccgcaacgacgaactcatcatcatgggcaagcagaatcaaatcgaccggttcctacgcagctgacacgctctttccatatggaaaaatccggaatttcataatcatgatttccggttttttttacttatcttatttgccttgattacactgcagacacggttctctcaaccggtcgctgtttcactgcatgaccgcgtacagcagatattcgatattgccatgcgtgccttcaatgggagatactgttgtggcgcgcacgtcaagcccgttgcgttccgcgcatgccacgacggaggacagcgcctgttcgcgtaattcctggctttcgacaatcccgtttttcccaaggttgcctttgccgacctcgaactgcggtttgaccagcagcacgatctgcgcctgcggtgcggcgattcttgcgatcaccggaatcacatatgtcagcgaaataaacgatacgtcggaaacaatcatttccggacgatacggcaaatcctccgcatacacgtcgcgaatattgacgccgctcatttcgataatacggtcgtcatgcgcgattttcggatccaattgcccatggccgacatccaaagcgatgacctgcgcggcatcattgcgcaatagcacgtcgcagaaaccgccggtggacgcgccgatatccaagcaacgtaatccttgcgcggaacgcaatccgacgtcggcgaaccgttcgaacgcgccgacaagcttgtatgcgccacgggaaacgtagccgtctcccctatcggcggcgatgacgtcatcaccaccgactttcgccgatgctttggtgacggtgacaccgttcacactgactttgccatccgcgatcagacgttgcgccttggaacgactgtcggtcagaccacgttccaacaacgcaacgtcaagacgaacaacctgagtggaatcactgtttcgcaatggttttccaataatcggtacgaattgttcgttaggaaatacggaattccggaacgatcacgccactcacatctcgcccgctgtcggccgcggcccacatggcgcagcatgcggcacgcaacccgtcgacgctggtgatgtcggtgacatacaggcggtcgccgtcaacgcgggccttcgcatcgcggcacagccatgcgccctcatcatgcaccacttcaggagcgggctcgttcaagccccgcagatctttggcgatgtaggtcgggcgaagatacgccggagcgaacatgagttcgcgcggatcggtgacgccggtcaacaccgcaagggaatcgtacccgccccgattgcccgcctcgatatcggtgtcgagacggtcgccgatggcgaggcactgttccttgtccaccggctcgccatcatcatgggctgcgagaatgcgcgcctcgtcatacatggcggattccggcttgcctgcggacgaaaccggttccacaccggtggcattgatcaccgccatgatcatggaaccgcatcccggcgcgatgccaagctcacgaggaatggtcagatcacgattggtcacgaaataggtcgcgccatgctcaacggcataggcgatttgggccatttcgttccaagacatgtcgggataccatccttggatggcggcgaccggctgcgcttctgcggaatcgacgacttcaagaccttgcttggccacttcctcacgcagatgctgggcgccaagcacgaaaaccttcgaaccttcaggcacggcacgtgccaccatgcgcgcggcgacaaccgacgaggtgatgacctgccaggattcgacatccaaatcgaaccccttcagctggtctgccaccacggcctgaagtcgggacgaattgttggtggtgtattccaccgccatgcccaaggattcggccttgcggatattcttggcagcatgttccaccgggttcttaccacggtagaccacgccgtcaagatcaagcagtgccagcgagtatgcttcgctgagcggctgattcgtggacttcagcatgcgggccacgtcacctcacttgttatcttcggaggattcggaagaagcatccgaagactcttcggcctcttcagcctcaccgtcatcatcggcgtcatcttccgcagcatcgtcagcttctgccggctcgtcatcggattccgcgcctgcttccgtctcttcggcctcaagctgggtttcgtcgttggtttcgccgttctcgtcgatggcttcggattcgtcttcctcattctcagggtcttccggagcgtactgcgcgtcatcttcggaaatgccaagcacgtccatgagttcgtcgttcagctcctgcatgtcgtattcgacaaccagatcgtcggaagtctcatcatcctcaacatcggcgtactgcagttcgagcttgtcgagcagacgatccaatgcgatggcctcatcggtacggccggcctcttcaaggaaatactgttcggcctgcaccgcacgcatgcggtattcgccggccaatcccttggaacggcccagcgtgtgcacgatctcgatggccttgtcccacatcttcagatcgcccagagcgccagcgtacaccaagaacatttcagccttggcttcaccgcgcagatacttggcgtcgtcgctcacagccacttcgatggccttcttcggctcgcccacgccacgctcgcagtcggcgatgaacggcagataatccaggaaaccgttcatacggaacgcggtgcggaactcacgcaaggcaagcttgtaatcaccctgacggtatgccacgaaggcgagtgtctcgcgggcgaaatcgatgcgggaagcctggcgggccacccacttggcatgttcgagggccagctccgggttgctctcctcaagcgtgtacgcggcaagaatgtgcagaccaatgttttccgcatgttccttcgacaggccacgcaggcgttcgcgatcgtcggtggtgagcatacgccattcgatgcccttcggcatcttcggctcatcaggacgacgatgcgtgtacgggttctgcgaggggaagctcaccgtgccatcggaattgcggcgcggcttggccatgtactcgccacgcttctcctcacggtaggccatcttctcttcgcgggtgaactcacgacgctcctcgccctgctgctggtcgcgatccttgtggaagtcacggcgctgatcgtcacgacggaaatccttacgatcgccatcacggaaattacggcgtccgccatcacgacgatcattgccacggtggtcgtcacgacggaagttacgacgatcaccatcacgatggaaatcacggcgatcattatcgcggtggaagttacgacggtcgccatcttcacgacggaagttacgacggtcgccgtcacggtggaagtctttacggtttccgtcacgtcgatcgtcacgacggaaaccggaacgctcgccatcgcgctgatagcgaggattgtctccacgaccgccacgataatcgcgatgatcgtcacgacgctcgccgtcacggttgaacttgcgcggaccgttatggaagcgacgctcctggccttccccctcaccgtcacgacggaaatcgcggtcgcggtggaaattgccgccattgcccttgcggtatccgcccttatgatcgtcgttgtggaagccgccggacttgtggccgtaggacttgccgccattgccacgcggcttgaatcccttgccgccgcgatcgcccggcttgcccgagccgtaggacttgtggttgccgtaggacttgccgcgcgatccgcgctgttcttctgccatgctgttccttatattccttgtattccttgaaaatggtcttcgtttgttctttgcttacgtttgtttacgccgctcgcgattgcctcacacgttttcgacgacgccgagggccttcttgccgcgacgaatcaatgcgaaacgtccatgcaggaagtcattttcgttcaaaacctgctcttcgtctttaacacgggcgttgttcagatacacgccgccagccttaatcgtcttgcgcgcttcggaaatcgacttgaacagtccggccttcatgccggcttccgccacacggtcgcccaccgcggccttggcgaactcgccgtcgatcttcacgccgtcaagagcagcttcgagcgtggactcgtcaacgcccgcaagatcgccgccacggccgaacagcgcaccggcggcctcgatggcctgtcgggtggcttcctcaccatgaaccaggctggtgacctcccaagccaaggtgcgttgcgcctcacgcgcgcccggattggtcttgctttcctccacaagacgttcgatctccgccttcggcaagaacgtgaacaccttcagcaggttctccatctcgctgtcagggcggttgaaccagaactggtagaacttgtacgggctcagcatagtgccgtcaagccagacggcgttgccttcggacttgccgaacttcttaccctgagcgtcggtgataatcgggctggtgaacacgttcacatccacgccacgtaccttgtggatcaggtcaagaccggacgtgaggttgccccactggtcggatccgccaagctcaagcacgcaatggtattcgtcgaacaggtgcaggaagtcgttgccctgcagcacctggtagctgaactcggtgaatgaaatgccatcttcagaattcagccgacgggcaacggtgtctttggcgagcatggtacccaaacggaagttcttgccgacgtcacgcaggaagtcgatgacgttcatggaggcgatccaatcgtaattggacacgaaacggaccggattgctgccttccacttcgagaatgccgccgatctgcgccttcagacgctcggcccaaccagccacgacgtctttcggattgagcgtacgttcgcccgattggcgaggatcgccgatcaagccggtggcgccgccgaccagggcaatcggatgatggcctgctgcctgaaggtgacgcatgttgatgagctgcaccagattgccgatatgcagagaggcagcggtcggatcgaaaccgcaataataggaaatgggatctccgttcaacgcttcggcgagtcgatccctgtcagtggactgggaaatcaacccgcgccattccagttcatcgaggacggactcgaaaccggcctccttgaaatcgatgacgtgagccatagctgtgttttctccctattgaattgcggatgatactgcgttttacgcaccctacagtttcgcagaagatgaagacaggcgcacgcggtgtttccccatcatccaccaaccatcgtgcatacaggtaaagttagaaggagcatccccatatcaagaagggagatacctgcatggaccgcaaaggcatgaaggttgcggctaagaaagcccagagaaaacattattggatgatagtcgccatttgcctgttcgcttcggtgttcggtgttgcgtacacttcatcgacgctctcggtcagcaccaacatttcgatcagcaccccgcaaacggaggattccacgcaatccaacgacatgtatgacgtattgcaggatcttgccgtaggcaatgaaaacgatgcccgtgaaaaggtcaagcaaaaccaagagcagatcgtcaacaacgataccgatgccacgttcggccgtcgccgcggagtaatcgcgtccctgctcaactcgtttgcatccggctcgatggtgatcgccgtggccgacgccattaattccgtcacccataacggcggcgtctccatcgccgtgccggtaatactctcgctggccgtctacattttcgtctggctgttcattcaagaaacataccgcatcgtcatggcacgtatgctgttggaaggacgttcctataacaagcttccggcaagtcgcttcttctaccccattcacacgcgcaaatggccgcgcatggcatggaccatgtttgtggaaaacgtgttcctgttcctttggagtctcaccatcgtcggcttcttcatcaagcaatattcctaccgtatggtgccgtacatcgttgcggagaatccgaatatcgaggctttggacgccattcgcttgtcccgacgcatgatgaaagggcataaatgggaatgcttcgtggcggactgctcgttcctcggctggtacctgctcaaccttatcaccttcggcttgagcggcatcttctattccaatggctacaatgccgcgttcttcgcggaatactatgtgtacgtgcgttcgatggccaagactaccggcattgcaggcagtgagatgctcaacgacgaatacctgtacttcaaggccgacccgcagacgctccataccacgtacgccgatgtcgcccaatccgtagcacagctggaacagaatcttgttccagcgcccaagccgcatggattcacaggatttctttctgagtggcttggcatccgcattctgcatgccagcgcagtgaaccgctatgaagagtatcgtgaggatcttcaccagatgcagatcggcgagaatattctgaatggctccatttatccggggcgtcttgcgcctgctccgatgccgttcaaattccgtgaatcacgtaccatcagcgccgaccgcagctactcactggtcaatctgatcatgatgttcttcatcttttgcttcgtcggctgggtgtgggaggtaggtctcgcatttatttccgaagacatgttcgtgaaccgtggcacgctgcatggcccttggctgcccatctatggcaccggcggagtgatcattctggttctgctcaaaaagctgcgcgaaaagccagcgcttgaattcgtcgcggctatggtgctgtgcggctgcttggaatacttctcatcgtggtatctggagatgacgcatgatggtcaacgctggtgggattacaccggatactttctaaatatcaacggccgtatctgcgccgaaggattattgacgttcggccttggcggattgaccatcgtatatctgctggctccggccctcgacaacctgctcagcagaatcgatgcgcgaaagcttggcatcgtggccgccgtgctgctcgtgctgtattgcgccgaccaagtgtattccgcgcaacatccgaatgtcggtgcgggcatcaccgactacaagggatcggacacgtcgctggaagcgcccactccatacgaaatccgtaaacgatccgatggactgtcatagcgtgattgtcatgcaaatcgcatatcgcaaacaataataaaatcgcctgtcgttctttcgagcggcaggcgatttcatgccgttgcttattgcgcgattatttgcgacgcagcatttcgtgcagagtttcgatgatcttgctgtatttgatggaatccgtgaaacgcaaacgcgggaatgcgttaatcatacgacgctgctgcttgttcaggatagatgcggcagtggcctgcatattggcaagaatctcctgcgaggagtccgaccaatcctggaccttgtcttgcaccttgtcgcggaatttgtctcggaaaatgtctttgccccattgcagggaatcaccggctttctccgcatatgcctgcacggtttcgctgaacttcgcaagattgtcggccaaatcgatgatgccaagcactgtaataatggtatccgcgacgataaacgccatgaaaatcacgcacatccagtgcactactggcaaaggaatcatctgtgtaatgcgattcacttcaggctgtatcacatcggtgatgagcacacccagcagaccgaacacaatcgctccaagcaagcaaatgcgcccttgaatgttgaatcggcgatgactgtaatcccaccatcgtgcgtggaatagcttttccatgccccatgacgtgacatattcaagcatgcatgcaccgattgaagaaatgagaaaaaccgcgaagggattatgcagatcatgcagcagcacaatcgcaagaacggctccgcaaccgtagatcgggcagatgggaccattcaggaagccacgattcaccaagcgacgttccgaaacggacacgagaatcgattcatatacccatccggcaaatgaatagaacaggaaccataagaacaggtattccagcatgagcatgctttcgcgccgtcactttccacttgtatgcatattgactttcggcttgtagaagcgctcaagactgaccgtttcccgtgtggcgctgatcttatccgcgacagtcaccaaatacccttcaagataccgaggcggtatcggcgtcaaaggaaacatatgattctcgatgctgtcacgttccactctattgagatggaaatcgcgcacggcattgcgcatggcggtgccaccatgggtgaaaccatgcatacgatgacggccgccatcatgcgcatgccagtcgtaaagaaaataatcgtgcagcaaagcggcgcgaatcaacgaatgcaaatccaccctatgccataagcgcagcctgtcagcgatccatacggccagacaggccacacggatggaatgagcaaacgtggtgaccacgccatgctggtaacagactctttcgatctgcatatgctcatggcacagtatctcctggccgtgaagtcgaacaagctgctgtatctgcgttcgtgtcagtggcaccgctttgcctttgctatgtactgttgctgtaattatttgagcaatgattccggcgtcttgtatgccgggccgtcgctgacggagttggcgaaggcacgcagctgttcgatggcggttttcgcggaaacgatctgctcgcgcacgcgcagcggagacgtgcctcccttgccattgcgggcggaaacagaaccttcggtggatagcacttcgcgcacttcgggagccttgtcggccggaaggaattccttgaagacctcgatgaagtcatcgtcggccaggtcccacagttcctggccgcggtcttcggcgatcttcacgcatgcaccggaaagctcgtgcgcgtggcggaacggcacaccgttcttcaccagccattcggcgatgtcggtggcgagggcgaaaccggtcggcgcttccgcttcgaggcgttccttgttgaagaccatggtgccgaccatgccggtgaacgcgggaaggagcacttccagcgtgtcgacctggtcgaacacggcttccttgtcttcctgaagatcacgtgcataagcggtgggcaggcccttcagcgtggtgagaagaccagccagatcgccgatgagacggccggacttgcctcgtgcaagttccgcaatatccgggttcttcttctgcggcatgatggacgagccggtggaataggcgtcgtcaaggcgcacgaacgcgaactcctgggtgttccagatgatgatttcttcagacagtcggctgatgtcgacgcctgccatggctgcgatgaaagcgaattcggcgaccagatcacgactggcggtgccgtcgatggagttcgcggttaccttggagaagccgagttcgcgggccacggccaccggctccaagccgagggtgttgccggcgagggcgccggaaccatacgggcttgcatcgatgcgcttgtcccaatcggcaagacgttccacatcgcgcagcagcggccacacgtgggccatgagctggtgtgcgagcagcaccggctgggcgtgctgcatgtgggtacgccccggcatgacggtgcgtccggccttttcggcctgttcggtcagtgttgcggcaaggccgagcagcattttggcgatgacgcggctgtggcgacggagccacatgcggatcagcgcggcgatctggtcgttgcgggagcggccggcgcggagcttgcctccaagctcgtctccggcgatctgcagcagtccacgttccaatgcggtggcttcgtcctcatcgtcttcgatcggagcgaacgcaccggaatcgacacggcgctgcagctcgtcgagagcgtcttccattcgctgcagctcgtcggcggtcaatagtcccgcacgtccgagcgcacgggcgtgggctcgtgagcctgcgatgtcgtcgtcggcaagacgccaatcgaattgggtggacttgctcagtcgcgcgagttccggagacgggccggacttgaaccggccgccccacagggcgaggtgttcaccattggttgtgctctcggtcattgttacttcattctccttgcagatatgactgagggagaggataccagtcaggatggtcctaacggtacgctctcccccattatcaagacgattcggcgtaaaaaactcgcttactcgacgctgttttccggaacctcgatgccattgccgaacttgacgtcgcgggctgcggccacacggctcggcagaccgtagatgtcgatgaagccgttggacgacttctgatcgaagctgtcgccggaatcgtaggtggccagattgtagtcatacagcgaggtgtcggaacgacgaccggtcacgacggcgcgtccgccatgcaggatcatgcggatttcgccggaaacgtacttctgggtgtcttcgatgaaggcgttcagggactgcgttgccggggagaaccactgcgcatcgtagacgagttcggcccagcgcttgtcgatatcgcgcttgatgcggtgctgctcgcgttcgaggcagcagttctcgagttcctggtgggcggtgatcagtgcgatagcaccaggagcctcgtacagctcacgggacttgatgccgaccagacggtcctcgatcagatcgatacggccgatgccctgtgcgcctgcgcgacggttcatctcttcgatggcctgcagcggggtgacgtcgtgaccgtcgatcttgacaggaatgccctgcttgaattcgatgacgacctcatcttcgactggcgggaatgccggatcgtcggtataggagtagcagtccttggtcgggccattccacggatcctcaaggaagccggtttcaatggcgcggccccacacgttctggtcgatggagaacgggctcttctcggtctgcacgatcggaagcttgtgctccttggcgaatgcgatctcgacgtcgcgggtcagcgacaggtcgcggatcgggctgatggccttcagtgtcggatcaatggaggagatggacacctcgaaacggacctggtcgttgcccttgccggtgcagccatgggagatggtgtcggcgccgaactggtgggcggcgcgcacaagatgcttggagatgagcgggcgggaaatggcggaaaccagcggatacacaccctcatatagggcgttggctttcagcgccttcatgcagtactcattggcgaactcgtcgcgggcgtctaccacatacgcttcaacggcaccgcaggcaagcgcgcgctgcttgatggtttcgaggctttcgccaccctggccgacgtcgagggatacggccacgacatccttgccggtgcgttccttcagatatgaaatggcgacggaggtatccagaccaccggagtacgccagaacgagacgattttgatcgctcatggtttccctttctaacatcaaacgttattcatcagtatatgcaatgctctgtatatttatgcatatacggtgcgtcgtgtccactatatggctattcagcctttggacacgacgtccaacagccattgcgcacgctgtttcgcataatcgtcatcggcgcaaatcaccatgacggtatcgtccccggcaatggtgccgagcactccatcgatgggctgcttgtcgatcacacttgccacatactgggccgcgccagacggcgtgtggaccaccaccagattcctagccgccgcgaccgaagtgaccagtcccgaaagcacacgattcatctgctgttccgtttttgcatcaggattggccgacgcgctttcctccggctgtctgcccagcgcataggccacggttccgtcagccaaacgggttttggtggcatggatctcgtcaagatcgcggctcagggtggcctgggtcacttcgatgccctgatccgcgagaatctgggacagctgcgactgcgaggtgacgatgcgcgtcagcaacgcctgctcgatggcgctcaatcgagcggcccgtgtggcaggacgttgcagcgcaggtgtttggtccgtcatcaggccagcaggctttcatctccgcgggccttgccggcaagccaagtcagcagtgccttctgcgcatgcaggcggttaccggcctcatcccaaaccacggactgtggcccgtcgatgacttcggaggtgacttccttgccacggtatgccggcaggcaatgctggaagatggcgtcttccttggcataagacatgagttcggcgttcacctgataatcccagaacggcttggaacggatggcgtattccgattcttcgcccatggaaacccatgtgtcggtgaacacgcagtcggcgccggcgaccgcttccttcggatcggtggtcaccaacacggaaccgccggtttcggatgcgatggcttcggcatcggcaacgatctgcggatccggcagatagccgttcggccctgcgacacgcacgttcatgccggccacggcgccaccaagcagataggagttcgacatgttgttggccgcgtcgccgaggtaggcgatggtctggtttttcagattgtcgacgccaccacgatgctcggcaatggtctggaagtcggcaagaatctggcagggatggaattcatccgtcagagcgttcaccaccggatgggtggaatacttggccatttcctccacacgatcctggccaaaggtgcgccacaccacgccgtaggccatgcggtcaagcacacgtgcggtgtctgccaccggttcgccacggcccagctgggatccggacttgtcgatgaccagcggatagccgcccagttcggcaacgccaatggagaagctggaacgggttcgggtgctcggcttgtcaaagatcaccgcgatgccttgcggtccggcgaacggctgatggtagaaacggtcgttgtggaatttgatggcgagttcgagcacttgcttctgctcttcatggttgagatcgtcatcgcgcaacatgtggcgcagttcaggagttgccattgttggctcctttcaaaatatccagtctgctttgattgccggctatgttcagtcgttgggaagatcagttggaatcttcgcgaggatggagatggcctgatcgatgtcctgttcggtcaccaccagcggaggggcaagacgaagcgcatccggcgccaccgcgttgacgatcaaaccgtgttccaacgcccaattcatcgccgcatgcgcgcatggatgggcaagttcgaccgcgtcaagcaatccacgtccacgcacggagacgaagagcggattgacgcaagccatgatgccgtcacgcaattgctggccacgcgcctcagcgttggccacgagaccgtcttcctcaatggtctccaacgtggccatcgcggcggccgctccgagaggattgcccgcaaaggtggagccgtgggatcctggggtgaacagcgcggaaagcttggcgccgaaggagatcatgccacccatcgggaaaccgcctgcaacgcccttggcgaaggtcacaatatccggaaccactccgcccgcaagatcctcacgctggaatgcgaaccaggatccggtgcgtccgatgcctgtctggacctcatcgatgatgagcaacgcgttgttgtcgtcgcacatctgacgggccttcttcacgtagtcggcgccgagcggacgcacgccggcctcaccttggatcagctccatgatgacggctgcgacaggacctttgccatatttgccgggaccggtttcggcaaacgcgtcatgcaatgcggtctcgtcaccggcttcgacgaattcgatattgggaaccagcggttcgaacgcttctcggatggtgggcttccacgttgcggacaacgcgcccatggtacgtccatggaagccatgggtcatggcgatgatacgcgccggtttgcctccaatggcaggcgatgcgcccggcaaggtgcggccatacagtttggcgagtttcagtgctgcctcgttgccttccgctccggagttgccgaaatacacatgagatccctcgggggcgccggcaagctcaatgagcttcgacgccagttcaatctgcggttccgtggcgaagtagttgctcacatgagcggctttggctgcctgctcgctgacggccttcacccatttcgggtgggcgtatccgagcgcgttcaccgcgatgcccgcaaggaaatcgaggtattcattgccatcgatgtcccagatgtgcgcgccttcgccatgatccataacacgcagcggagtaccgaacacgttcatgtgcacccgggagtactcccccagccacttggcgtcctcgctgccgaggttttccaactgttcagttgccatacgaactcctcatttcaataccgtcttcgggaacgaccatggttccaatgccgtctgtggtgaaaatctcattcaggatggaatgcggtttgcgtccgtcgatgatgtgggcgcgtggcacgcctccatcgatggctctgacgcaggcttccatcttggggcgcatgccgctctccagatccggcaacatgtcgcgtaggttctccacgccgatgcgaccaatcagagaatccctgtccggccaatcggcgtacaggccatccacatcggtcagcacgaccagcttgctggctccaagagcggccgcaagcgccgcagccgcggaatcggcattcacattcaacacttcggtagcatcatcctcatttggagccaccgaggaaacaacaggaatgcgtccggcattgatcaggtcctcaaccgcggatgcgtcgacgctcaccacgtcgccgaccaaaccaatatcggttggcgatccatcgatgatcggcttgcgctgcatggcggaaaacagcgcaccatcctcgccggaaagaccgaccgcgaacggaccatgggcgttgatcaacccgacaagttcacgggaaaccttgcccgtcaaaaccatacgcaccacatccatggcctccggcgtggtgaccctcagacctcccttgaattccgacttaatgcccaaagccttaagcatgtgcgagatctgcgggcctccgccatgcaccacaaccggatgcaagccgacctgtcgcagaaacaccatatcttcagcgaaacaggctttgagatgatcgtcgatcatcgcattgccgccatatttgatgacgatgcgctgtccggcgaattcctcaagccatggcagtgcctcaatcagcacttccgccttttggtcggcgcgcaaatcggtatgcacgtcaaaatggaatccaggtcctttgagttccttggtcattaccgttcaatcagctttcgtaatctgcattaatgtgtacgtattcgtgggtcaaatcgtcggtccagacagttgcttccgcatttcccgcatgcagatcgatgtcgatgtgcacctcgcgcggagtcatgtcgacttcggatcggtcgcgtccggctccgccgttctcacagatacgcacgccattgacgtcgaccgtgactttattggaatcgtagggagcgacttccggcggcacggtacccagcgagctgacgatacgaccccagttcggatcattgccgaagatggcgcatttcagcaaattggatgccgctaccgcacgaccgcaagcaagcgccgcatcttccgtggtggcgccggtcaccttgacacggatgtcatggctcgcgccttcaccgtctccgacaatctgacgcgccaaggaggcagtcgcctgcgccacaagctcgttgaactcgtcgggatccggttcgataccggatgctccagacgcaagcaaaagcacggtgtcgttagtggacatgcaaccgtcaacgtcaatgcggttgaacgacatttccactccagtgttcagagctgcctgaagctgtcccgcgcttaccacggcatccgtggtgatcacgcacagcatggtggccagctgaggcgcgatcatgcctgaccctttgaccatgccgccgacacggaacccattggacccttcaagttcaacggttttcggcttggtgtcggtggtcatgatggcatgggacgcatccgcaccggcctgagcggtatcggcaagggccgcgaacgctttgtctgcgccagaaagcacatggtcaagaggcagaagctcaccgatcaggcccgtggagcagaccgcgatatcgctgtctttggcacctacaagcgccgcgaccttttgggccgtggccttggactgctcatatcccggctggccggtgcatgcgtttgcgcctccggaattaaggatgacggctttcacatgaccgtcggccacgatcttgcgcgtccactgcacgggagctgcgcagaaacggttcgaagtgaacactccggcagccatatccagcggaccgttattgaccacaagagccagatccttcttaccttcgactgcggaaataccggcttccacgccagccgcggaaaaaccttgcgcaaacgttacgctcatggcgccactccaatctttgtcaggcctgcatcttcaggaagtcccagtgctacgttcaacgactgcaccgcctgtccggccgtgccgcggttgagattgtcaattgccgcgaaggccagcaaacgccccgccttacggtcgatggccacctgaatatgggccgcgttcgatccgatgatattggcggtggccggcatgacgccttccggtaaaacaatcatgaaatcctgatccgcatatgcgtcagtccaaacctgcctgatttcagcatctgacatattcaatgctgtatcggttagtttggcggaaaccgaagcgagaatgccacgggccattggcacaagaatcggggtgaatcccagcgtgaactcgtttgccgcggatgcgttctttcctgcagcatgggcgaagttctgcaaaatctcaggaatatgacgatgagtaccgccgacagaatacggtaatgcggaaccgaatgcctcagctgcaagcaaattgacgcgcttcagattcttccctgcgccggagtagccgaccaccagatcggcaacaatatccgccggttcaacaagcccttgggcaatgcccggctgcagcgccaatgtggttgcggtcacattgcatcctggaccggcaatacgcttggttcctggaatcacctcacgctggtgctggtaagaaccatcttcggatatgccggtaatgagctcaggcatgccgtaagtccagtgctcatagaagtcgccgccgtagaactcatcccatgcggttttttcctcaagcctatggtcggctcccaaatccaccaccacggcattcggatcaagctgggaagccaatgcaccggatgccccatgaggcagcgcaaggatgatcacgtcatgcccgttcagtacctccggagtggtgtcttccaccacaaggtcggcaagctgcggaatatgtggcatatgcttgccaagcttgtccccaacggatgaatgcccggccacgcacgtcacttcgaaatttggatgggccgcgaggatacggagggcctcgcctcccgcataccctgtcgcgccggccacggctactgtgtatttggccatgtcacgcctctttccattgactcactgaaaacacattcagcatacactttatgcactacattgcataattatgcattcatttcgtgtcgcatagtggtcattgcgagactatgacaattattaaaagactagaaaacacgccgaatcaggcagcgatcgactcgtctccctgccccgatcccgcgccgccaagcatattctgcaacgtctcgttatacaggtcggcaacggaaagaccatgcatcgccaaccaaatcacggccaaggtgtacaacacattgatgatcaccgcggcgagagccaagccataccctttcatatggagcttcttggtacgccacatcgaaatcgcgccgaccaacgcgggaaggaccggcaccggcatcagcacggcaagcacgagagacatgatcgcataggcatcccaatggccgtatgcgggattctgccgaggatcgttgagatccagattcggcagatagggcatattgccctgctgcggatattggttcggatcatacggattcggcccatacgggttggcgccgtatggattccgttgtccgttcgcattgtacggaggcatcggttgctgcccatttgaagggtattgccccgtttggtattgcatattctgctgctgtacagcatccgcaggttgcggttcaggttcaggcgcaccatacacgtatggatcgtaaccggccggcagctggctactcatcgcaccatattcgggttgattgatctgaccatactccggctgtgaagacgcagcggcatcggaagatgacgaaaccggagcagcatcagccgtctcctgacgttcgtcggtgttggtcggctgatactgctccggttcgttcataatcatcctctgttcttgggaaggtcgggatcaggcgcgcagctgcgcaccaagcttggacgcttcatccacaatacgcttgcggatggcttcgctgtcttcggaagcgagagtcttatccggagcgcggaatgtgaccgcgtaggccaaagacttttcgtcctcgcccagctggtcgccggtgtacacgtcgaacagctcgatgctttcgaggctgcttccagcggcatcgacaataacctgcttgagctcggcggccgtgacatcggtagacaccgtaaaggccagatcctgcttgaccggcgggaaggtggaaatcggcttggcctgcaccggcttgccgctcaacgtggcgaacagcgcggtcaaatccaactcgaaggccgcggaatgggccgggaagcccaacacctcgttgacatgcgggtgaagctcgccgaccataccgacgaatacgtcaccagccatcacacgagccgcacgacccggatgccattgtgccggcacatcttcagccttcggctgatccagcgtgagagctgcaccaatacggtcggagatgcgctgcaccgcctcaacggcgtcagaccaatccactgcgcggcgctcgcccagccaaccggagtcaacggcgttgccggtcagaatgccagcaacatgcatcggctggtccggaagaccggcatcaagcgcggcaagctgctcgtccgtcggcttgactgcacccggcagtgccggaatcgccggagcgttcggatcccacagatacacgtggccgatctcatacagcgacacattctccacgccgcgacgtagattgcgctgaacggtctgtgccaacgttggaataatgtcacgacgcaggaacggacgatcaccggcgagcgggttggcgatctccacgctgacgttcttcgtctcagcgacgtccagcgcgaagttcttgtaatcctcatcgccgacgaacgggtagctcaacgtttccaccatgccgtattcggcaagttcatcggcaacctggcgcttgcgcagctgctcagcagtcagaccgacctgaccttcgaccggtgccggcggcacggtgacgggaatctcgtcatatccgacaagacgcgccacttcctcaaccagatcgcacggctcgttcaagtcggggcgccaacttggaggcgccacggaaaactcgccgttgccgcctcctgcgacggagcaaccgatgtcggtaagaatgtcgctgatggtgttcacgtccgtgtcaagtccggccacacgagccacttccgaagccttgaacaggatcggacggcggttagagacggtattgaagtcggtcgggtgctcgctcggctcgccattgccgtacctaaccatcagttcggcggccatttgggcggctgccggctgcagctggtcgtccacaccgcgttcgaaacgacgggaggcttcggacggaatcttgtgacggcgtgcggaacgcgcgatcgacacctgatcgaagtgcgcggattccagcaggatgttcttggtttcggcagtgacctcgccatacatgccgcccatcacgcctgcgatgccaagcacacgggagccgcgttcgccattcggggaatcggtgatcagcagatcctcgacgctcaaatcgtgatccttgccatccaacgtggtgagcttctcaccttcgttggcgcgacgcaccacgatcggtccttcgatcttatccagatcgtaggcatgcatcggctgtcccaagtcgagcatcacgtagttggtgacatccactgccaaggagatggaacgcatgcctgcgcgggtcaggcggcgacgcatccaattcggcgtatggctggccggatcgaagcccttgaccgcgcgagcgtaatagcgatcgcatccaaccacaccgtgaatcggattattgtcgtcgacgatcacttcgatgtcggtcttggtgccttccggcaggcccttggtgatcggcgccttctcgttcagggcgacagccggatcggtgtaggccgcaccggtggaatgatggtattcgcgagacacgccacggtatgagaacgcgtagccgcgatccggagtgatgttgatctccagcagcggctcgtccaagtgcagcaggtgcatggcgtcgtcgcccggctggagcttctcatactcttccggggtgaagccgtacttgcgaagcaggatgatgccgtcatggctatcacccaatccaagctcgcgttcggaagcgcacatgccgttggagatatggccgtaggtcttgcgcggttcgatcttgaaatcgcccggcagcacagcgccaggaagcgttacgacgaccttttcgccggcagccatgttcggcgcgccgcagatgatgccgcgcggcaccttgttgccgttctcatcggtctcgttgtattcgtcgccgacgtcaacgtggcaccagttgatgatcttgccgttcttctgcggttccggagtggcgtcgaccacgtagccgacgacgatcggaccgaccagctgggaggtgtggatctcttcctcttcgagaccgaccttcaccagatctttggcaagctgttcgtacgtaaggccttccggaacctcgacatggtccttgagccaatcaatgtcaaccattggcatgggtcaatcactcccccatcacaaactgttcgctgaatcgcacgtcgccttcgaccaggtcgtgcatgtcgttgatgtcgtggcgcagcagcagggtacgttccacgcccacgccgaaggcgaagccggtgtagacctcaggatcgaggccagcggacttcagcacattcgggttgaccataccgcagccgccccattcgagccagcctgcgccacccttcttgtcagggaaccacaggtcgagttcggcgctcggctcggtgaacgggaagtagctcggacgcagacgggtcttggcttccgggccgaacatggccacggcaagcttatcgagcacgcccttcaggtcggccatggtcagatgcttgtcgaccgcaagagcctccacctggtggaacaccggcgtatgggtggcgtcgagctcatcggtgcggaacacgcggcccgggcatgcgatgtacagcggcacgccacgggtgagcagaccacgcacctgatcggaggaggtctgggtgcgcagcaccatgttggatccgacgaatcctgcggcgtccttggcctgattgcccttgacgtagaaggtatcctgcatctggcgtgccggatgatcggggccgaagttcagcgcgtcaaagtcgtaccattcggtttccacttcaggaccgtcggaaatctgccagcccatggaaatgaagaagtcttcgacatcctccatcagtttcggcaacggatggcgcgcgccaagcggcttgcgattgaccggaagagtcatgtccacggtttcggcggcaagcgcacgggcctcttcctcggccttgacctgctgttccttggtgccatacgcacgaccaaagtcagcgcgcagcttgcccatgatcttgccggcgtctttcttctggtccttcggcagcgcgccgatggccttgctggcctgcgtcatcgcggattccgctccggcgtactgcgtcttgatggctttcaattcctccatgctggaggcgttttcgattttcgcgatgccctcggcaaccgcatcggttaccgcttgggcgtcgaataccgcaccttctgccacgagatacctttctcatttcccgtttgttttacgcgaaaaacgcgcaatttcaacgttttccgactttacattctttcaacatgactcgacatagccaagctcagcagcattaccgccgaactggtgccgaggttcaaggattccgctttgccatagagcggtatggacacgatcctatcggttcgttccaaaacttccttggtcaatccgcgtgcctcattgccgaacaacaccgctttggcgccggcaagcgtttccggcgcagcgattacatccgtcagggattccggctgccgggaatccgtgccatatacatcggccgcatacactgccaactcgtgagtatcgcaccatgcgaagaagtcgtccgttcccatggtcagaatcggaaggtggaacagtgatcccacggtggagcggatcactttcggattgaacacgtccacgcagtcgtcgaccaataccacggcggagcagccggccgcgtcggcggaacgaatcacggttccggcgttaccgggatcgcggacctgccaaaacgcggcgaccatcgcatgctcgtcgaaatcgtccggagcggcggacgaatcgaggaaagcctgcatgtccgcgacggcaagcacgccttgcgcgtcggcgctcatacggtgcatcaccgcatgagtgaccttgtgcacatacacgccggattgcatggccttgcccgccatctgcgcgacgacaggtgtcgcaaacgaggcatcgggctgtgccgactcgacctcaacgtagagatcctcgacaagtcctggatgccatgtcagcagctcgcgcaccgattgcgggccttccaccatgaaacggccagaccgtttccgcccttttcgatcggcgagctcggacacgcggcggacgcgctccgacttggggttcgcaatgacttcggattttataggcatacgcgttagcctaacaccattgccgcaatgaatgccccgtccatgtcgcgtttttaattcagaaaactttccagattcattccatcagcagtcgcagcagaccagccagagggcgcagtccggtcgcgatatgcagggtccgacaaatgattccagcgactctgccggctcgcaggattccaataccgataacaattctccggattcgcagcagtccggcaacgcacagagcgatgccccagcgctggcaaaaccactatgctgttactgatttccgggcttgcgaatcccacagagggaaaagtgttgtgcaacggcagcgatttgtcacagcaggatcgtcacccttcgccttgccccgtattcgacatgtcatgaatttggcaggtcgggtacggggcttttgcacatccatgaaagatatgcacagcttgcgagtgtgtctcaccgctttcgattggtttgcgaacatcggttcgttacactgattatctgacttattgtctgattacggttgggcgcgcgacatcatcccatgaatgttggaggtacaagcatgaacgtcacggtgtatttaggagctcacgaaggcaacaaccccgtatacaagcaggccgtggcggagctggccatatggattgccgagaacgggcaccgtttggtgtatggcggttccaacgaggggctgatggcagtcatcgccgacactgtgcttgagcagggtggcgaggtgaccggcatcgaggcgcagatgttcgtggacaagggtgtcgcgcacaagaatctgacccagctcaccatcgtgccgaatatcaccgaacggcgtactcgcatgatcgagcttggcgacgtgttcatcgccttccccggcggcacgggaacgttggaggagatcagtgaggttgtgtcgaaggtttgccttgaccagttgacgcagccttgcattttctacaatctcaacggtttctacgatgacatgaaggcgttgctgcagcgcatgatcgacgatggcttctccacaggggaacgccagcatggtatctatttcgcttcggatcttgccgagatagagcatattatcgccatgcacaaggcataggcggctcagtaaggtcgtttttattcgacaggtttttcaagaaaacggggacgcccaaacgaccctcataatcggccggaatatcctccaaccggcccatcacaaccaacatgcatccacatgccccgcagcgcatccggtcaactccgggatgcttcgtttgccgaacttactgatcggatggaacccgtatccgtcggccacgcgaagaatggatttgcgttttattgtctgcatgatttacagtttcgttaccatgaacatcccgtttgtcctgctgtacattttcctcggcggcgtgctcctgttctccgcctattcgctctgggagaaagacaaaaacaatcggaggtaatgcagaatggacagcaaggcacttctttccttgaaccatttaagcgtctggtacaccgcagatcaccccttactttctgatttgcactggatctaggggcagcggaagatcagtcatttcagtatttcacattccgggaatatctaacgtatgtggcggcgtcctatggtgtcccgctgccagatgtgtctgacctcataaggggatttcactttaaggactatgccaatgttcttctatcggtcgcggatcttcttccactgcctgccatagcgcttgcccgcggagtagccgcgcgtgaaatgcttgtactgccgctccgcttccttgcgatgcttctcacagtattgctcgccgtcctcgcaaaggttcgggcagccggggtggcggcaggggcgtcttggttttctcggcatgcgtgccgcctcctttcggacaatagaaaagccccgaaaggattgctcctttagaggcttgaaataggtcgtccggaccgcgttctccttctttcggcttgttatctacgatgggcgccatgggtgcttatagagagtggttcgcggtaacgctacgcttgcaagacggttgaaacctgagtatttatttaatccagttaggcgtagtgctttgtgatgcacattggcaataaaaatcttgaaagacgataagcggctatgcgggaattactacatgaggatgatttcctacgatataccctgcagagcaaaggcaaggtatatttgtgggaaacgagtaatcaatatgcatgaacggcgcatgtcaccaaggagatggtttcgacatggacaaggatttccttgcgatttttaatgccataaaggctgatggggcgaatgcagactacaccaagcgcggcatcgatccgctctactccgtcggggctggcgctcgcatcgtggtcatcgggcaggcaccaggcgcggtggcggaagagacgcgcatcccctggaacgacaagtcaggagagcgtctgcgcgattggctgggtgtttctcgcgagacgttttatgatcctgagcgggtggcgcttctccccatggacttttattttccgggacatggcaggtcgggcgatctaccgccgcgcaagggattcgccgagcagtggcatcctgcactcttggcgctcatgcccaatgttcggctcactgtgcttgtgggcgcatatgccgtccgcaggtacctgcatctcaagaattcggacagccttacaaccgtggtgcgcgattatgatgcctatatcggccggggattcttccctttggtgcatccgtcgccgcgcaaccagctatggatgagcaggaatccttggttcgaggccgagaccttgcctgcactcaaggcacgggtcaacgcggcgcttgaacagaggtaagtggttacgaaatcatctgtgacgataacttccagccatacaaggaggttcattcatgcagagaaggacgttggggactcgtgaggcgcttgaaggcatcctcgaagatgccgcgacgccaacgagagcgttcgcgagtgactatggttatgacctcgtcagtcttctgctgcccggtgatgaatgctcgtatgtgatgggcaacccgccgttcatcggccatcagcagcacacgcagcagatcaaggatgatatggaactggtgtgcggcaaggccggaggctcgctggattatgtggctggatggtattttaaagctattgatttccttgacgggaatccctccgcgcaattcgcgttcgtatccacgaatagcatcacacaaggccagcacaagtcgccccgctattcaagcatgtggtcgaacgagggtggcgtatccggttcgctcaccgtacgttctgctgggacgctcagactacggacaatgcgaacgtgcatgtcgtcattgtcggattcgacagaggcacaaacgctcctgcgttgtatgaatacgacgacattaacggtgaacctgtggaagcacgtccggctcatatcaacggttatttattggatgcgtctgatgtgttcgtggaggcgaggagtcagaagaccggtccgtaaggtctttgccgtcccggatggaagaaattctgtaggaataaggagagcctccccaatttggagaggctctccttataaccaatctggctaccttctgattacccttggagtccaaaacagcttgatttcaagggaaactgggtataggcctcagatgtggaagtacagctcgtactccagcggggtcggagccaggcgggcctggtcgatttcaccacgcttgatgccgatccaggtttcgatcaggtcgtcggtgaagacgtcgcctgcggtgaggaagtcatgatcttcctcaagggcatccatggcctctgccagggagctcggaacctgcttgatacctgcgtgctcttccggcggcagctcgtacagatccttgtcgaccggctccggaggctcgatgtggttcaggatgccgtccagacctgccatcagctgtgcggagaaggcgaggaacgggttgcaggacggatccggagcacggaactcgatgcgctttgcagccggggaggtgccggccagcgggatacggatggcggcggagcggttgcgtgcggagtacaccaagttgaccggagcttcgaagcccgggaccagacggtggtaggagttcagggacgggttggtgaaggccagcacggaggaggagtgcttgatcaggccgccgatgtaccagcgggcaaggtcggacagaccaccgtagttcttctcatcgtagaacagcggcttgccgtccttccacagggactggtggcaatgcatgccggtgccgttgtcgcctgcgatcggcttcggcatgaaggttgcggccttgcctgccagagcggcggtctcgtgaacgacgtacttgtacttcatcaggtcatcgcctgcgtgctgcagagagttgaagcggtagttgatctcctgctggccagcgccggcgacctcgtgatgggaacgctcgaggatcagaccgaccttctgcaggttggcgaccatgtcgtcacgcagatcctgggtgtggtcgatcggcggaaccgggaagtagccgcgcttgacgcggttcttgaatgcgatgttcggggtgccgtcgtcttcggtgtcgacgccggagttccacggagcttcgatggagtcgacctcgtagaaggagcgctgcatgctgttctcgaagcgcaccttgtcgaagatgaagaactcggcttccggagcgaaggaagcggtgtcggcgatgccggtggacttcaggtaggcctcggccttgcctgcaacctgacgcggatcgcgggagtacggctcgtcggtcagcgggtcgacgatggagaaggccacgtcgagggtcttgtgcttgcggaacggatcgacgaatgcggtggaaacgtccggcaccagcttcatatcggattcattgatggcctggaagccttccacggaggagccatcgaacggcatgccgtcggtgaaggcgtccttcaggaattcgcttgccggcacggtgaagtgctgctgaacaccgatcagatcagtgaagcgaacggagacatactcgatgccttccttgttgataagggcctcagcatcagccttggtttcaagtgcagtcacgggaccgctcctttcgaataagtaacttacaggctcttagtctaggaacgcgcgtttcgctcactcgccaattgggttacgagaatgtttcgtaatgacatattcgaaggatgatttcgcgaaaaactggggttcaattgttacgaacgctcgtatttgcctctgcaaaaccgttcaatttgtggacattcgtgtcgtcatgtcgcttgcgacgtccatttcttttctcaaaaaccttaccgcatgcgcgcaggccagcggaaggtaacggagatatgaaaaaaggaacctcgataacgtgttcatcgaggttcccatatgtaagccggctttacgattccaggaaaatcagcggccacgcatagcacgacggctgatgcgctgcgggtgcatcgggtcgacgcccttcggaatgcccatgccgttcttcatctgcagagtgcgcagacgctcgttgaggatgttcagctcggtcttggtaagcatgaagcggctcttcggatggatggcggccaccaacttgttcttgtggtgggtcggcaggtagctcttgcatttgagcacggtcttgcgcagattcttcaggctcgtctgattcttgccctggccgacgtagatacggtagacgggaatatcggaaccggcggtcacacccttgatattctgctcctgacggtccatggcacgcttgacgcgattgtaatcgccctcgccgagcagataaatgccgttgtaaccggtgccgcgccaaatggcgtctttggtcttcggatcaacccacaccggctcctgcggaaagttgaagccagccttgttaatgttgccgagcacgctgatggcagcaccctgacgcccttcaagcttggcgtatccgactttgtcggcacggttggtgagcatcatggtggcgaacagcaggccaagcatgacggccaggatcatggatgtgatccatccaatcaccgaccacttgaatacgatgccaagtaccacgaacacgatgataggcgccacgaacacgcctccgcacagccacggaagagccttgtcttcggcatgggtgtacttgaagatctgaatgatctgtttgatggtgctctgcttcttctttggctcttctttgtctgccatcgacttcctcacttggttatgcggttactcacactggaacggtagtttatcaggaaccatgccatatcgcatgatttccgctgtttcccctttattgacgaggattatcgggtgtgcaaaggcctgccatccgctttgagcagcgcctctccgaacgattcgctgaacgtaggatgcgggtgaatgagctttgccgcatcggcaagcggtacatggttaccaaccagctgttcggcttccgcgatcagatcgctggctatcggactgacgatgtgcacgccaagcacaagaggaacgtcgggagcgtcagccatcgcaccgctgacgatggtcatggatccaccctccccactcatgagcatacgcgagttggacagcatcggatatgcggtttcctgcggatcgacaatagtgtcacgtgatttcgcctcgctgagcgtaagcccgacgcttgccgcctcggggaaggaaaacacgacttgcggcacggtttcgtcgacgacaggtttgggatcaagtcccgcgatggtttcggcgatggtgatgccctgctcgaacgcacggtgcgccaaggcatgccccggcgtgatatctcccaaagcccatacgccttccacgttcgtgcgcccgtacgcatcggtcagaacatagccacgttcatccaatgcgatgccgttggaagcgaaccagtcggcatcggtgttcggcatgcggccaatggcagcaagcaccacttcgccatacgcggtacgctcctcaacgtcatcaccctgcctgtagtgcacggtagcacccaagtttgctccggtgtccacatgacttaccgacgtgcgcgccaccacattcacgccatggcgtttgagctcacgtgtcaacgtcatcgaagcccgcctctcccaagacgacagcacgcgatccttgcgaatgagcaaggtcaccttgcatcccgacgcattccacaatgatgcgaattccaacgccaccgcgccagcgccgataatcactgcgctggatgggaacgtgtccaattccagagcctgcgtcgaatcaatcaacgctccggaaaacggatcgtcaggcaacggcagcgggcgcgaaccggtcgcgagaacaatatcgccgcctgagatcgtaagttccgatcctacaagttcccctactcccgccttgatggaacgcagaacctgcgtctctcccaaggccggcgcaacatgcacctcatgaccatttttcagctgtgcctcgccacggaacacggtgacgccacggtgcgacagcaatcccgccaatcccttcgtcatcgtctccaccgtggacatacggaagtcacgtaacctgccgaagtcaatgctctgcaatgcgacattgacgcccatacgctccgcctgacgtacgttctctacactatgcgcggccgtcagcaacgccttcgatggaatgcacccgcgattgaggcaagtgcctcccaacgtgtcgtcgcgttctaccaatgccaccgttttgccaagttgggcagcgcgtagtgccgtggaatatccgcctggtcccgctccgatgatgacgatgtcgaaatgctgttcagtcatgcctgtcctcgttgattcgtgcgttacaactggttacatggtaatggaaaagccgccggttttcgccgacggcttgaaaaaacgatggccgcgattcccggcaggagccgatcactccggccagtgtccacgcttatcgtaacgcggcttcggcagacgccaacggcgcatctggatcgcacggctccacgcataggaaccagaacgcatgcccttggacacggattgctcgccgaacttctcaatgagtttcttcttgagcttacgccacatgatcaccacgtcaatgatcaccgcgaacaggtacacatacatgagcaccatcaacggcaatgccagcgcaggccactgatatgttacgaaaatcgaaccgatcagaatgacgaacgcaaccggaatgaagaactcaccgaggttaaaacgagcgtcgacgtagtcacggatgtaaatgcgccatggcagacgctctgcctttggcatgtggttgatgtcgcccttctgcatggcatcgtactcggcgttctcacgctcgcgcatacgcgccttggcggccttacggctcgcctcgcgatccttgggaaccaacgggcgaagattctgcgcctgagcatccttgcgcttcggcgtcggacgacccttgccggaagtggtttccgcaaccttggtctcgacaggctcctgcgccgtctcttccttcttgttaaacaaactcatgcctatagagcgtaaagtgacgtatcgacgccttggccctgccctgtcaacaattggacgtgccgattgagaccgatacaatggtcattcgttacacgcatatgatcacgctgcgttgttgtatggcagcgcgtctttgtaaggagcaatatggcagctttacctgtcgaagaagttcgatcacgagtcgaagcggattttgaccgcatcgtcaacgtgcttaacaagaaaatcgcattacagtccatttcggcaaaaggcatcaccgcggatcatatgaaacgatccgccgaatttgtggccgaagagctcagcaaggtcggcgtaaacgcccaagtggtgcagtcccacaatcctaatggcaccccgggcgcttgggaagtcattggttcgaagattgtcgatgaggatgcgccgaccgtgcttctgtacgcgcatcacgatgtacagccggtacccgacgccagcgcatggaacaccgacccgttcgtcggcactgtaatcgacacccgcctgtacgggcgcggctcggccgacgatggcggcggaatcgccattcattccggcgcattgcaggcgctcggcgacgatttgaaggtcaatatcaaagtcttcatcgaaggcgaagaggaaatgggatcgccaagcttcattcccttcatcgaggagcataaggacgaattcgattccgatgtgatcatcgtcgccgactcgggcaattggtccgctgaaatcccctcgctcaccacgtcgctgcgaggcaataccgatattgacgtgcacgtcaaggcgctgcatcatccggtgcactccggtcagtacggcggaccgatcctcgatgcgaacacgcttgcctccatgctgatcgcttccatgtatgacgagcatggcgatttggtggtaccgggcgtcgcctcagaagatccaatcggcggactgcagcgagatatggatgaggcaaccgtgcgtacggacgccggcatcgtcgattcctaccgtctggccggcaccggttctttggccgcacgtctgtggaccaagccgagcgtgaccgtcatcggcttcgatgctcatccagtggagggatcgttcaacgtgatctcccctgaaacgacgttccgtctcagcctgcgcaccgctccaaaccagcgtccggaagaggctcaggaagcacttgccaggttcatggtcgagcatgctccgtttggcgccgaagtgtgggtcgacaagcttgataatggcatgggttgggccatggatccaaatgccgaggctaccaaagacgccatggacgccatggaagaggcgtttggcgtggctccggtcaataagggcgaaggtggctcgattccgttcattccggaattgcagcgtattttcccggacgcgcaggtactggtcaccggtcccgaggatccgaaggccaacgcgcacagcccgaacgaatccatcagtcttcccagcctgaaaaacaatgtgatcaccgaagcgctgctgcttgacaagcttgccaagtagcggatatcacatatcttttgagaaaaacaacgggcaaatgcgaagggcgttccattccatacaacgaatgaaacgcccttcgcaaatccgccgcgcattcaacaaacctcgtactgcgcagccctgctccgattaattgccagtgccggtaaaagcccaatgccagtaaccggtgaaataagcgcaagacaacgcaatcactggcactgccacacaaatcgcataaaacagccagtcgacggcgttcaaacgtgattcccgggcctgactacgtggagcatccgatccgaaagcacgcgcctccatggcggtggcaagcttcgtgccgcgtcgaatcgacacaaccaataggctgaacgcttgggaaaatacgcgcttgatggcgctaccgtcgcctagtccacgagagcggcgggattgcccaagcgcacgccaatcatcctgcagcaacgtgaacatgcgcatgccagccaaaccgccatatacgaatcgtgacggcaaatgcagaatctgcaccaaaccatcggccagatcggtcgggtcaaggccaagcgcgaggatcacgccgggaacggcaatggccgccacacgtaggaacgtggccaccgccaaatacaacgatccctgcgagaccacaatgacattaccaagattgaccagcacggcaccggaggttttgccatacaatgacacggaaatgaagcttcccgaagctgcgacccataccggccaggttttacgaagcaccgtccatggagcgacgcctccaatccagagcagcagcatctccaacgcaaacgccaccgatgcggaaaccacatccaacgtcacgaacatgggaatgcacaatatcagcgcaccgatgaaacgactgaccggattaatcttcgctacaaaccatgacggcgacgccggcttggcgtcatcatgacgttccctatgcggcaccacgctgatagttttcaactgttccatctcactccccctcgcttacgagaatgcgacgcgcacccagcgcttcgatcaacggctcgtcatgagtgaccatgatgacggaacagcccgcgtcgcgcgcgcccgctatcagcctgaccatttccgtccatgtggtgaaatcctgaccgaatgtcggctcgtccatcaccaacaccttcggcgccgcggcaagcatggacgccacggaaaggcgacgcttctcgccgccggataacgtgaatggattggctggggcgaaccgcttgagattcagccgttctagcatcatatcggcgatggcgtaggcctcgtcatcggttttccccatggatttaggaccgactgccacttcgtcgcgcacgctggacgtgacgaactggtgttccggctcttggaacaccatgccgattcgcccaagaagatccctgcttttccatgtgaagacgttgttctccctatgtgcgggaaccatgctttcatccatacttacccgaccggaaatcggcttgagcaagccagccaaagtcaaagcgagcgtggattttcccacgccgtttttgccggtcagggcggtaatctcgccggcatggaacgcgaggttcacacgctcgccaagagcgaattcacgtccgaagctgagatcctcggttcgcagaacaacatttcccgacgattgattggattcgggaatatggctttcgacggtgcgccccggaacccaggcaccaccttttgtcaataccggcgccatgctgccaaacacttcttccggagtgccgtcggcgatgactccgctgacatgcgaatcggattccggcttaccaagcacaatgacacgatccaccaaatcaagccatacgtcgatatgatgctccaccaccaccaaggtttcatgggttcggtcaagcacaccacgtaccgcatcatgcacttccttgacgccttccggatcaaggttggcggtcggctcgtcaagcaacagcagcccgggatgcatggcgagtacaccagccaaagccagacgttgacgctgcccgccagaaagcctgcgtgtggaacgatcgagtttcatatagccaagtccaacaatgtcgagtgatgaacggaccctgctccaaatctcattttttggcagattcagattttcacaaccaaaagcagtatcatctcccacacgttccagaatcgtctgcgcatcgggatcctgcaataccaatcctgagcgcccacgcgaatgacgggcatccgttccgtcaatcagcagctcaccctcgagttcgccttcatcatcaccgccgagcacgccggcaagaccggccatcaacgtcgattttccggcaccggaagcgcccaacagcaacacgcgctcccccggctgtatggtgaaatccacatgccttaacgcaaaatccttacgtgaggcatgccgccatccccaatcgcgcgcgaccaccccggctgcggaaaacggttttcctgcatcagtacccatgaatcgttctttcattccttttgcatttgacattcgcaaggcgaacacgcatcaaagaagtcccgtatccactcaccgtgaatgcgatacgggacttcacaaacgaatcgtcagaccagttcctgcgtgcggccggattcgaaacggtcaagcacgccggttttggcgatggccacctgtaggaaatacatcaccatcccggcgagcactgcaccggaaatgatggaggtgcctaggtagatactggcacgcaccgtgctccaggccgggttggtgatccagtagtacagaccgcagcctatacctgcgaaggcgccggcaatggtggtggacagcaggtcccacttcctgtaggcaaagactgcgaagccgatttccgcgccaaagccctgcatgatgccgacgatcagtgagccgccgacaccccactggttgcccatggtgagctcaagcgcggcggcaagggtttccgcgaacaacgcggcaccaggtttgcgcacgataatggccgccaaaggacctgcgaacagccaaaaggcgttaagcaatccttcaaaaccaggggtcaccgctccgaagagagccagtggtgcggtacagacaatgtcccagccccagaagatcacaccggacgcaacggcaatgatggcagccacgacaatatcgactacacgccacttgttgttgtgcttgcgcactacggaagactgcttttcttcaatcataggatatgtgcctttctctctttgacaaggcacgggaatggagagacgtccgtgcgccggcattacccggtatacgttcatacggtcgaagcgtttgcttcctctcagccatacggcccccgtgtctgcgcttgatactacacaaggcacaagattttcacaagggccgtttcattttcgcttcgtttccggtatggaatacgctcggttttttgcaatggcctgtcttcgcgggtttccctcccatactgaatgcagtacgggaacacggttccatagagttttacaggggcctgcgcatcaacgattcagctaggttcctgaatgtctcgccaatatcgtcggcacgtaatgagccatcctcattcagcacggccggacgtccggcctcaccagtctccctcaattccggttccaacggaagctgagctagcaaaggaacgtcataaccgaggctttcggtcagctgttccgacacgcgcgcgccgccgccttcgccgaaaatccgcagacgttcacccttgtgctcgtaatagctcatgttttccacaacaccacgcactttcatcggcacctgcagcgtcaccaggccggagcggaccgcgatgtcggatgcggatggctgcggcgtggtgaccaccaccagttccgcgttcggcaaggcctgggccacggaaatcgccatatcgccggtgcctggagccaagtcaagcagaagcacgtcgggctcaccccaccacacgtctgaaaggaactgttcgagcgaacgctgcagtctcggccctctccaaaggatcgcgcgatcggcgcccgcaaacatgccgatggaaatcaatttcgttccccaagcggtgacgggcatgagcatgccattcagattggtgggttgcgcgtgcacgccgaacagtcgcggcagcgagaatccatagatgtcggcatcaatggcagccgtatcataaccgagcgccgcgaaagtggcggcaagattcgcggtgacggacgatttgccgacaccgcccttgccggatgctatggcgaaaatacgggttttgatgcccggcttgttgaagggattctgcttgcgctcggctttgagaccggcaacgagttgggtgagcttgtcttggctcatagatccgacttcgatgcgcggcagcagcgttgcatccgggtaggatgccaccgctccgttgatctggttggtgatggtctgcgataatgggcagccttctaccgtcagttcgacctccacacgaacctcataggtgttcgccttaccttccaccggtatcgcatcgatggctgcgatcatgcccagatcagtcacagatcgacccagttccgggtcgattactttgctgagtcgctcatagatgcgcgcttcgatggtgcgctcgtcggtcatggttcctcctttagccgcgtaccagactagcgtctggagacgcggcatgccagagctttcttgcgattacgttgccagtttgacgtgccggtatcacaccgttccattttccagcagtattttgaactggtcctcgtttagcatgggaacgcctaattcctctgctttggcggctttggcaccggcgttttcgccaatgaccacccaatcggttttcttgctgacggatcctgaggctcttccaccgcgggagataatcgcttctttggcggagtcacgcgagaagtcaatcaacgaaccggtgacaaccactgttttaccttcaagcgtctgcggtagtgtactgatttcaacctgctccgcaccgactccagcagccttccatgcttccaacaccgtgccgcgccaatcgcctggttccttggccgacgcgaaccacgtgaccaccgattccgcgatctccggaccgatgccgtctatctgtgacagttcgtccacactggcgcgttcgatggcgtcaagcgatccgaacgtattggcgataacacgtgccgtaggaggaccaagtcgcctgatggacagggccacaagcacacgccataagtcggcgtgacgtgccttgtcaatttcgtcaagcattttccttgtgttttccgcggggcgtatatataccggctgcacgctggatgctccggaacgcgacaccttggtttcctctcggaccaccatagcatcctcaggcacatcatatccgggatattccgcggatccatcgacttcgtccttacgctttctcgccactgtcggagtcgtccaaaacgccggaacctgatgccacaggcctgatccgccgatacgtttgcgcgtttttttcggtttaccgttcttgccgacggtttcatgaatttcgatgattggcgcttctcgccatacgcgaacatcctgcaaatcggaggatgtcagcgagaacaggccggcctcgctggacaacaccggcgtttgccgggccggcagctccagcccttccaccggctcgtacggttctggctcctgccccggtgccaccacgatttccgtgatgtccggcgcgtaggtcgccaccgaatcagggcgatcctcttctggattcgtcaacgcgatggccgattggtcacccagatgttcgatatcgaacgcctttctggacgccaggttgatgatgcgttcggttaactgcgccgggcaggactccacgttcgggcagcggatgtccttgtccccctctttggctggagcgagttgtgccccacagctcgggcactgcgaaggcatcacgaaacggcgcagctggtcttcgtgcccttccctacgctccaacactggacctacaagttcgggaatcacatcgcctgccttgcgtaccacaacggtgtcgccgataagcacgcctttacgttccacctcgaacggattgtgcaaagtggttctcgacaccgttgaacccgcaacatatacgggcttcagaatagccaccggtgtcacgcggccggtacgccccacttgcacggtgatgtcaagcaactccgtgttgacttcctccggcggatacttgtaggcgatggcccaacgtggcgcacgcgaggtcgcgcccagcgaccgctgcaaccccagatcgtccactttcacgacgatgccgtcgagcgcatgctcgatgtcaccgcgatgctcgccgtaataatcgatcatgtcgagaatctggctgaatgtggtgacctcacggttatgtggcgaaacgggtatgccccacttcttatacaacccatacgcttcggattggttgttgaccgcatcatggtcggcaccacgtttggcgccccactggagcgttccaatgccatgcgcatagaagctcagccttctggtggcggtgatgcgcggatccttctgccgcaggcttccggcagccgcgttacgtggattggcgaaaggcgcgcgcccagcatcctcgttttctttgttgagcgtgttgaaatcgtcccatcgcatgaagacctcaccgcggatctccacgaattcgggaatgtcttcttccggtcccgcaagattctgcggaatggtggagatggtgcgcacattgagcgtgatatcctcgccgatcacgccgtcacctctggtcagaccttgctcgagcacgccgttacggtagatgaggttaagcgcaagaccgtcgattttcacttcgcatgtcatcggcaaaggcttcgtctcaggccaatcaagtccccgaataacaccgtcgtaccattcatgcagttcctcaagcgaaaagacatcgtcaagactcatcatgcgagacgggtggcgtaccgatgcgaaatcattggagaaggtgcctccgacacgatgcgtcggcgattgcgcggaatcgagggatgggaactgggcttccaacgcctgcagacaacgtattctcgcatcataggcggcatcggacgagaccggcgcgtcatcgatgtagtatgcgatctggtcggattccacccacgccgccacacgcgcccacaatcgagccgcggcttcagcactgatggacgagacatcaagtcgggtcaaccgcatggcgtcggcatcggttggctgcaatgcggcgatccagcgttcactgcccggcgcatatgagctgactcccccgtcgggaaccacagcggttgacgcggagcccgtatcgccgcccatttcagaagcgtcaaaatcccatgcgagttgttcggaatcgtcatgccttgtcattgtcattgccttgtcactgtcttcaatgttttgccggtcagagccgccatgcacacattatcgcacaaatgttcgatttactgcatcgccaacgtctgtttggcgcactgcggaaagcacgccgttcagttgttcaacgacctcaggaactgcatctgcaccacgtcggcaccgtcgcgctcctcgtcatccatccttgaagcggcaaccgaaagcgtacgtgccggcacgaacatgccttcatccacacagacccgcgcggccttgcgtaccaaggatgcgacctgggtattgggccataccggcagtcccgcttgggtaagcacgtgcatggcttccggaacgtcggtgggcaccggaatgcattgcgattgcgcgcgtccgatcaattcctgcagctcgctctccagcatggcgattcgcccgggggcaatctcctcgctcatgatgtacgcggcggccgcgatgtcgaagtggtcgcacatccattccgcataggcgagtctgtaataggcgaacgacgcatcctcacggtcaagtgcgacgtgcaacgcgttgaggcaagccgctctggccggatcccaatcctcggcgcgcgccagttgaaccgccagcttgagatgggaaagcgggtaggccggcgcatatcgcaccatcgcattgagatgcggcaacgcggccttcacgcctttgacctgtgcaagcacgtcggcgagttccatatgcgcgtagaacagattgtccggaatcagcacggtccgttcgccttccgtggcgaacatgcgattgtagatgacgcgttccgcatacgagttgaaataccgcggcacgcccggattcgaagcgaacagtcggtccattcgctccaacgccgcttcggccagttccacgctttggtcgacctgtcctgagaacagcaggtctctcgccttgatgcgttccgcgtcaagctcgtcggccaagcggaaggagaagtccggagtgtctttgccatcgatgagcgcactcgtcacctgcggagccaacgacgtcaattccgggtcggcaatggtgttgatgacgtccatggcctgctttgccttggccaccgattccagatgggagtcctgcgcgattctgtggaattcgccaaccgcgcgctgcagcaggtcgacgcgctgaatggacaaccccgacatgtcacggcagccgaacagctgtgccgtgtcatggtcgaatatggcgtcggaaagctcaggctcctcctgacttccggatggggagaaacgactatcgcgcaaatcgaacgtggcgtccactggcttcaatgcgccgaggccgtccacatccatttccgcatcgaacatacggtatgtgcctgttggatcagacaatccgcactcgcccagacgctccatgaattcgcttctggtgaaggtgaccgtcaccagattgcgtacggtcggattcttgcgaagctggcttaatggatcatcaccattcccatcgaaatcgccgaagccgatcagtcccgcgtcaagagcgccatcatgcacgccctgtgcggaaccgtcgtccatgctagaggaatcgtccgcaatctcgtcgggaaccgcgaacgtcacttcgtcgaagtcgatatcccgcatcagatcctcgaattggctgttcaacgcatcatccgtatcctcggagttgacgccatcaacgcccatgtcggcggatctcggcgccaccggacgggacgggtctccgtggaaatcgccgtccttcggatcggccttggacccagaaacacccatatctccagtacgaatgcgttcgaaagccgccaaagcctcgctcatcagctcgctgatggcggaatcctgctcggccacggcctcttccaaaccaatcgaatcgatatgcatcgacacacgctgtatgcccggatcggcgccaaaactcaacgcggccatcatcagtccaacacgcagattgtagtccgcgctcatgcgggcgcgttcggcgtccgtcatatccacccatgcgtggcgggacacgtcatatttggtggatggcatcatggaaacgccggcagaggtgaaaccgatggccatattgccgtctcggagactgcatcggaagtccacgtcgaagcggtatggcaggcgcatgctgcgcaatagtctcgacattgtctggcggtatacccattccgaaccgccttcggctccgaaggcggtaccatcctcgccgtccttcgtgttttcggcgatggaacgtctggtttccgcggcgatgtccaccaggcgcatgacggcttggacgccgtcatcctgctgtgagtcgaggatcgcgccgaattcgtcgtccggtttcaatgcgatcagcgccggattttccagtagcgccatgtcgatttgcgcggcttccgcgcgggttacggtgtcttctgtgggcagcttgccgatacgggcgttgcgttccagccatgaactgactgcggcgaaacggttgaggttgccttcgatgttcagcgcgcgcagcgatgccgagaacggcagtgtggaatcccaagcgaagaaatagcagcccgagtagctggacgtgtataggtgcaatggttccgcgccgtgtactgcttcgagcccttggtctttgtcaagggcgcctgcctcgcgcatgaggtcggcgaaataatcctcaagtccggatgcgcgcatgccatgggagcgtgcgctcatcgtgtctctgatggatcggcggatcgcgcccatcggcgcctctcggttgagcctgcggaagatgttgcccgtgccgaatcccacgagtagcccgttcatttgcggcagcatgtaggctgcgaagaatgcgatggtgatggcatccctgtattccagatcgaatcgcatggtttccggcaggttggcacgcatctgttcgagcgtgtagcggttgccgactttcagccaggatgcgagccacatcatgcggccatcgggcatgcgtcccacgacaccgccttgcgacgcgcgcaccatcttcggcgcgccgtttgtcgcgtgtccgaatcgtggaccgtctggcagggtgagggtttcttctttgacgaatatgaatcgtggttccagatcctgcacgtccatttcgggattggtgcccgcgaagacgcgtgctttgctgtcggcgagcgcgatttgcgcgaagtggttgttgtcggtgaatagtccgatggagaaggctttgccttgggtttgtggcagttgcgcccagccgagttggagtgtgcttggtatgccttcgaagcctttgatgatgtgtcgtttgatgagtgggttgagtttgatggcgttgcgggtgagttcatcgacgatgtcgtctggcgtgtcgagggctttgccgaaggggttggcgtcggcggtgttgtgggggtgtttgttgtggttgatgagttgtcgtaccccttgcatggcgtggttgagcatggtccgtccttggtgtggatggtgtgctgatggcgatgctggtgtgaggtgtgacatgtgggccattctttcaattcaatgcgacatgcagcctttagaataaagttcgtgactttttcgaaacagcgttttcaggcgcgtcatcgtgtgtgcgcagctattgtagccgcttttgttgtggtggtgttggttgagtgcgtgttgtgtaatgtgccgtttttccgctcgttggcggcgtcgggtgattcggcggctgcgtataacacgttggggccggggcttgagcgtcgtgatgacgggttgttggaggttactgatccgacgcaggcgtatttgcaggtggctgcggatggttcgtctgagtatgtgcggatcgtgccggtgtccgatgaggttatgggtggtgtgcctgccggttcgcgcgtgttgcgtacggtgcgtgttcgtgcggatgcggatcgtgtggctggttcgttgtgttcggtgtcgttggattcgtctcgttcgttgtatgtgagggctgcggccggtcgtacggtgcgcgtgcaggtggtggagccgaaggggtcattgattccgtttgatgcggttcgcgcgaatgtgcgtgtgccgttttcggtgagtccgttgcgtgtggcgttgttggtgttggtgatggtgttggtggcgttgtggcgtccgggctcgcgcctgtggaaggtgccgttgaatacgtcgagtgtgcgtcagcgtgtgacgttgggcgtgttgttgacggttcctgggttggtgactgttgcggcggtggcgtggcagttggtgtctgcggtgccgttgagttttcatacggatggcatgtatacgtatgattacgatcagtatgatcatgtggctcgggcgttgcttaatggtcatgcgtggcttgatttggatgtgcccgacgcgttgcgcgatgcggataatccgtatgatgtgacgactcgtcagcaattgcttgccgatggtgtgagtccggtgtattgggattatgcgttttttgatggtcgttggtattcgtattttggcgtggtgccggcgttgctgttgtttgtgccgtatcgtgcgataacgtcgttgtgggttgatggtggtctgatgatgccgtctggcgctgcggtgccgctgctgatgtttgtttttttggtgttcgcgtgcctgttgacgattcgcgtgatcgagcgtgtgcgtccgcatgtttcgctggctgcggtcagtatgttgtgcgtgtttgtggttttggcgtcgaacgccccgtacttgtggtatcggacgaatttttattcggtgccgattgcggcgtccttgttgttgagcacgttgggcttatggctatggatgggtgcggcgcacccgaacgcggccgatgccggtggcgatggtggtgcgaatacggtcgaatcgttgtcgctgcctcgtttggctgccggttcggtgtgtattgccgcgaatgtgggttgccgtccgtcgtttgtggtggtggcgttcgccgcgtttccgttgttctggccgcagattcgtgcgattgccaaacagttgcgtgatggcgtgttcgcttctggcgcgcatgggcgcgtctgcgccatgttgcatgcgttgcgtgcgcctttggccgtgctggtgcccgcattggttgtggtggtgccgttgttcgcctataacatggtgcgtttctcctcgccattcgatttcggttcgtcatatcagataacggtcacggatatgacgagctaccatcagtcgtggtcgaatttcatttggacggtcgcatactatctgtttttgccgttgcgctggacgaatatgttcccgttccttgccgtcgaccccaccccattgaaagattgggggttcacggaggcgatgcctggaggcctgttcgtcatggcgcctctcgcattggcttcgctggcatgcccattcctacgccggcatatgcgcgctcgtggtcatgtcggtatgtggcgtacactgacgacgttcctgctgttaagtttgctgattgtggcgcttgacgcgcgcttgggtggtcttgggtggcgctacatcgccgatttcggttggctgttcgccttggcttcgttgcctctgctgctcattgcgttggattgcgaccgtccgcggctgtgctggctgttgcgcgtactggtgttggcgctgctgctgttcatgttggcggtgacggtgttgtcgttgttcctatatggtcgcgacgacgagctgatacgcaataattccggtttgttccatgacgtgcagtcgtggttcaccctgatatgaggcacggcgttttcagggttatttcagggttttattacggtttgtccaataaaatctccggtttgttccgagttttgcgaataatagtggtgtcgtaactgttcgatatgagatgaacccttgttggagacatcagttatgaaatcgcttccacttctgtctaaccatcctcgtgttaaacgctggaccgcggccgtggtagcatcggccatcgcattgggcgtctgtctcgccagctatgacaacgtcgatgcggccatcagacaaaacaggatcgaacggctgaacgcacgtatcgagaatgtgtacacagccgactatcagaatatggccgacgacaagctcgagcaggaaaaaagcaagtctgccgccacggaagatgacatgttcgtcaccgaggatccgtacggcaccaacaccacgtcgctgtatgtgtatttcaccaccgacgactcggtatccgtatcctataccgtgcatgcggacggctacgcggatttcacccgtgacgcctaccagcaatcgcaatacagcaaaacccatgaattccagatactcggccttattcccggggaaaagaacaccatcaccatcacgttgaccaacgccgatggcaaatcccgtacgcataccttcgaacacaggggtgcttccctgcttggcaatgaggaagtgcaactggagcagaccgtcgtagctgattccggagaagacttgggcgatggcctgtatgccatactcggcaacgattccgacgagcaggacttcatgttctattatgatacgaacggcgtgctgcgcggtgagattcccgtgctctactatcgttcgcatcgtctgctgttcgacgatgacgggctcatgtggttctccgcttccacacaccacatggcagcgatgaaccgtctcggcaagttggagaagatctatgatcttggatccgactatattctgcaccacgattacgcgatggacgccaatggagacatcgtgctgttggccaccgaaatgggccgcgacgacaatgccgtgcaagatcaggtcatcaagctcaacacttccaccggcagtgtgacccgcttggtggatttcggcgaactgttcgccgactataaggcctccaccacgcatgcaggaaccgacgagtcggattcgagcgcccagaatcgttgggattggctgcattgcaacaccatccaactgttggatgatggttccgcgttattctccgcacgcgaaacgtccaccatcatcaaagtggatgatctggaatcagatccgacggtcgactacatgatcggcgagccgtccgtgtgggcaggcaccgatgaggtcagcagtttcctagcgaaagacggagatttttccgataccggcggacagcattccatcacatacgtcgccgatgattcgttgcctgacggccagtattacctgtacatgttcgacaataatttcggcacttcgttgacgcgtcctgattttgactggtcggtgatcgacggaatctcgatcgaactgtcttccgacacggcaaattcgcggtatcgcaagtatctggtcaacgagaatgccggcacgtatacggaagtgtcatcgttcgacgtgccatattcgccgtatgtcagttccgcgcaggaattggataatggccagatcctcatcgactcgggcatgaagggtctgttcggccagtacaacaaggatggtgatctgctggcgcagttcaagatgacgttgaacagtgcgtacatctaccgcgtgtacaagtacgatttctcgggattctatttcgcctgacatcctgtccgcaggcttgacggggccgggaatccaaactcccacaaggagtttggatttccggccccgtttcgtatgcaatgggttcggcacgcccgtacaatggttgccatgggttttttcgattcgctgttttcatccaaacgtcccgaagcgacgcatgacgtcacgttcacgctagatcaggcaggccacacgtatgaggatggcaatgtcggtctggagccgacatcgttgacgatcactccggaaagcaaacgtgtggctgtgatcgggttgaatggttccggtaagaccacgttgctgcagctgttggatggcgcattgtctgcgacgtccggttcggtgcgtatcgacgcgaatggtgctgcgtatgatccgtcggtgaaacgtgatctgaaacgtatcgaatcgatgatcggccgcgttcgtcgcgaggaaattccgaacagttattacaaagcggattccattcgcgaggcgattgatgaaccgttgaagaagcataaggtgccggaaagcgaacgccaggcgatcatcggcaatctgttcgcgcatttcgatctggcggcggtcgcacgtgagcccgcctccgcattggatagcgagaaacgtcatctgctggcgatcgcttccgcattgagcttctcccccgcggtgatcgttgccgacgagccgaccaagggtttggacgaggtggcgtccgcgcatgtggcgaaagctctgttcagttacgacaaacaggtagtgttcgccacgcatgacacggagctgatcacacgcgcggaatatgcgatcgaccgcacgctggtggtcgacgatcatcaggtggtgttcgacggtggcccgcatgaggccgtggccttttacacggacctcatccgcgctaaatatgaggcttccaaagcctgaccatacccacggattattcccgttccccacatgttgcggctccttcatcggtgtcgacgatggaaccacaacatgtttcagccgatcattgtgttgacggtgtcaagcaccgtctgaacgttatgcctgaattcgtcgggttccggcaataacgagatcgcgagatagccgttcgacgtcatatcgaagaaatagccgggctgtcctgaaattccgtgcttttcgatcatggacaacaccagttcgttctcgtcaagcacgctgggcacgcgcaaaagcacattccatccgccttcggcacgcaacacgctgaccatgccctgctcgtcatcatccagcatggtatgcaaggctgcgaggttggtttgcacgcgctctcgcacgcgcgcggtctgcgcggctgcggcgcccagcatggcggggatctgtttggcgatgatctcactcattggcagatagtcgtcggcgaccacgtcgagtctgcgcttggcctcatccacttcagccgccgggccggacacttggatccaacccactttggcatgtggcgcggccaacgtcttcgagaacccatccaatgcgaatgtgagcgtgccggtctcccccgcgagacgcgcgttgccatcgaatggttcaagatcatagtcgtagaacacctcatcggcgatgatggccacctcatggtcatgacaaagccgcacaatggcctcacgttccgacgctttgacgtacgatccggtcggattgttgggattgatgagcaccagcgcgcggatgcggccgccatcttcaccttcaagcgcttcgcgtagttcggccacgtcgatgtaccaggatccgtcgaaacgttgctggtactcgatcatgtcgacgcattcgagtcgtgcgatcgattcgatgagcggatatcccggcttcggtgcgagcacagcgtcacctgcattgcagagcagtttgatcagccatgagtacgcttcggacgtcgagctcaatatgtataggtcgtcggcggtagcggtattgccttgttcatgcaggaatgcggccagcgcttcgcgtgcgtatcgttgcccgcgtggctccgctccgtagatgtccggcaatagttccgacgcgagcgcatgtttggttggattggagtcgttgagtttgccgagtgtgatgccgtttgctttggcttccgcttcggctttggcgatgggattgggctcgctgatatcgactctggaggaaaaacgcatggtctccaccatactctctgggttgcgcaagtgttgcatcgagcaagaaggatgcattcgccatgcgatcatcagaggaataacaagagccgtccgacggatgaatcggacggctctcgcttatatgaaggttaggaacctttatggttcacgacatcacttctgcttgatgcttgcgtagtacgcagcaccgatgatgccagcctcattgtgcagcttggctgcgacgatcggggtcttgatgtcgatgtacggcaggaacttctcggacacgcgggacacgccaccgccgacgacgaacagctgcggatccaagtagaactccatcagggaataatacttggtcagacgcttggcccacttcttgtagcccatatcgagcttttcacgaatggaggatgccgcgtacttctcggcgtcacccttgcccttgagcagttccaaatggccgagctcagtgttcggaatgagctcgccgttgaagatcagcgcggtgccgatgccggtgcccagcgtggtggcgacgaccaggccgtcctggcccttggctgcgccgaactgctgttcggcaagaccggccgcatcagcgtcgttcaccacggtgaccggacggccgcaagcttcggagaacacttcggtgacgtccacgccaacccaagactggtccagattggccatatagccgagcttctcgccaacatgaatcggagcggggaatgcgatgccgaccggagcggactcaggaacctcaaaatgctcgagctgctggcgaacgatttcgccaacggccttcggagtggaaacctccggggtaaggatcttcagacgcggttcagcaaattcgcccttctcgaggttaaccggggctgccttaatgccggagccgccaatgtcaacgccaaatgcctgtgcagtttcaatcatcttcgacctctcctatcaaggtacatagtgggtatatcgaaccggtaaacgccatagtaactcgccccatgccccaaaacgcgccgacaatacacaattggtgaatacgattgcataatctgtcgcaatgaaacgcaaatatttgcgattgttttctgcaaacgattcgccccatgccaacgcaacgcatcggcatggggcgaatcataagaaaataaccgtctgaagacggtgtagccacattacttgagcggcggcatcggcttccaatccggatcatgcagcagcttgcgcgaatcccaccaacccttgacaatctgcaccaagccggtcttggcatgctcacggtccaccatcaccaagcgaatgacctccttggcggcggtcagcaacgtgccaaagccgaacatcagcggacggtaatcgccgaacgacatgaaatagcgtgccatgtagccacggttgcgcatgatgtggtagcggttcatgtcggaagtggagttgagctgacgcacgccggcgatatcccagttaccgatctcgcgcgtacgtcgcaggatcacgtcgggcaccacgatcggattggtgaccttgctggcgcgatagccgtacatcgtatcgtcccagtagatgaagaagcggggatccggcaaaccgatctgttccacgatattgcggcggaacaggccgccttcaaagcataaggtgtccatcacacgatagccgggacgcccgaacgcggccggagcgatcggattgggaatgccaagaggcacgatgaaatcgtactgccagtagaacgggcctccgtcgtagtcgtatcggcttccctggatcacatcatggctgccggtccacttggcgagcctttcgatggcctcaggcatcacggccacgtcgtcgtccatcacccagaaccactccgcacccagctcgtatgccttcttcacacctgcggagaagccgcctgcgccgccgaggttgtcggattgcggcgcgtacaccacacggctttcgttgcccgactggtcggcgatggtattgccccactgcgcggtgaccgcttcacggaaatcgtcgaccatgccttgggtcgcctcgctgtgctcgttgtccacgacgatgatacgccatggcgccacagtgagtttttcgatggattcgaacagggtggcgagcagctgctgacgcctgtacgtcaccacgacgatagccagcttttcgatggtgttcttcgcaacttgcttttcagtcatacgttccattcttgcactcgccctcaaccgaacatcgcctgtgttcgcatcatgcggcacgattccattcgacggacgggctcttgcacatttcgtgcggctttgccataatgtacggcgtaatgcaggggaacccgtgttcgtcgggttgagatgggccaagtgaggcctgaaccctttgaacctgatggttaacaccagcgtagggaggcatgtctagtgactgctgtgacatcaacaaccgatttcgattatgagttcgacgccgccaaaggcatccaacgcgacaatcttccgccgttcgcgcagcgcatgcgcaaggccgccgacctggtttgggaggaaggctaccagcagccgttcatccgcgagcttggcgaaggcacactgcaacgcgagcgtttcgccttctatctgctgcaggattttcgttatgtgaacgattacgccagagtgcacgctttgggattagccaaggccaccgaccctgaaatcatggcgttcatgctcaaggtgcagaacggcgccctgcaggtcgagaccgaagtacaccgctcctacttggccagctatggcatcaccgaagagcagatgaacaatgtgcgccagtcggccttcgcgcgtgcctacacgtcgaatatcctttccatcgcctatggcaaggatattctcgacattcttgtggccgtgctgccgtgcgcctgggtgtatgcggattatggttatcgtcttgccgccgagttcgcggacacgctcgacaacaatccgtacaagagctgggtcgacatgtataagaccgacgagttctggcaggattccgtgtggctgctcgatcatatcgagaaactggtggccgacgcgagcgaggagcgcaagcgcgagctgatcgacattttcgtgaccggcgtggagaacgaatacatgttctgggccagcgcgtacgacatgcagtacacatggaagcccgaatggaatcaggcgcgctgatagcactccttcatggggtttcctgacttccgattgtttattttcattgcagcaaggcgggtgtcttctgattggttttcagaaagcacccgccctgttatgtttggtcgcgtcagtttcccgctttattcgcgtacgaggcggatatgttccacgtcgtcgcgatgggagcggcggtagagcacgaaacggttgccgatgacctgcacgagttccgcgttcagttcttcagccaatccctcgcctgcttccttggcggtcagaccggatccgtcgagcacggagcacttgatgagctcacgcttttcgatggtttcgtccgcctgcttgatggcgttttcgctcagatcgttcttgccgacctggatgagcggattgagcttggtggccaggcctcgcagctgcttgacctgcttcttggttaatgccataacttgttccattcctatctatgatgcttgctcaagagtagcgtgaggacggtaaaatccgccgactgccttcagtttagtccagcgatcagaaccaacgcagccacatatgccacaaccacaccgcccgcggcaatgtctcgtttggcgatgctcatcacgcgccaatgtgtgcgtgcgataccctcttcatagcatcgcgcgtcgagtgcgagactgagattgtcggcatggcgtatcgcccctgcgaacaccggaatgatgatggaaaccatcgccttgatacgctgcacgaacgttcccgtttcgatgctgccacctcgagccgcctgtgcgtccgcaatggctttcgcctcgcttcccagagtgggcaggaaccgcagtgcgaggctcatcaccagtgcgatctcctgcgcgtgcacgcctatttttgcgaagggtttgagcaaggcttcgaacgcgtcggtgatggccgtaggcgtggtggtggcgaggaacaccactccgacgataatgaccgcaacgaatctgcaggcgtacagtatagcgatacgcacaccgtcgtcggtgattggaatcggtccgatgttcgtaagaacattgccggattgtacgaagaacacattgagcagtccgcagaacacgaacaatgcaaggaacatgtgaatcgatttgaacagttgtttcacgccgatgcctgatgtcgcaacgatcatgccggtcaacagtgcggccacgagcagctgccagaaagagcggatggcgaatgcggagaacatgaccgccaacgcgcccaccatcttcacgcgcgggtcaagccgttccataaaactgcggttttcacggacgtctccctttgcatgtccggagccaagcgtgtgcagattcttcgaacctgccgattcgacagcagaaccaggctcggcatcacgaacttttccaccaacgttccggtcagcgtcaagcgcgatcgtccggtcggcaagtacgtcgatttccgcttgcgaatgggaaatgatgagtatggtgatgccttgtgcgtggagggtttggatgagattgtgcacgcgggttgtggccgcttcatcaagtcccgcggtcggctcgtccataatgagaatccgcggttggcatgcgatgacgcccgctatggcaacgagtcgttgctgcccgccggaaaggtcgaatggcgaacggtcggcaagatgttcaatatgcagcaatgccatggcttggctgacatgttcatccacttgcgcttcatcaagccgttggttgcgcggaccgtaggcgacgtcctcggctacggtttcggcgaaaagctgacgttcgggatgttgcatgacgtagccgatggtggcgcgcagtttctcgcggtccgcacgcttgagcgactgcatattgccgttggcgcgttggcgtgcgacgggaatggtgttgacggtaatgctgccagattgcggctgttccagcgcgcagagaagacgcgcgagggtggttttgcctgcaccgttatgccctgtgatggccacggtttcaccctcattgatggttatggaaagcttatcgagcacaggcttgctactgtttggatattgatatatcagattatggatttcaatgattggtacagctgatgttggcttcgatgcgccatttgcaatattggatttggcaattgggttgtcttcttgcgctgtgcctgattcgtccatttccggaatacttgcagtattaccgcgagcgctttgcacgatacgcccgttatccaggcgaatgatgcggtcggcattgacgaattcgtcacgatggtgggtgacgagaatgatggttgtgccgtgctgctgcaattcgtcaagaatatgcatgatgtcggcgcggccttgcggatcgagcatggcggtaggctcgtcgagcacgaggatttcgggattcatggcaagcatgccggcgatggcgacgcgctgctgttggcctccgctcattcgcgtgggatcggcttctcgttgtccgctcatgtcgactgcgtcaagtgacatggcgatgcgcatatcgatatcatcatgcgcaatggcgaggttttccggaccgaaggcaacatcatcctcggtaatggtggtgacgatctgatcttccggatgttggaaaaccgccccgataccatgccgggcgctgcggtaagcgtcagcgtgcgcgccggagtcatcgaatacgttgtttcccaacaacgtgacatgtccggcatcgggtgcggcaagtcctgcgatgatgcgtgaaagtgtggatttgcccgatccgtttggtcctgccaagcatacacgttcgccttggcgaacggtcaggttcacgccgtcgagcgcccaggtcgcgccggagtcgtaggtgaaacgaatatcgtgcagttcgaccgcgatggtgttcgtggcgctgtcaggattcatggaaaaagtctttcataaacgaaaggaaccttccatacgtcgaaaggttccttcctattcatcaatatgcggaatcgatatggtgaacgaggctcagcggttcaacaggttggagatcggcttgtagatcaggaaggtgaccacgccatggatggtgaatttcaacgcgttgaacggcagaagcgccggcacgatcaatgccacgacctgtgcggtggtcatatgcgcgtagaacggtgtgacgattatattgcccacaatcgccatcgccaaggctgcgatcgcaccgacgatgatgccgatgaccgcgcctttgcgggtcttgttcctgcggtagatcagtgctgccggcacggataatgccaaagccacgagcacggccataagcgtgccccatgggttggtaaacaggtgcggcaggaaaccaagcacgctgacgattaccgccgccgctggcccgtaggcgaaacctgccaccaggctgacaatgccggatggatcatatttcagccattcaacgcctggcacaatgggaaattccacaaagctgacggccatcgacagcgccacgaacagcgcatacatggcgatgcgtttggtggaccagcgtccagagtcggccacgcctgtggaatgcgcgttgtcggggcgcgtcatgctttcgctggcgatttcggcgtcgttgttttgggtattgtttggtgaggatacactcatgttgagccccgtttcttccatccggactttgaccgttggctccggattctcaccggatcagccgctttcgcgggtcgcgggcttcggcatgggaccgttatgaacgtcagtcgtaccgttaccgccagtaaggattttcaccttccctgaaacttgcacgattatatatacgcctatcgtcggaaatatgcaaaccgcgtctcactggcgtctattatcagcaggcatcaatctttaatccggaaaccatgatcttagcctcatatgccttttgcctatggcatgaacgtcgcctcatggtgtgttgccgcagtgtgcgctttacctgttgctttcgtatcgtgtgcgttcaagcaagcggcaggtacgttgattgttatgccagcaggtcgagcaagtcgtctttgctgagtgtgccgacgcctccagatgcggtgccgtcggtgaactgttgggcaagctcgcttttcttctcctgcagtttgaggatgcgttcctcaatggtgtctttggctacgatctggtacacgttcacatcctgcgtctgtccgatgcggtgcgcacgatcggtggcctggttctgcgcggccgcgttccaccacgggtcggcgtgcaccactacggacgcacccacaaggttcagccccgtattgcccgctttgagcgagatgaggaacacgggaacatcgttgccattgaattcgtccaccagttccacacggcgtttcttcggtgtctcgccggtgatggtgtagaagtccacgccctgttcagccaaacgtgtaccaatcaggtcaaggaatgaagtgaactgcgagaatacgagcactttcttgctttcgtccatgcacgtggatacgagttcgcaaatagcgtcaagtttggcggaagcgtttttcgcatccgcatagacgagtctcggatcgcaacagatttcgcgcaacagtgtgaattccgcaaggattcgaatcttcttcgtattgaagtcggcgtccttggttttggtaagggtggcgcgcaaccgttgctcgtgcgccgcatagagtttgcgctgttcgccttccagtttgacggtgagcacgttttcgaacttgtcaggcaaatcggtcagcacgtcttttttcagacgtcgtttaatgaacagtccgaccaaagcctgcagtttgtcagccatgacggaatgttcagaaccgggtgccatgatcggctgttcgtatttttctcggaacttcgtgtaggttcccagcaatccgggcatgaggaagtcgaagatgctccacagttcgctcaaccggttttcgatgggggttcccgtcaatgcgaaccggtgttcggcggtgatctgtttgacggctttcgccaacttcgtggcatggtttttgatgtattgcgcctcatcgagcgccatcaatgcgaaccggcaggcggcgtaatcatccacgtcgcggcgcaataaatcgtatgaggtgatcaccacatcggtacgctgcatatcgttggattccgaggggttcttccattgctgtgccacggctgcgatgagcttgcgccgttgtgccttcgtgccggccacaacttcgatggtaagatcctgcgtgaacttctcgcattcggcagcccagttgtataccaaggatgccgggcagacaatcaacgctggaccgctccccttgcgagcttccaccagtgacagcaattgcacggatttgcccaaacccatttcgtcggcgagaatgccaccgaaacctttgtcccacaaggtggaaagccattggaagccttccacctggtatgggcgcagtacgtttttgaggttgcggggcacttcgtatcgtttcgggtcgatgattttcacatcgttgacatagtcgacgaacgattcgcttttgccgtcgtcatcaacttgagcatccaagaggaacgcccgatatccgggaatggtgattcttccggaatcaagctgttgctcatcaaggtcaagatctgtggcaatctgatcaagttcatgcagatcggcattcttcagatcaacgaacgtaccgtccttgaatcgatggtagcggcggttcctgcggtaggaattcagcaacgcgccgacctcgttcatcggcacttcgtcggctatcggcgaaatctcaaccagattcgagtcgatggacagtccgaccttcaccgtagggctgcctggcatcatcatgccgtcgaacgcggccgtggagaacacctgcccgaccgaacgcaagatatccacgccttcggtgagcaagagcagaatagtctgttcgtcttcctcacgaatccgcgccacgtcaatggaactccatgtcgggaaaagctggcgaaccacctgcaccgcgaatgattcgcgggccgtatctcgtttgatgagcgccgctttcgaccgcgagtccggattaatcacgcctcgtagcgctttggcggtcggcaccaactggaacacgaaatcgccgtatcgtgccacagcctcgcaggtgatgccctgcagatcacggtccaagtagaattcgatctggcagtcgactcccatccgttcggcgacttcctgcggaatatcgaaaccaatgcccgcttcggtaagttttggcagtattgttcgtgcgaacatgggccagtcgttttccgcaatgaacacaccatcgctaacgttcgacgcgcacaatgtcatcaacgcgtccactgcgggaaggatgctgtcggtacaacggaagagtccgctcactggcatcatatgggaatccgtcggagtgccgttatgctcggcactcatgaggtacacgccccgctgcccaacaatccgatccgtgatggtacggttcgacgtgatacgcacgcccgacgaagcgccttccttcacatattcggcgatgaaccgaaattgcggattgccatcgaatatggcgatagtatgcgacctggactcccctggcgtggccacttcgacatagcccggagcggcgtcatccgtatgggcgaaatcatccggagtgagctgccgcgccctctcacgcccctcatgcttgggagcttccagcggcccacgtgctatcagcacgtcttcgatgtagtcctgttgcggttccgcttcgaacaggttcagtagatcgcacaattccccatcggtgagcatgatttcacgttcgatacgcacgtctggcgcgtaatagtagttgttctgcagttgcgctgcggcacgtgatccaacaacaccttgcaggaatcggaacagctgcagcgagaacggttcgagcatgtccggagtgtgggtgaacgagagtttctgtccgtatgacacgtatgccccgttgtgcatgtcggctacgaatttggaaatgcttttgatgatataacttgcgtcgccgcagccgattttcaacgtcaggctccacagctcacggttcatgatcagcgtgggctccagacgcacgcttcccggtttcactatgatggaaccgctcttgcgttttgttttcgtggccccttgcgtaatgacgcctcgttgctcgtcggcgagacggcttttcgcgtcgacgatgcgcttgagcacgtcaagctgcgcgctttgaccggtattgtcattcttcgcatccagcgcacgcatgtagtcggataggatatgcgaggtcacgccacttcgcttgaatccgcggaaccgttcgggctggtcaagaaacagcagcagcattgcggcgacatgcttgcacatgcccgtatagcggcgccccccagccggatccgaatcgaactcgtcatcgtcctgcacatgaccgaacgtcgatcctgaaccgaaatcatcataatcatcgacataatcgtattcatcgtcatcatcatcgaaactgcgatattttggattgttgcggtagctgggcgaatatgccgacgaatacgtgccataaccgtgctgcgaaccgttgaacgcggggcaggagcagtagcgcgctaagaacagttcgtcggagagatcgagcgtggcctgcacttcgtatcggctggacggtgaggtggtgccccgcatattggcatgcagggtgatgcggtcggaatcggagtcgttcaggcaatgcagatccgacattttcgcacgccactggttggcgattccacgggcacgctgcaatacaggctgactgcattcgctgcgtagttcgtcggaaagccatgacaaagtatccgccaactgaaccccaatcgttcgcacatttgttcttatgaaagagtatcagcacagcggaacaggaaagccgtggctgcaatcccagccacggcttcgctccataccggttatatcagcggcaacgcttggtgagcggctgccatggatcgagttccaccggttcggattccagcagcggcccgatctacgctggttggtaatggagccctgcttcagtcctatggagaagtcgcgcggcagcgagcgctgacccttgtaatcggtggcggcttcgagcacgcccacagataccgtcgcgttgaccgtggaaccgaccgataataccggtgcagtcacgagaaccgctatagcctgcgcagctgcgcgatatcatcgcgcagctggttgacggtgtccgtcagttcccgcacattgtggcgcaactgttccgtttccgattccgcctcatccgcacgcttgtcggtctcgtcacgaacacggtcgacaatccatgaagccagcgtcgcggtgacgatgccgatcagggcaacgccggttatcatcagtccgatggcgatgcatcttccctgccatgtcaccggggacaaatcgccatagccgactgtggtgacggtcacgaacgaccaccatatcgcttcaccgaaatcggtgatggaagcgcccggaaccccacgttccacatccaattcggcaagggcgccgatatacatcagtagtgtcacgctgcagcatgtgtacagtgtgatgcgcccacgcaccgccatgccaccggtacgattgagcacgttgagcactgccaccagacgcagcagtctcaacggcctgaagacgggcaatgcgatggacaccagcatcagcagattgtctttgaaccaagttttcttatcttctgccagcaggatcgaaacgacgcagtcggcgatgaacaccatccagatgatgttgatcaccatttcacacaacaggatatgcgtcctcgccagaacttcccacgaatacgcgaacaggaacaccaacgccaatgccgtcatgaaccattccgtcgcacgacgccatttgttcaatgtcataccctttcctttcttcccgactgccatcatacgggtctccccgcacgcgcgaccgtcagcttttgatgggcatgcgattgtcgagcgactgaccgttggcgtagcagcggacgttgcctaatgcaatggagatgatactgcgttcggtgatctcaagatggttgcctcccgccacatgtggggtgatgaggcatttcggctcgcaccacagcggcgagttggccggcagcggttccggttcggtcacatcgagcgcggcaccacggattcgtccttccgcgagcgcgtcggcaagcgcctgactttcaatggcgttgccgcggcccgcgttgatgatgatggcgtcaggtttgagagatgcgatgcgttccgcattgagcaggtggtacgttgtcgaagtggatggtacgcacatggcgatcacatcggcgtattgcagcacgtcgtcgagggactcgaatcctacgatatggtcgacgcccggcgcttcgacggcgggattacggcgaatgccaatggttgtcattccgacgtttttgcagagtcgtgcgaagtgtgatccgatgtcgccggttccgatgacgagcgccgtttttccgttggggctgacggcgcggcccgcgtcttgccacatggcattcgggttgcttgccgcatagatgtgcaggttcttcatgatggcccacatcatggcgaacatgtgttcggagacgctttgtccgtaggctccggtggcattggtgagcatggatccgggctgcaggatgccgggtcgctggtatttgtcgacgccggcgctccaagtttgaagccattcgagtttggggcactgcgcgcattcctcgggcgcgatgttgccgatgaccgcggtggctttggctttgagctcctccggtactgcggcggtccagctcatgcttccccgttgggtcgaatcgccgacgaattcctgtggtatgtctttcgcagcacgtatgaattgcgcacgttcggattcggtcaacggcaggcagttgacgatcaatttgcggtcgttccatattcccatgcgttttaccctatgacaatcgtcggatatagggtttcacgttgggttctgggtcagacgccgagttcgtcggtatcaaagatgatggtggccggaccgtcgttggcgagccgcacgcgcatgtgggagccgaatcgtccttcttttacttcgagtccttgcacgcgcagggcgtcgttgaatccgtgccatgtctgttcggcgtgcgcgggcgctccggctttcacgaagcttgggcggttgcctttgcgcacgttcgcgtatagcgtgaattgggagatggacagcacactgccgttcacgtcgtggatggaacggttcattttgccgttctcgtcttcgaagacgcgcaggttggcgattttgcgggcaagccagtcgatttgtttcgctccgtccgtgtcttccactccggcaagcagcacatagccgatgcctatatgctgtggttcgaatgtggtgtcgacttctccgcttgtctcgtcgaccacgtcgacggatccttcgccgaccttctgcaatacgatgcgcatagtccgtcccggtcttttcagccggcgtagtcgacgatggcctgcgtgacctgtttcaggtagtcgagcgacgtctgccaatcgtccggcacttcgatggaatggttggcaccagcgtacgtgcgcacatggtcggtgagcagatgcgctttggcgtcatcgtagtatgggtcggcgtcacctgcgcagattagcggcatcgggctgccggcagttcccggtagcggcgcgggaatgaccgacttgtgcttgtcgaatggcggcgggttgagcaccggggtgagcagcaccacacgtaatcctagttttgcggaatgcggatatgagagtgtggagagcgatttggtgacgaccagcaaatgcggctcctcacccgattcggcagcatgttcgagcgccgccttgcgccattcgtcgaccacgcgttccatgcaggcgatcatttccggaaactcgacgctttccgtcagtttcaggtcgagccggtccacgaaccatccgttggccgcaagcgcctgcgctgcccagtacagcagcggtcggtctacggtgtatccaatgcccggcatgatgagcacgtgattgccggtttcggtgttcttcacacggttcttaccccatggggtgaccgccggtgtgacgtttttcgttgttggttgcgtgccgttcttgcccatgctgtgtttgattcgccttttcgtgtgttccgtccgtcttggccggtcgttgcggccggcgtcgtttcccatattgcatgctaggcggcgccggctacaatcgtttccgtcagttcaccacgcattggttgccgaactacggaccgacctattacgccgctttcgtgcacgatccggaaggcaacaacatcgaggccatgctcgtctgagtgtccgacagctcaacagcgacaagaccagatcccgccatacgttaatgttctcatggcgggacctgtcatattcccagagaatcaaacatctcagcagccgtatggaaacacgggccgttctccgctgaatattcatggacttcccgcaaggcagaaaacgtatcagtaggaacggcgctctgttgaggaaagtctaataaaagtcggaactcgtacgtgcctggattggaacacatatgattttcccctttagccctggttacttgaacaggtcgaacagactgaacgtggtcttcttgtagacggtgttgtacagtttgcgcttggggtacagccagcccatgcccttcttaccatagccggggatcagcgcacgcttgaccgcacgagtggcgcggcccttcgtacgcgcggacaggctcttcttccaactgggtttcctcattccatacttcatgacagcctcttttcggacggttatgtatcgctcaacattgcatacgcatcggctggataaactcaaagatgaacatagatgaacatcaagtacagtcaagcaattacttactggcagcttctttgagagcggcctgcagttcaggatcaacggcgaataaatacaatccatgcacaccgcgtttgagcagaacattcagctcattacgcagattggattgcgcgtaactgattgagccgttcctcttactcactgcacgtttattacaacttgccttttcgttaaaaacgattttcccttcgcgataggtaaccgacggtccaatgatgacacctacataattaagatcaaacccctgaatagagaacgttgatcccacttcattaagcgtatgcggactttccgcccagacagcatctagggaaagacccttatcccctaccttgatttcgtaattccatggatgacagaaataatcagctcttccatcaggattaaacgcatcgtatcctctcggcattccctgagccgctcccatgcgccatactccctgtgcatcgcgatgcaactcaacattccagagaccatcgggacttgaatcgttaattttgccgcccttatactcccaatcatacgtagcaaccacacgagaaagcccgcatccgtcaacgcctgaagcctttagatatgccttctcctttatggctttaaacagttcaaccggcgaatcgaatactctgatttcaaatggctcgcggacatattcgcctgtttctctattcttctccccaatgtcttgaggaatacgacctattctcttaccatcagcgaaatcatcaatccatcgaatcgtcgcatcatccgcagcaatgcgaaattgcctatgcaagcatatgcgacttagcaaatagtgatcaccccacatattcaatggcacaaatcgctccaactgcccgctatagccagcagcagtttttgcacgtcgctttctgcttgctgcggaaagagcatgtcctgatcctcttcgctccaacgctgcgaagtttgcaaaatctgattcgggtcgaataccgcaataaccactttcgcacgacgcaataaatcgtgcagcatgttcttgcctgagtatccttggtcaccctgcgtcaacagcagatgagcttcatcaacaagcactacatcggctttgcctcggggcttgtccgcaatagctcgattacttgctgttttctcactaaatcgattgatgaatcgacttggtttaagagccacctcgccaaaatgtttctgcaaacctaatttgcttgcaatttggttatagacgtgcatttgctggttatggttgacaagaatatatgcttttctgcgatcttccttactgatttttggcgatgaatcggttcccagaatatcttcatcatcttcgtcattgatgcgcccattgatgtccatttctgttgctatgcgataaaacaggtgacttagcaaaaccgtctttccagtacccgcaacgccttgcacgaaaatcagtctcgataaaccggaatcggctgaattaccagagccggcaagagcttcagaaagcgcgtccataatcgattcctccgcagctatctgatcatcactcaattggtgaaaaggcgatgctttaaaaagtgcagaatcgcgaataatctcctcagccggaaatagttccggatcctgtcggttcagttccagccagatgtccgagaaaatctggctgaattcatcctgcgtatagtagtcgccttgcgcgttggcgcgacgattgttcaaattcttgactgcatcagagccaagaagataatgcatcagccggttctccacgtccaaagtcagagatttgttgaaatgcggattgccaatgacatactgtcacacagaacgagcgtcgctctgcaaattttcttgaaattccttccaatcaactctcgttttgggatcttccctcagatgatgcattgttcgactacgaatattattcgtctctcccacatacaccgtatattcgggacgtaaagtatgctgattcctcttctttgaatgaaccacatacaccgttggataatcgaaaatatagtgcaaagtctcacgctcaacagcagataatgtctcgtatcctaattgctcgacaaaggctttctctatttctgctttgtcatcaatgctctgatacggcaaatctataatgattgactttggaagcgcgctcttcgtcatatgctcattatgcacccgagagaggccttcagaaaagattcgacatacacttacgtattatgatttccgattcaagcatcaacgcgatccgtaaattcgtagcagagcgggactggtctcaattccacactcccggcaatcttgccaaatctatcagcattgaggccgcagaacttctggaatgttttcaatggaacgacgagccacaagacagcaatatcgaacatattcatgaggaaatagcagatgtactcatatattgcatcatgctatctgacaaattgggatttgaccttgacgagataatcctcgataagcttgcgaagaatgctcagagatatccggctgaatttgcctacggcaatagtaataaagccaattgacgctgtatatacgttcgtaggtaacacctgaatagttgcacgctgcccaatctgcattcactatgagccacgttttcttcgcgagcgcgacgggggttccaacagatagaacctgcatccaggttagtaatccgtcagaatgcgttcgcgcattctcgcgtactttcacgcattctcgcgtaccaacatcttgattacatattctgttcatgtacggcatgctcacttacccaagtgatatacaatgccggattcgccaccctgcgaagattacgtgagcagctgcagcaacccggcaaccatcttcgcctgaaaatcagtagtgcattgagacgtctcgcgaggcgcttggcgcgttcttcgctgtcgaagaacttcggcacacgcttcgccacttccaaccgctcgttccgggggcgacagaggtttccggcagcgtttccttaagagccacggcatacgcagtagtcacccattccctctttcagagctcatcgaaaatcagttcctaaaaactttcagatgttgggtgttcctctgcaatagcgtcatcaaaattcgaatcgcctcatgatcgcgtcaccaagacccgaatcgcgtcataatcccgtcacaatcccgtcgtcgaaaactgtctctgagccattacgatagatattgatgcacagatccgtatcgcagccaaggaattttgattccggcaatccggcatcacataccttctgcatcacacgcaggatactgcccccatgctcgatatacccatgtactcaaaagcagaggccaaggcatcgttacgtatatttcaaatagccccgcttcatgcgttcaatggtctacccatcggcaagcgctctgacaaggtgatttcaagccgattgtcataaatctcaatctgaatgctcgaatagttgtagctgcaatgcacttgcgttgacaatcagctcgcaaatggcatccgacggaatctcatatatgtcctgccagtgcacacccttgagccagacacccatatgaatgtcgcacagcacatactggtaggactcttcgataagctcctgcctaggcgggtaatcacaaatgtaatagggactccataatctcgtgcaaataagcgaaatcatcatcaatgtcacggtgctcatcggcagcttcaacgcctgcgatgaaatcagtcacgctatcccccattcgtgctcacaaggatgattcacgcataggaaaaacccgaacgaatccggtctcttcataagaatatccgccaaagaaggactaggcaggaaggagaccaccgtgtcggaatttttatcgaacaggtgggcttcaaccatggccttgaacagattggatcggagtttccttgccgttccctcgcttatggtttccagctcgggatgccatgtagccttgttcgcaatgaaccgatcataatcctcaaagtccagatgcgtattgccggtaagataatgctttttaagtacttcattgcgtaatatcggcacatcgcgatccacataagtgcctcgcggtcggatgtggaggaatccgggcctgccaaatatgcaagctctccaaccgtgagcgcactgagccgcctagtagtttccgccacaacgcgcctgttcgcggaatccgtgcgaatcgcaagaacgttttcctcgatggcctgttggcgaatcgtggcaatggattcgccgacttcttcgtcagcactcttgtcgctcttttcgttgaccttttcagagatcttttcagagaccttggtttgggaagaacgctcagtgctgccaccgcccatacgattcaggtacatttcggcaagcgcacggccctgcggggagagaagtccaccaacggtgaaggaaagcctgtatctctccccctgcgtcgtctccgcgccgtatgagccagccatgcgattctccttctgctaagacatcagtgttaagccacaagaacatttcagaatatttcatggtgtggataccagtagtatcagcccctaatggtggaatcattccgtatatcttgatctagaagtctctttcgatatgcagctatccaccgctcgagcaataggtaatataatgatgcgcaagcttaacaattagaatagcctaaagccaaaggagacggattatgttcggcaaagttcgtaagacaagaagcgactgcactgtcggcacgtatgaaaagaagcacgatcttccaaccggcaccattcggaataaggacggacgaaaggcacgcaaggacaagacgcttgcagcgcttcgcaaagaaaatgggaaagattatcgctgataaatcggtcgccggttaacaacgctcctccttgaaggcacaggtacagcaaaaacgcacaacgatgtttcggtcatacttgttccttccaatcagggaggcacaagaaaagtcagcaactcgtactatggacgccagcttgcagaaacacacaccacgaccaagcaactgaggcgcgacctcaacaactacgtatggtggttcaataatcagcgactccactccacccttggatactggagtccaaaagaattcaccgaacgaggactcgtcattctagagaaccatccaacacaccgttaccaatccatataaacaagcggatagttaattagacagtctgggggatatgcgatgtatataaaggaaatgcgcgtatttggattcaagagattttccaagctgcaagttgaactctcacctggaattaatattgtcgtcggtgataacgatgcgggaaagtcaacacttctcgaagtcatcaccgcagtattagatggacaatatagaggaacctctttagcaaggaatctgtcggaggatttatttaatgctgaaaatgtagccacatacataaaaaatattcgttcaggaactcaatgcgaaccgccagagattcttatcgaagctgtatttggcggtaatgaccaagaagaattattagctctctatgaaggggacgccaattccaaaggggcgaaggaatctggtatatcccttcgcatcaccttggatacagactcattcgccaatgaatatcaagaattcgttgattccagagaatgctttggaattccgatagagtactactcttgttcttggactacatttgcccgtaaatcaatccgccctgtcgggattaaattcaatgcttcactaattggcggagggcacgcatttgcttgggcaaatgctaaagcggttgtttcaagaattgctcggaatgtgctggaaccgagtgatcagattgttatctctcaggcgcatagacaaatgagaagcaacttttccgcaaatgaaaaagtccaacaaatcaatgacaagatatccgagaaggtagaaagcctaactagaaaaacggttaccctaggcttcgaggcagataccgttagttcttgggagaacggcattgtaacaaaattggagaatatccctttctcaaatgtgggagatggaaccaaaagcattatcactgcagaattggcattatcgaaaagtaaagatggtcaaaaagatgtgattcttcttgaagagccagaaaaccacttatctcatacacggctgagcatgttcctcgacgatgttaaaaaccgttgtaaagacatacaattgatagtaacgactcatagcagtttcgtggcaaacaaacttgacctcaaaaatctcatactattaaacggagacgaatcgacttccttcgcagatttgcaaaaagatacatctcgctttttcatgaaggctcctggctacagtaccttgcgcgttttgctctgtaaggcatcaatactcgtggagggagatgccgacgaactcgttgtgcagcgtgcataccttgactcgtacggaaggcttccgattcaggacggcattgacgtcatatcagtaaggggagtcactttcttaagatttttggaaatcgctcgaaaaatcgaaaaagatactgttgtcattaccgataatgacgggaacgtcgaagcccttcgaagcaaatacagggactatccttttattaattcgccagaagccaccaatgcccatcaagtcatttcttatgatgaaagctatctcactgaggggaaagcgaaaaaagtaaactacaatacactcgaatctgagatatacgagtcggcaggtgcggaaaagttagctaaaattctgggcagatcaaataataaccgcgatgaaacactcgactatatggaaaaacataaaaccgaagtggctctaaaaatatttgatgcaacagaaaagataacatacccaaattacattgttaaagctatcgaatgggctgccagtaaagttggcgccaagaaggttggtgttggcaaataatgtctagaatgtatctagctgcggcgggttccggaaaaacaacatttcttctggaaaaaacatcagataaaagcaagagatatctatatacaacttttacggatgagaacgcagaaaacgctcgagacatgctcatcaaaaaatacggatgcgtaccatcgaacgtgaccattcttccatggttcagctttctgctagaacatggggtgcgcccattccaaggtgccgctggttttaaagatatgcaatttaccggcatacagataaagccagaaggccgtaattattataaacagccagcccttagacattactgcaactcgtccaacgcaatttatgcggctaagctgcctgaactcgctttgctctgtaataagcagagtggcggagcagtacttaatagactgcaacgcatatttgatgctgtcctgattgacgaagttcaagatatggctggatacgactacgaattcatagaacttctcatcaattccgatatcaatataatcctctgtggagatgagcgacagaaaacttatagaaccaatggaagccgcaaaaacaagggcaaaacacttgaatgctttcttcaggaaaggaaactgatcggtagatgtccagtagatcgaaacaccttgaacggcagccacagatgcggagaaacaattatccagttcgccaacaaactatatcccacatttccccaaaccaaatctttagcgaaatcatcgtcaagtcgtcattctggagtttggcttgtcccagattcgtgcgcgcaagcctactccgataagtatcatccagtcgtccttcgcgataaaagcaacatcaaaaccatagattcatccaacattctcaatttcggcaaatctaaaggaaggacctatgatgacgttctgatttatcctgtcggcagtgtccgaaaatggctcagcaatcatgaacaagatttaaaagaacaaacatgttcacgcttttatgttgcagtcacgcgagctcgttacagcgttgggattgtccttcccgacaaagaagctaatcagctaaatgatatttatcaagtatgggaaaacacttttgagtagaaggcaacatagaaacagacaagggtcgcagacgttttcttggagataatcacgcagccattccttggctttgatggtatttactagggctcatccaactaagtgactgtttgacgcgctcatagtcagtcatgccagcggatgcgaccgtcgccagaaccaacgcttcgtcgctcagttttttcagtcgtctatctcaatcgcgtgaatcgcgacttcgccatcttccgagaactcggcttttctgaattccatgcggagttccatgccggtctcgtcgaactcaccgttcagattacgcaccagcgcatcgaccaatcagccgctagagctctcagccatattctccccactccgatagacgcactatgcttaacgcccatggtgttcgttcctttgtctgttcggtggataacatgcgggcaatccgcattcgccatgagccatgttttctccgcgagcgcgacggggttccaacagatagagcctgcatccacgttagtaatccgccagaacgtgttcgcgcactcttgcgcactttcatgcacttttgcgcatctacgccttgattgcatattttgccattcatgcggcatgttcaattgcccactgatgtacaatactgtgcatcagtgcccatccaaggctacgtttacgtcctgaaatgcggtgggcctcttttctatctcattgctgctgcgagtagtagcaacagcttccaagcctcttagcaatgctcaattccagggcctcttccttttgccaagccgcataggcatgtataaatcaaccaatacccgccttttctgaactacactgttcctagaagagttccgtgttgaaaggggtaaccgatgacgcgcaaaggtgggtttttgaaggggatcgtcgcatcggcggcgacctatgccgtcaaaacggcggtcgacattgcggccaatccggaaaacatgcagaaggtggcgcagcttgtcagcgaacaacaggtaggcagcaagcttaagcaggccgccgcgagcatgcatctgccggccgcgcttagcccatccgcaagagtcgccaagaagcttgacaccatcgaggagacactggagcaatacgccgaccaatttcccgtaaacgcaccagtcgaacgatggaagagcaccctgcaaagccttcgtcttatggacaccatgaacagatccacaaccggcagcgagcataagaaccgcctggaaaagctccagacgcagaccgaagctctgttcaacgagatcttccagtcccttgactcgggcgatgcccagatcgaagactgaccacttccccactgctttcatacctgttccccgccactcccaagcgcaccgacgcgtctgccagtcgtatactgctaccaagtggatttgaaggaaataaccatgatcgacgacgattccaacgaactcatcccattcgaaggcggagacagtgatgccgatgccagcaccgggaacaacaatccagacgacacgaaaagcgtcaccatcatccaagacgaacaaggcatcgtcttcctcggcgacgccggtaccatagatctctggctcaaggatgaaggcttcgattccaaagcattcaaagccaaagccatacagaccgtctcctcggccagcaaaggcgcacaggcagccggcaacgccatggtcgaaagcggacgttgggtaaaactcaccaaggaatcggctgagctggtcgccaaatacggcaagaactgtaagaagggaccgttccaagccggtgttgtacggcaaccgaacgggcgcatcatcaaacatctaaaattcacccagccagggcaactcaaccccgccatgctcaccggcatcagcggcgtcatggcacagatggctctggaacaggacgtctccgaaatcaccgattacctgaaggaaatcgatgcgaagctcgacgacctgctgcgcgatcagaaagaccagaccgtcagcaagctcaccggaatctcccaatatagtaaggaatcacatgcgttatttcacttcggacacgcatttcggccatccactagtcaccgcgctgcgcgggttcctgaacaatggcaagctacgtgctgagtacctcgacatctggcagacgcagacccgcaccaccgcacacgcgtggatcaaacaatatgtgcacgacaatcagacatcgttcaaagcgatctgcgacatcgcacgtcatgagaacaccatcatcgacaatatcaacgagatcgtcgggcacgacgacgaactgtggattctcggcgacctctcctaccgttgcaccgtcgagcacacactcgaatgcctgcgccgaatcaactgccaacatctgcatctgatcatcggcaaccacgaccgcaacttccgtctccgattcaatgacatgctatacgaagacgtgttcgagaccatcgacgactactgcgaaatcgacatggaacttcccgttctcgatgaatccggcaaaataacggtggcgaccacgcagcaaagcatcgccatgagccacttccccagactctcggcattggccgaagaacacggcgactggccgagcaactggaacgagttcgccgatatggcgcctaccaccgaaggctggctgctctacggccatacgcatcaggacgttcccgacggcactgatccgcgaagtgtgaacgtgggactcgacgcatgggatttcaagcccgtcagcgaacagcagatcctcgcctggcttgtatcccggtgtgccgaccaatcaaaatgaattccaccctgagcatgaatccgggctgtaggatgccgggtcgctggtatttgtcgacgccggcgctccaggtttgcaaccattcgagtttgggacactgtcggcatgttcccggatcaacattgccgacgatgacggtgacttgagctttgagctcttcggggatgatggccgtccttgccatgttgccacgctgcgccggatcgcctacgaattcttgcggcacgcctttggctgcacgcataaactgcgcttgttcgaatggcgtcaacggcaggcaattgacgataagtttgcgattattctcggttccccctatcccaccttaggacaaacatgagataagcctttcgcatgtgagtggcgaatagattcagccgagtctgacttgaccccggctgaatcacatgtatgcgcccgtctgttcaggcaagggactcgtacgcttgcgcatcgaccggttcaagccattcgttgctcatcgcgccagggtctcctgccggaaccatgaacgccaggtgggagaaggattcgccaggagccgcaccactgacggcaccatgcgcaacaagtatgatcaagcgcaagcccaagacatgcccatcgtcgaacgtgtgcttgaagtagccgaacaccatggagtgcccatggctcaggttgcgcttgcatggcactgggccaagggcgtgactgcacctatcgtgggctgtttgcagccagaacgcgtggatgatgctatcgccgcgctaggcgtgcagcaccatgagctctcgtcgacacgtagtaaaacatatgccaacattgcaggtctcttgcgcacaaactaaaccatgcaaccggtttgattccctattagataagaacgcctcacaaccgcaaggtgtactcagccactactacatcgcggtatacatacagcaccactcatcaaaaaacggaagagtcgccaaagtcatctaaagatgactccctacgacaaataattacaaggatattccacctatgacaaactggcgctgcgaagaggaggaaaaatgaaactaatcgctatactgttgtccatcatcataatggaagcacctagctccatgaccagccctggtccttttacatcagcaaacgctctcaatacgtattccgccaagatatatcccaagtgccctccaagtctacactggctctgccgagtcttctgacatgatgacaggaaaacgcgcatgaaactgccatgctcctttttcagaagatgttttagcaaatcctcctatggacttaatccatttcatatgcagcgacaaaccgcttccggacaccggcttgtcaggaaataagttctttgacgaaatatcattcacctgatccacatgaattaaatcatcgtcatcccaaaaaacaatgagacggtattcacctcctggacttccatgcacagcgatatttgtatatagctcatgaatcaaagaaaaaacctcacgggaaaaagcatcatcaagattcttcaaatcttttagcgcaattctcgtctttccatgaaatccgagttccttcaggaaggaatccccttgctcacctacaatttgcaatccagagagactcatattgtccgcttgtactgattccgtctttccaccattcattaaatcaacaacagatcgcatctcatccaaagtttctacgacgagagccctcacttctcttatttctttctcgtcaaaggttttgttcttctcagcatccaagattagaccgtccagcaaaattgccatgtatgccaagttaccagccactgaatcatgaattcggctggctaccacgctctcttttcgcaggtattcgacgtgctgacttaatttttcataccttagtttgttttgtttgagctgggcagcaagttctttccacgcaaacgtttttccgacgaagtatgcaaagaacatgacaagaattaacatgaaatactcattggccgccacaccatcagcattaaagcgccacattcgaaccaatgccaccgcgaacggatacagcatcccccacaacgactcaattcgcagccccgcataccccagagccaaccaagttccccataaaaagcttggaccaccgtcatctggaataagacagcaaatcacaaaagtaaaaaaaaatgatattgcaacatataatcggccgccgcggcatcaggacaacagctaatacatgcacgcatacgaggaaaaatgtcatcacacccgcagaagggaaaaacagtatttccgcaatagtcatgatgacacaaaccgctacaagcagatattggaggtgaaatacgcaccatgaaataaatggatttactcttttagtactcacgttcattaatttccatccattgaattactgcttgagtcctatttttagcccctaatttcttcatgacccttcgaatatacgttttcactgtaggttcccctatgccaagcttgatgccgatctcctttgaggtaaaacccagggaacacagccccataacctctcgttcccttttcgcaaacgtttcatagttgacatttccacttttggcagtcaataatctctcatgcgactcctgcgcactttcggaagatgcatatttaacatccgcccgccgcccattcactattgcacataagacatggcaaagacctttcacattcgccttatccacaagacagctcgctccgttttccagagcaggcacacagtaacggtccagagaaaaagcagtcatgcccactaaatcaacctgagcagtctcctcacgaatggtccggcacacatcgcaaccgctcattccctctagagacatatccacaagcaatacatcaggacgcgtccgcgagttaagactcttactcaccgcggtcagaccatccgatacagcccaacacacgttagcctgcggaagaatacgctcaatcatcatcttcataacgccaagcgtcaatctgtcattgtccacgatagcgattcttattcgttttcccaaatacatcgtcactcaccttcacccctaagcatacaaatatagccacgcattgcatcacgtacaggccatcacccagccagcagcaatagctattttcaaacacggaaaagcgaaaaatcctcattttccagaaccggcatccaagatccccattcccctgatcgcccagaatcacttaacgctaaaagcacaccggccgatcccgtccccaaatccatggaacacttgtatccataaagtcccgggaaaacaatgtttccattgttcttcatcaggtaaagattcaatccatcaataatccgctcccacagctcatcatcaatacctaagtcgcgcaacgctattgcagcaggcaacagtcccacataacccccgaataagccaccattaaacgtgcaaaccatatctgaaccttgggaaagccttctaagaaactcctcattaaggaattccattgactcattaccatctttatagacttcaataaaagctagggccacaccagaagttccacaatccagataaggcattgttctgggtttattcttcaaatgatccacgtaatacatcggacgctccttgttatccgcattggcaagatgcgttagcgtaagacgaaaaatgctttccgcacgggagcgcaaagcatcgtctttcctgcaaagagaagccttccacaggaacagacctgcacccaaccagcccttcattaaggtaaagtccgctttcgaactcagcatgtcttgcgaagttaaaccacaatcgcatctctcatacaccttggaaagaatatacgacaacattttttcttcatgcgagttcctagatgctcccaatgacagaagagccatgccaatgccagacaaaccagagtacaaggaatagtcgtcaatgcctgccaaataatcaatgtgagagattccgatataagaaagcattttatgacattcctcgcgagaaaacacctcatatgcagccatggccacacctaccgtaccgttaaacaatcccgcgcggaacgacataccgtctttcaatttacgtaataccgatatatatttctcccgcgcaatagcataaaaccattccgagttttccaaacatgaagatttcagcaaagccaagctcacaccggcaaaaccagacccaatgctatatttagacatctcatcgccatacattgaaatatcacctttgacaggatattcacctcgcaagtcaagaccagagacaatccctttataaagaagtctcataaaggtttcaatattctcaggatctaaaagcttgtcacaagcctgtaacgctttgtcgataaatggtccatgagacaataacggagtcaagccaagcattcgcgatctgacagaccgaagaaaagaaactgcctcattcccaaagtgcttttgcaccatataatcctgacagaacaacaacgaaggagccagataataaaggggacatatgggaacaaaaaggcggtgcactataaccgcgaaggcataccaatcttgttgttcatagttgcatacagcatcgttggtaaatcctggagtagcgatatctacttgaaaatcttgggaaagttttttcgccgcctcaaaatcaatcagtttaatttctaaagaatcattaatcagcacatttgataagctcaaatctccaaccgcaaatccaattccatgcattttcgcaattgcactttccaatttggttgcgatctctttacaccctcgccaataagaatcagagcaatccgtccgagcagagcatccatcgaaagggaattccattgctatgtactgctgcaaatctcgaccttcaaaaaaatcctcaactaaaaatgcatgattccagacatcaaaacaatcgacagcattcacaacatcagagagcggactcaaggaacgaaggatttgatattcatgcttgattcgatgaaaagcatccaaacatgacctatcactgaccccaacattttttcgcccttctttaaggatatattttttgccgtttcgcgaagcgagatacaccccaccgttattactaaaatggacagcggagtctatttgataatccgttaattttccatttgagtattcaataaaataattattctctttaacatatataggttcatcaacgaaagaaggcaaggaatacagcggtaattctttatccggtattaaatcaccctgaggagtcactatcacaggtacattcttttcgtttgaaaagcgcggcttcagagcaccatatctgaaaaatacattactattttgccattgtttatcagttaagatataaggaccatcatcatatttacaaacaatggtttttaaatcttttagtagctgaataaaaatatgttcagaactggggtaaatagttatgaatttacctgactcaagtctatccgcatattttccattcgcctgaatgaaacaagttctacttgaaagatatttaaaagaaatagatttaacgaaaagatattcagcaacatcatagagaacattctgagcatcataaattgtagaagtgatatgaattttccaaccttgaggaggaaaagagtacatcagacaattgacataagtccaatgcccatcagacctaacgccccattgctctgagttgtcattcgtcggcaaaacataagcatcttcacaagcataaacaggttcgctatagtatatggtctccttatctgccgagaaacggaggtaatcatccgccgagtaaccaaccatcacaattccctcttcccctatatcaatccttcaagagttgattttgaacaaaaaatctatacgctggacatctttcaatgagctctcgatgatccccctgatccaaaagataaccatcttcaataaagaaaataacgtctgagtctattatcgtagacaagcgatgtgaaatgacaattgaaatatcatactcatgcgatcttaataggttatcaagcacacgtctttctgtcttcacatcaagattcgacgttgcctcatccaaaataagtatcggagctttccttaaacaagctctcgcaatctgcaatctctgtcgctgtccaccagacaaagacatcccctgctcaccaacactcttttccaaatcaccaacggaaataatttcatctaagcaagcatttttcaaacatttattaatgtctttttctgatggcacaaaatcaagaccaaaaaataaattttctttaattgttgtagagaaaaggagattatcttgagagacgacagtaaaccaccttctccactcttctagatgctgcccatcaagcaagctctcattgatagcaatggctccagaatttgcactatatagacctgttattgtattaataatagtcgttttcccggatccagatggtccaataattgcatatcgaccacccttttccaacctcatactaacatcatgaagaacttcattatcattgtaaccaaatgaaacgcttttcagttccaaataatcaacattattatacgcaaagttttccatatctacttctcttgagatccgatgacacggttgattctttttaaggaacctttgattgtttgacaactcaaataaaaggtaaataaaccacctactggagtaaccagctgaaagaataacattacatatgcaacaaacgaaccgtatgtcaagagatgtacgtccatcagatgaacaccatagcaaacaatgaccccagtacaaaaaatcgaaatcagattttgaacgggcgtaacaaaagaatatactttgtcattcaagagattaacttcttttatttcatttactcgtttcttgaattttagaagcatacatctctctgcattacataacttaacagtgcgcatacttcgcactatttctgaagtaaacgtatttaatttaccaattctctcttgcagcatcatcgcatttctgttattaaatatacctaagggaacagccagtatcatcactgcaggaaagataattagaaccaaaatagatagtctgtagttaattacagtaagagcaacgacggaaaacagtatattgataacactcgaaacaaactgaggaatactagccgccacaaaattcctgaccagagagatatcatatactattccactggcgatttcaccgctattttcattgtcaaaaaagagcatatctttctcaaaaattatatccatagcctgaatacgcaattccgccacatgaagatcggcctcagttgaaattagcaatccaccaattgcacacaatatgaattgcgccgcaaaaagaaaagggaatacatacagtaaactaagatcaaattttttattatctataaaatcttttatcaaaagaggaacaaagaatgataacgtcgatccagcgatactgcaaaccacgccaagaatcattctcttgctaattcgcataaatttaagcatcagatttttccgccaaatattttgtattagttttaagcaactttcctttactgcctattctaggtttaacatcctcatcaccaacttcttcaggttttaatcctaagctttcaacaaaagcatctgataagtcatcaagcgccatatccttcattgaccaaattctcttatttaccctaatcaatggcgtcgcaaacccctccctccctggagctattaggtcgcttcgtagtattgtgtaatcattacttttttcaatccattcatcgtactgtccatttaaactttcctttgcaatttctctagatattcccgctttaatcgcttgttcgattatcttttcatcagacatttctacataatctacttctgaaggctggaacttttcatcaaatatttctgaaatgaatgcaacgacatgctttggatctttttctgaaatgtaggctatggatcccgatactctggccgaataatggtcagatgaacacttgtctaaaaaaatcacaggatgaatttcaagcttaatctgaccactcgtatacatttttcctatatcatcatttaatgttctatcaatttgtgcacaagccggacataggggatctaaataaaattctacagtcggaatatctttttttgacccaacttgcaccagtagcccgccatcatttgttgcgtttgtaggttttcttttcacttctgataatgactcatacgctttttttatatctttagcgtcacttgcactgtttctagacatgaaaagcccaataaatgcactggcgagaagtataataattataaatacagtaaacaatccgagaattgtttgcttttctctttcattcaatcttttcattacagcatccatctatcaaaatggctatctgttaacttcaaaacagatagccactgcagtttaaaactgttgctcttctacttcagcagaaccaactccacgaactatgccaatgatgcgtattcggatcacaattaggatccgtcgaacaatttccatgcgtgtcaacacatggtggccttttagaggtcatacttgcaggttgcgcaatcaaagcctgtaaactgagcaaatccttcatttccactcctttgaacttccagactctcatcacagcgaaacagatagaagtccagaaacatttcttccactgacgaaacccagtttgacacttttctcaatttcgtgtcttattcactctcttatgtcatcccttagatgacatttcaagccatatatggatctaccatttttgacatgtaacggctcgtttttcatgatgggttacagacatcattgtctgtaacccatcacattgcgaaacggccatcagaacctagaaatcagccctagaaaggactgggcatactctcttcacttgttgccgtccaaaattgccgatagatcgacaacccaaataagtgaatgctgtccatatactgacgcttttccgaaaatatcactttccatacaaggcagaaacgttcagcaacgcccctcatacaagaagaaggaaagcgcgccgtcttccagaccgccttgcgtaaaggagtccctgcgtacagtacgttccgctttacgcgtcaaaccacggtaatcataaaaaccgtaatcgcaggtagtgtcagtgaagaggaaatactcgttcattccagcatcacgaaacacgtcaagcatgtggttgaacagcttacgaccgacgcccatgcccctcgcttccggggaaaccacgaacagcgttacctcagcctgatagcttttgccggcatctcgcttcaacatttcatcggcctgcaaaatcgcaatctgatcggcaagtcctcgacggccatccttgcttgtcaacaagggcaacgccaagcaatttcgcgtaatagcatgacgtatcctctgcgctgtggtaacacgggatctcaacgagcccaataccacgccaagcacccgaccatcacgttcagcgaccgtagcctcggtggtgcgggaaagaaaatcatgcatgtcgatggccgcgagtcgatgcatattacgcaagtgaatcgccttgcgcagcttatacttacgcaacccgcgctcatcgttcggaacattcccattatcatccgactcatcatccacataccaagcctgacggacaagctcttcaagcgcgggaaaatccgtgcgacgcatcggtcggagcataatcatttctgaagtcatgctcccccatcctagccgcagccataccaaaactccgctcacggatgacataatgcgcatggtattgaaataacaggaatgcgtaggatttgttggcattggcatgtgaagcttgggggtctgggggtcacaagtttaggatgagacaggattgcgtgtgacgcgcaatgaatgagaggttcatatggcaacgttggttagacgaattgcgggcgcgctatgcatagtgctcgccgcggtatgtgtttgttacgctttcgcagtgcgtaacacgcattccggcacagtattctggattgtctggctagcattcgcggcgctgttcgccgtgcttggattcggagtgctcttccaatggtgggcgatgctgccaagactggtcagaggtgtggcgatcgcagtcgcatgcgtcggtctggtcgcattcggcacggtggaaggttgcatcgtcagtcaaatgcatgcgcaaggcaaatcggatcttgattatgtggtggtgctcggcgcccaagtgcgtaagtccggcccgagccttgtacttcgctaccgtctcgacaaggccatcgaatatttggatgagaatccgaataccatctgcatcgtttccggcggaaaaggaccgaatgaaccgttccccgaagcccaaggcatggctgactatcttaaggaacatggcattgccgaacagcgcattcttgaggagccggagtcaaaaaccactgaggaaaacattgtcaacagcaagaagctgatcagtgacgataatgcttccgtaggggtgatcaccaacaatttccacatgttccgcgcgttgcagattgccgacaaatatggtttggacaacgcccaaggcattgcggctggctctcccccgaacatgctcgtcaacaatatggttcgcgagtttttcgccgaaatcaaattcctgctgtaactcatgtttcggcaatctctgtcttgccctgtttaaggatgccgaaaccgaatacgaaataaattgaggggtggaatcccatatggatttcacccctcaacgctttagaaagatgactctcgcaagtcaggcattaagcgagactcactcttcggaagcgagttcgtcagccacagcggcggctgcggaagcagcttcaacgctctcggcttcttcatcttcagcggcttcgccgaggaaggcgctcaaatccaaggtttcaccctcggacttgaaggtcacggcacgcatgccggcaagcaggcccttggaacggccaacttcctgcactgcggagccgagctggccgttgcgcatgatggcctggatgaaggcgttcggatccatgccgtactgctgggcgatggaagcgaggaagttgaacacgtcggactgggagaccttgacgtccagcttctcggcgagcacgtcgagcaccatctggtcgcgcagttccttttcgacggtttcttcagcttcggccttctgctccttggtggcattggccggatcagcggtcacgcccttgagctgctgctcaaccatttcagccttgacgcccttcggcaccggaatctccaggccctcttcgagcttggcgatgaaagcgtcacgagctgcggtggcctgacgaccttcggcatcctgggaagcggccttcttgaggtcttccttcagctcgtcgagggtgtcgaactcagaggcttcagaagcgaagtcgtcgtcgagttccggcagctcttcagccttgacggagttgaccttgaccttgacctgagccttctcgccttcgtgctcgcctgcttccaaggtaccttcgaaggtggtctcttcgccggcggacaggccttcgagagcctcatccagaccgtcaagcatggtttcggagccgagctcgtagctcacgccttcctgggagtcgaccacttcgccgtcgatttcggcggtcaggtcgatgttggcatagtcacccttggcggccgggcgatccacacccacgagggtgccgaaacgctggcgcagggcttccagacggttgttgatgtcttcgtcggtgatttcggccttggcgacctcgatctccatgccgtcgatttccggcagttcgatgtccgggcgacgctcaacggtggccacaaacttcagcttggtctcgtccttggcggattccggaacttcctgaacgtcgatttccggctgggccatcggacggatgcccttttcttcgagagccttggagtacagctccggcacaccgttgttcacggcttcgccagcaacggcaccgaagccgatgcgctggtcgatgatcttgccgggcacgtggcccttgcggaagccaggcacgttgacctgcttggcgatttccttgcgagcattgtcgagatacgggttgaactcttccggatcaacggtgacggtgagcttcaccttggtcggctcaagattcctgacgctgattttcacgcttgcgctcctgaaaaatacggttcttcacatttctgccgttaggcaacctctacatgatagcgcgactcacggactctgcaaccagcgcgacctgccacgccctcgcgccctgctcggtgaggaattgcgcaacgtcacgtttttgcggttcgtcggtccaacacaggttgcgcagatactgcggtttgatgatgacgtccgcgggggtacgcgtgtcttccgctatctgcgccaccatcttgcgtgccttgtcaagcgttgcgagacgttccggataacgttccctccagactcgcgtcgctcgtggagcggatatgctctgcgcctcctggttttggggattgccgctttcgatgaccggccattcgctttccggcagatcaagcgcctgttggattattctcttccacatgcttggcttgattttacgttggatcggcgcgtaacgttcgaacattttctcctgttcggcaccggcttggatgcgtacacgctcgttgatggaacggaccgccctgaattgcgcggcgttatgcggcttgcgttccgccacttcgatgatggtgctgtcggcgagcagcagtgtcggcgaaatatcgtattcgcgtgccagttcatctcgtttggtccataatgctttcgccacggccagggcctggcggtccttcatgatttcggtgatatgtgaaatacgcagccatgggatgggatgctccttgcgtggcgcagtcccttcgcgcagcgcgtaatcgaattcctcctcagcccattcgatcttgccttgcttttgcagttcggcgcgcatggtcgtttcaagctcgatcagcaattcaacgtccagcgccgcataattacgccagtctcggggcagcggcctgtacgaccagtcggccgcggaatgctctttggcaagtgtcaatcccaagtaatgctccgtaacggcggccaaaccgaaccgtttcatgccgagcagtctcgcggcgatctcggtgtcgaacaaccgctgcggcttcaatccaagatcattgaatcccggtagatcctgcaaagaatcatgcagaatccataccgcatcgcccaccgcacgattgaaatcgttccaatcggcaccttccgcagccaatgcctgcggatcaagcaatcctatgccggcaccgtctcttttgaattgcaccaaccaatcgtcatgaccgtatcggaagccagacgcacgttccgcatccgcagccaaagacccatgcgaagacgccaatgcgctgcagtactcgcggaatgccggtagggtgtcgatcacatcgggcacgccctcacgcggctcggcctgcaaccttggctcgtcagtcaacgggataatcctcctcggattgcgtcatggaccggaggaacctagcccacgcgcccacttgggcgcccgcgtcaaggcctccatcggcatagtctagtggcgtccaagacacacgaatctcacatccggtttcgggagcgtcggactgagtgccaaacgtcgtgcttttcgtgactgtgacggttcccgaaacatgttcgacatcgtacgaaccgacacggtccatcatcgcatcccaatacatggacggtatcagacaatcgccttcgcctccagacaacggcaacgcggcgaaagcgacgcaacgccaatgagaatgccagtcatttcggtatttgtgcgaatacaacaccatgatccagcctgtggaacgcgcctcgtcgcattgcatctcaactccaatgccgaaactcgccatggcgcacggcactggaatctcacgatacgacacgcttggtaatcgaggcatacgttctacggaaagcacggcgtcccataccttgtctggcacgccggaaggtcgggtcaacatttgttcaggagggtcggcgtaggcgcacgatcccctacctgtggcacgcgcttcgttgggcgtgccttgaggaaaagcatagatgtccaccatgattcaaggctacggcagagtcgccggttttgcggtatttcacagcatttcgccacgcgtcgaatgtgaagattttttcgcgtggcgaatgctggttcaacaattgcacgaatattcctttttccaatcgctgaggcactttcaaacgattgatttgccggaatcgttggctggaatatgcgtggcttcccgtttagtagacggtgaagccgtgcgattggaattgttccaccacacgctgtttcattgcctcggacggccccttctggtcttccaacgggtagggaatgttgagcatatgccattttggacggccaagctggtggaatccaagcacatcgatatgttccactgcgtcgccgaacgactcgcagatcttcgccacattctcaacgttttcctcggatgaggtgagtccgggcacgagtacgaaacgcacccagatcttcttgccggccttggccagacgctgtccgaaatcgatggtcggttgcagaatgccgccagtcaccttcttgtaggtttcctcatcgccagacttgacatcaagcagacacaggtcgatgtcgttcagcatgtcgtcggtatagcttgcgccaaggaatccggaagtatcgaggcaggtgtgcacgcccatctccttggccgcacggaacacgcgggagacgaatgctggttgcatcatggattcgccgcccgagaaggtgataccgccatgcgtcgccttgaaaagatccacatagcgttcgatctttttgaccatggcctcgtaatagacgggcttgccgtcacgcattttccacgtatccggattctggcaatactggcaacgcaatgggcaaccgctcatgaagacggtcatgcgtgttcccggaccgtcgacggacgtgttgatgtcccaggaatgcacgaagccgatatcaccgcttttcagcgcgttgatgcggtcacgccggtccaggccgatcggcgattcgaagcctgacagccctcccataagcgtttggttgacgtagttttgcgattctctgagcatatgccttgttgtggagcgaaaatgtacgttctcagacatcggtgtcctttcgttgtatctctccaatggtttccccacattgtacagggaaaaccaaggggcgaagctttcacgctccgccccttgcactctaccgcttcacacggtaccgttcagtctcagtcgacgacggcgccctggtggaacgtacgggagatcacgtcgagctgctgctccttggtgagcttgacgaagttcaccgcgtagccggagacgcgcacggtcaggtgcgggtacttttccggatgctcgacggcatcctcgagctgttccttgcgcagcacgttgatgttggcgtggtacagaccgtggccgttgccggcgtccagaatgcccacgaggttgccgatgcgctcatcctcgtcgcggcccaagccatcaggggtgatggtgttggtcagcgagatgccgtcaagagcgtcgttgtagtcgatcttgccgacggagaacatggaaggcagcatgccatgggagtccatgccgttctccgggtttgcgcccggagcatacggggtgcccttcttgtggccggacgggaaggcgccggtggccttgccgtattccacgttggaggtgatggtcaggatggactgggtcgggaccgctccgcggtacaccggcaggcgcttgacctggcccatgacggtggagacaacccacttggcgatctcgtcggcgcgatcatcatcgttgccgtacagcgggaactcaccctcggtgcggtagccgacgatcagatcgtcatcggcgccttcgacgtactcgtcctcatggcccggagtggtcttggcgtccttgttgtagatcgggtagaccttggcgtacttgcatgcggacagggagtcggctgcgatggacaggccggacataccacaaccgagggtacggtacacttccttgtcgtgcagagccatctcgatggactcgtatgcatacttatcgtgcatgtaatggatgatgttcagagccatcacgtaggtctcggacagccattcgagagccttctcgtagttggccttgaccttctcgtaatccaatgagccgtcggattccggctggatcggctcgataacgcccttgtcgatgacctgcatgccggtcatttcgtcgcggccgccgttgatggcgtacagcagagccttggcggagttcacacgagctgcgaagaactgcatctgcttgcccacgcgcatcggggagacgcagcatgcgatggcggcgtcatcgccccagtgggagcggatttccttgtcggactcgtactggattgccgaggtgtcgatggagatcttggcgcagaagcgcttgtaggcttccggcagcttcggatcccagaagatggtgatgttcggctccgggccaggtccaaggtgctcgagggtcagggtgtcgagcagacggaaggaggtcttggtgaccagcgtacggccatcatcgccgaagcctgcgtcggaccaagtcgcccagtacggatcgccggagaagatcgcgtcgtaatccttggtacgcaggaagcgcacgatacgcaacttcatgaccaagttgtcgatgatctcctgtgcgtcggtctcggtgatcttaccggacttcaggtcacgctcgaagtacacgtcgaagaaggtggagacgcggccgaacgacattgcggcgccatcctggctcttgacggaagcgaggtagcccatgtaggtccactgcactgcttcctgagcggtctgtgccggacgggacaggtcaagaccatattcgttgccgaggttgatcagctgcttcagggccttgatctgctcgtcatgctcctcgcggaagcggatccagtgctcgatctccggctcggtgaagtcgttgcggtacggcacggagtccttgtcacgctgcttgaacttgatcagggtgttcacaccatacagtgccacacgacggtaatcgccgatgatgcggccacggccgtaggcatccggcaggccggtgaggatcttgttgtggcgggcaaccttgatctgcttggtgtacacgccgaagacgccgtcattgtgggtcttgcggtacttggtgaaaatcttcttgatttccggatccggctccttgccggcttccttgatggcctgctcgaccatacgccaaccgccgttcggcatcatggcgcgcttgcaaggaacgtcggtctgcagaccgacaaccacattgtcgacttccggagagtcgatgtaaccggcgccgaatgcgtcgatgccagccggtgtgtgggtgtcgacgtcgtagacgcgctgcttgcgctccacggccagatagttgtcatcgaggtactgccacaggtgcttggtcttctcggtggcgtcagccaggaaggactcgtcgccctcataaggcgtatagttcttctgaataaagtcacggacatcaatgtccttctgccagttgccctcagcgaagccttcccaagccttagcctgaagctcttccggggagactgccgtcgcatcaactgctgccatttccactccttctgggtgttggtttggcgacgcatcgttacgtcgtcgctagttatcgattctagctgcataaacctgtatagaacctgagtttacgaggaaataaaagtgacatatgtcacacttgcgaagtatgaaaaatcgcggtgccgtaatccggacaccgcgatttcttatatcgcatcaactacttttcatcggaagaccagcgtttccattcgcgatcctgttcttcccatttgatgttgcgttcctgcacgatcttccatgcatcgagcgcgtcttccctggttttgtatggtcccatacgatggctcgccggtgagatcatgcccagttcaggctgttcggtaaccgtattgaaataccattgcttttccatatcactccttacgaagcgcgtaacgaaacaatagtccgccgctgttctattcgcggaacgcgttggtaatcggcaagcggcggtcacgtccgaacgccaatgccgtcacctttggcccaagcgggtattgacggcgcttccattcggcacgatcgaccagtcgcataaccgtgtcgacggtggtctcatcgaaaccgtctgccagaagatcctcacgaccatgcgcatgttcaatgtacatcgccagcacctggtcgagcagctcgtactccggcagcgaatcagaatccttctgccccgggcgaagctcggcggacggggctttctcaatcgaattgacgggaatcatcacgccatccggcaaaggagtcccagcaagcccctgttcgttgcccacgacatgcaatccgccgatgcccatgcctgccgcggcggccttattgcgccagcgagagatttcccacacacgggtcttgagcagatccttgattggcgcatatccgccgaccgcatcgccgtaaatcgtggaataaccgcaggcaagctccgacttgttgcccgtggcgacagccagaagccccttggaattcgaatatgccatgacaatcacaccgcgaatacgcgcctgcaggttctcagcggccacaccttcaagatcgagctgcttctggaaggagacgaacagcggttcgatgggctgaatgtcgtagtgcgctccaatattcttcgccagatcggcggcatcatccttcgaaccgtcagacgagtacatgctcggcatggaaatgccatacacgttagctcctcccacggcgtccgcggccatggccgccaccaatgcggagtcgatgccgccggaaaggccaaggcacacgcccttgaaatggttcttggccatataatccttcaagccaagcacgcaggcggtgtacacctcttcgtccggatcgggcttggctgcgatagatccagctttctggcgttcggcagtggtgtcgaggtcgaagaagctcagatcctccatgaacatcggcgaacgttccagcagcgtgccatcggcatcgaccacgaagctgccaccgtcaaacaccagatcatcctgaccacccacctgattgaggtagaccatcggcgcgttcacttcagccgcacggcgtaccgcaagatcgagtcgagtatcagtcttaccctcctcatacggagaaccgttcatggtaagcagcaaatcaatatgctgctcggcaagttctgccacaggaccgccatcctgccagatatcctcgcaaatagccacaccaatacgtgcgccattcacatcaagcaccatggacttattgccaggactgaaaatgcggaattcgtcaaacacgccataattgggcaggaagtgcttgtcatagccgtcccaaaccacgccgtcatgcaatacgacgagtcggttgcgtggcttggatgtctcgcgatcagtgccgaccgtgccaaccaccacaaacaggtcgccaagcccatcggcagccagttcggtggcgagccagttggctttgttccacgcggctttgcggaaggtggcccgcagggcgaggtcttcgatgggatatccggtcaatgtcatttccgggaatacgacgacttgcgcgccctgttgcgcggcgcggcggacgtatcgcatgatcttaccggcgttggaatcaaggtctccgacgcaggtgtcgatttgagcgagtgcgaagcgaatgtctgtcatagctgcctaacctaccgttgatttgttgaacgttttattttcttacgatcgcgaattgaaagcggaccgcacgcgtgtcacgaaagttcgttgagcaccgtcagcgccgcgttggcgtagaattccacgccggcctgcagtgattcatccagaccgacgaaatgcgggctatgccaatcggggcagcctttctcgccattggaaccgatgaaggcgaacaccggcatggtgacgggcatgaaatcgcagaaatcctcccccgccatcgaaggatggattggctcgagctgcgcatagtcgcgcacgttgtcagcgacgattttggatagttccatgtcggagacgagcggattctgaaagtcatcccagtcgatgtctgtggtaatgccgtagcccgcggcgatggattggacctgctgcttgaagcgtttctcgaccagttcgccgtcggacttatggaagtagcgtacggttccttggaagctggccttgtccggcacgacattccacacgtggccgccgtgcagttcggtgatggacagcacgagcggatggaatggtgagacattgcggctgacgatggtctgcaaggcgagaatcattgtggcgagcgcctcgataggaccagtgcccttgtgtggatatccggcatgtgagccggcggcatgcagagtaacgtggaatttcacgcagccggccatcatcgggtcggggcctacggcgatctgtccgggcgcgtaattcggattgttgtgggcgccgatggcggcggatacgtcggcgagcaaccccgcatcgaccatagctttcgcgccgagaccgagctcctcggcaggctggaacagcagtttaatggagcctttgatgcgcttgcggcgttttgcgagccagaatgcggctccgagcatgtaagacatgtgcaggtcgtggccgcaaccgtgcatcacaccgtcgttgacggacgagaacggcaggccagtatcctcttggatgggcagaccgtcgatatcggcgcgcaatgcgatgcgcgggcctggttgctcgccgcggatcaggccgaccacgccggtttcaagcgggttgttgagcacttcgatgtcgtgcgcgcgtagcagtttctcgatataggcacttgtctcgtattccttgaaactgcgctcgggatgtgcgtgcagataatgacggatctcgatgatctccggcgtgatctcaatatgttcgctcatggttgacgattgtaggcgcaaccggacgtttttcctattttcgtgttcgtttttcgtgccgacaatggcgttttccgcagtttttccccgtaagctggatgacgttttgaacggattcacggggagatcggcatgtcatcggacatcaaggctgcgtttttcgatatcgacggcactttgacgagtttcgtcacgcatgtggtgccgcgatccaccatcgacgcattgcatgcgttgcagaaaaaagacgtgaaggtgttcatctgttcggggcgcgcaccctcctatatgggtgtggtgcttgacaccattcccgtcgaatttgatggcattgttggccttaacggccagttctgcacaacacgcgacggcctcgattaccgtcatccaatcgacctgcacgatgtggagatcatcaccgactggctgcaatcgcataccgatgtcgtcgccaattacgcggaaagcaactacgggtatttcaatcgcatcaacgccgctttggaacgtacgtggaacagccttggcaaaaccgcgccgaaaatcgacatatgcaatccgcagcaacgtataggaaaccatcgcacattccagatcagcccatatgtggataaggcaacggaagcggaaatcgccggcatgtgcggcaacgtgcgcggtgtgaggtggcatcccgacttcaccgacctgattcctgcggatggcggcaaggcggtcggcatgcaggtcgtgcttgagcattttggttggtcgagggacaatgcgatcgcgttcggcgatggcggcaacgacgtggatatgctacgtttcgccggcataggcgtggctatgggcaacgccactgacgaaccgaagaccgtagccgattacgtcaccgacagtgtcgacgatgccggaatctcgaatgcattgcatcattttgaaattctgtagaaaaggtttttaagagttttcttgcgattctataagacggttttcgcgaatttctgcgtttttcatgccctttataagtattttcaataagtgaacgccgtgttgccgtcgatggttcctctatattggtcaatcgttgggtccgccgcgtggcaaacgggcggcccgtatagcgaattgagagaggaactcaaccatgcgtaacaagaagcttctcggcgcgctgctcgccgtcaccacgctcgcgaccttcggtctggccggctgcggcgactctggctccaacggctccgcctccaaggaggatgacaagaccatcaccgtggcggcctccccgaccccgcacgcggaaatcctaaacaaggccgtcaagtcgctcgtcgagaaagatggttataagctcgaagtcaaggagttcaccgattacgttcagccgaacaccgccaccgaggatggtgaagtggacgccaactacttccagcacaagccgtacctcgacaacttcaacaaggagaagggcacgcatctggtgtccgtggagggtatccacttcgagccattcggcctataccctggcaagaccaaggatttgcagaatctgcaggatggcgccaccgtggccgtgccgaacgacgccaccaacgaggcccgtgcgcttctgctgctgcaggatgccggtctgatcaagctgaagaatccgaaggacatcaacgccactccgaaggacgtcacctccaatccgaagaacctgaagttcaaggagcttgaggccgccgtggttccgaccgtcatcaaggatgtcgacatcgcggcactgaacggaaactacgccattcaagccggcttcgacccgaccaaggacacactggtcaccgaaaaggccgacggcctggccgcgaaaacctaccagaacatcctcgtggtgaaggaaggcaacgagaacaccgccaagaccaaggagctcaagaaggctttgaagtccgacgaggtgcgcgactacatcaacaagaactacaagggcgctgtggtgccggtcttctaagacccgcttcggctgcaagaattcaatgccgcaggtatactaccctgcggcattcttgttatggaacatcaataggaacaggacattatgacgattcagatcgaccatctgcacaaaagctatggcagtggcgccgaggcgcatgaggtgctgcacgacatcaacctgaccatcgattcgggtgaagtcttcggcatcctcggctcctccggcgcgggcaagtccacgttggtgcgctgcatcaatctgctggaacgtcccacttccggcaaagtgcgcgtcgatggtgaggacatcaccgacgcgaaaggcaaggagctggcggacgtgcgtgccggaatcggcatgatcttccagaatttcagcctgttccagcagcgcacagtgctgcgcaacgtcacgttcccactggagctcaaccatacgccgaaaaacaagcgcgaggagcgtgcccgctatctgcttgacctggttggattggccgatctggccgaccgctatccgagccagctgtccggcggccagcagcagcgcgtggccatcgcacgcgcgttggccaacaatccgtccatcatgctgtgcgacgaggccaccagcgcactcgactccaccacgactgcgcagatccttgacctgctgcgccgcatcaaccgcgagctcaacgtgacgctggtcatcatcacgcattcgttgtccgtggcacgcaacatctgcgaccgtgtggccatgattgatggcggacgcatcgtggagatgggcgatacggaggaattgttctccaatccgcaaagcgacattctgaaaacactgatcaccgatgcgaaagtggagaaccatcgccataagcatgattccgcttcgtccgatgagcagacggactcgccgaccaaggaagaggtgaagtgaaatgggacagattatctcgcaattcatcgccgattatggcgaactgctggtcgagggagtacgtgacacgatcatcatgaccgcggtagcgacgctactcgcgtatgtgatcggcctacctgtgggcgtactgctcatcacctcagcaaagaagggcatccgcccgaatgcgacactcaacaccgtgctcggctggatcgtgaacatcgtgcgttccgtaccattcatcattcttctggtggccatcatcccgttgacccgactgattgtcggcacttcgctcggcgtgccgggagccatcgtgccgctggtcatcaccgcggcgccgttcgtggcacgcgtggtggagcagtcgctcgccgaagtggacggaagtctggtggaggccgcgcaaagcttcggtgccagcaatctgcagatcgtgttcaaagtgctgctgttcgaaagcctgccgtcgctggtgcgcggcgcagcactgacgttcatcaccctgttcggcttctccgccatggccggcaccgtcggcgcaggcggtttgggcgatatcgccatccgctacggctaccagcgttaccagtacgacgtgatgaccgtggctgtgattctgtgcgtcatcctcgtacagatcgtgcagaccatcggcgacgtggcgtccgaccacatcgaccatcacgagcgctaaaccgacgctttcatgctcctatatgcaagaatcgggtctgaataattgtgttcggatccgattcttgtatgcgaagacactgctacgtggtgcgcttacttgttgagttcaacaactcaatctatgatataacctgtttttgctccgcatttccccgactcgatgggagatgatgggattcacggcaaggacactctaccatgcaccgaaattcaagtcagaaaccaatcagtatccggctttaatggcggtgatggtcagctcgccacggttcgtgtacccgagcgccgtgaaaaactcggatatgcaggggcgcacagtggtctcgctcggtccgagccgtttggcgatatcttgtttggtggcgcctagacaagaaggaacaatcccactgccatgtcaggtatggtaatctcaaaacaccgtataacctcgaaccatccagaacatcgataaactacttcaaagacaaaagaggcgcggcacgattgcaggggcattgatgacaggaacattaccaaaacagcataaagcggcgcgcattatcgagcatatcgtccttgtactcgcactggtctgggccggcggctgtaccctcatatggacgcaaatagacatgccccacagcatcgtgaacacgacatcctctgacggcacctgcgaagtggccatcggcgaactgggctcgcccatgttcttcggcccaagcaccatcacgatcaaagtctcctgggacaccgattccaacgtcatcggagccgagaacgtcacagaaatcaagacggacctgcacaacgacggcaaatcattggactcggacaacttcaccgtaacctggcacggcaacatcccgaccgtcaccacccatggcgaggaacagtcggaccagagctacacgttcaactggaaataaccaccccggacatcgcgcctctccgagaatagtcctcacggccgagcagatcccacaggggcataagcatgaaaatcatgactaccatcatcatgcgcgcctccgatgataatcgtggtcagctgtttttggccttattccaaggttttcaatttttgggaaacctgccgatcagtctcgtcttccacgaggcacctacaggcacccaaaaataatccgggaacgttccaccaccctgccggcgctcagcgtcttcgccgaccggcacggaaaagtgcaataccccctgtggtttcatgatgttccgcctgggtggtgcccagaagcattcgcccggcagcacgtctccatggcggacaatagacagaacgatacgcggcccatacaaccgtcccagccgccaatggcaccccgaatcccacaggcctattgcagacagcccagatcagctggctcatagtccaaagccgcctgcgacgccaccgtcccaatggcaggaacggtcagctgcgcagtatgatttccgccctgtcggccagttcccgttcgcgcacgcccatagcagacaggatcgcttgtctccgcgacggcatggcggaggtcgcccgtgcgaccaatgcggagaagcgaccgaacaattccaagtaatcgtccttgtcaagcaaatagccaagatcaccgatggcctggtacacgttctcgttagcgcgcccatcgtaccgggcacaatagcagcgctcgtcatgcgcgcacaggttgcggtagaacaccagtctgttgaagatgctgtccaaccgcttgatggtgatacgccgcggcccgtcgtgcgtgtccgcatacaaaccggtgaaactttcggcgaccgccaatcggacggccggggactggacttggaagaaccataccgtctggccgaaagaaagatggttggccagcacccacaacgggacctggccgttgtggtcttccatgcaatggcggatatacgccttgccgccatagtcgcccctgttgcgcgggttgccgtccaactcaagtatccgcttgaagaccttgtcgatcaacgccacggcgctcggacggcgcctggaatcataatagtcgggattgagatacgggttgacctcgtcggggtgcagcctggtgaactcatgcgcgcatactgccttgagcgcggcctccgcccgtgtgatggcggaaaacaacagttcacgcaactcacggtcgaacaggaacagggcgtacagatcatcgaaacgcgcgcccgtcccgtaccggtcatcaccagcggtcaggcatgcctttcagtcgaggaacaaatccttgtagccattgacgatcggataatagccctcgcgcctgagcacatgacccgcaccggcatcgacagccatgccacgggagcgcaaaatgcgcagctgttcgtccacactcctgtagggcttgcgcaacgacatgaattcgacctcccccaatccggcgatgaaagcactgaggccaccccgcatccacgggatggcctcagcgaaccgaacgaagtccagcttatttcgctgttacagaatagcgccgatcccccgcgaatgcaacccagccggacgtcgagtgagatgaaacctccatatcattattccaaaggcacacgccgatctatcaaggccaccaccagaaaaacccaaacgcctccaaaaagagacgacgcacgcctccacgagactgaattgcgccccgtttgttggacgttgttaattaggatacagccctagcccgcgagggacatgctccggaactcctccggggtgtgtccctcgagtcgtatctgacgccgtctggtgttccaatggatgatgtaggcgtccagttcgcgcttgaaccgctcgtacgagtcgaactcccggcctcggtagaactcgtccttcaagtggccgaacacctgctcggtagcggcgttgtccaggcagttgcccttgcggctcatggactggcggatgccgaggcgttcgagctcgtccctccaccatcggtgctggtactgccatcccatgtccgagtgcaggattggctccgcgccggcgagcaggcgcctctgctgcccgaggtccggactgcggctcacgtcccaggccacgatctccttgctggccatgtcgtacacgggagcgaggtacgccttgccgcccgcgaccttgaactcggtgacgtcggtcccgagcttggagaacggacgggccgagtcgaagtcgcgttcgagcaggttatgcacgtgatcgcccgtctcgcccctgtacgagctgtacctcctccacgggttcctggagcggatggcgcatctcagtcccatgcgccgcatgaccccaggcacgctcttggccgacaccttccgtccgaactcgtggaccaggcacatgcgtatctgtcggtggccgcatccgttcggcgtgcgtccccagatctcgccgaccaatggctcgagatcggcccgcgtcacacgctccggatgcgacaggtgatggtagtacgtggatctggccagtcccgctatcctcaggaggtggtcgagccggtgtccccgccctgcgagcagtcggacgacggcgcttcgctcgcgccgcgtgacttggacgcccgcagggcccggagtttttccaggtacgcgaccttcgccttcagataggcgacctgttcggcgagctcctgctcgcgcgtcggttcgggtctcggtttggattccgagcctctgggcctgcccttgggcctcggcccgagcgcctccggacctccggcccggtattcgcggcaccagcgttccaacggcgcgacgctcgcgatcccgtgcatggccatgacctccgccttggtcagaccgttctcgacgtggtcgcgcgccgcggcgaccttcgtctcccccacgtataccgtatagtcaggaacgcttttatacctgttcttatcttccgtatgaaccacatacaccgttggataatgaagacgcgttctctcggacatcgatacccccttttatccctatctcgcttatgtatggcagatacacctcggaaaagcgtacttagggggtatgagaacagctgtcatgacaacctgacctgccatatataagcgagatgtctcaggataaagcacggaatctaccatacgtaagcgggataaccaagcttaagcgctcgtacgacacatttttgtgcacaagacatccctccgcaagcgtcatccgaccgcctggtggcacgtttcatatgcacagagaaaacacagcccgcaaacaccacactcgaagcatgacgccagtggctttaaggtagaaccacgccgattctgcttgctgattaaggtaggcgatacgggctttctctggcattcgttgtcgacggaagcccatttggcggatcgcatgttcctccttttcgggtatgaagggagtgttcgggcactggagtgagcataacgtaatcatgagagagcagacaaaataactacggcagcttcgatcttgcgcgttccgcccctctcggtcttccctcggcgcatctctacgaagtgcttgacggtaatttcttccaaggtgaaatcagctagtggggcaagtgtttctgtatctgtgcattcttggaccatccgtgttcatgatcagtctcgggtcgaatctggtcttctccgacgccaaccctcgcaagattgtaaaacgaggctgcaccacgctcatcgcttttcttctgttgaatatcgtgcgcgatgggattcccgatgtagtcgttgcattgactggccaccccagtactctcgacacgtttggatacgatatttttgcgtccgatattctgggatttgcgggtttcgtattcctgtttttcgcacttgtcaaacattttcacattgtttcattggctacgccgctgatttcgttatgcatgttgacggttaacgatctgattccgccattgcacaatgtccattggactttacgtgcagaagcggcttgtcgcacgcgcttctaaagcctgatttcgcatgcgcacatccgcaaagtcacgcaaatactagttagcgcaacactacttggtgagatttgttcccgatgtttttcgtatagcaccctaggtcaaccctttttggtattttttcattggatatgccatacgatgggatatcttttcggagtatacgagattagggaaaatatggtcaaccaccataaaatgattaatgctgcaatcgcaacgcttgcgacttgcgccatgttgctgccggtagtaggcagcgccaatgctaatgaatcctcgaataccaccgtacttggtgccggctatacggccaccaagatttcgcaccccaatgcagggctgggcgaagacgacggtatcgtaaacgttttgaacggtgaatccattgatgatctcacgcagggtttgcccgagcgtggtcagaactattcatgggcttcggccggctacggcgactggatgtatgtgggcacctgctattccgcaatgggttccacgctgaaatacatggctaacaccatgggcaccaagtatgccagcatcaaggccgctttggatgttgcgttcaacggcgagctgttcctcgacaatggcgagaaccacagcttgctgctcaagatcaacgtcaagaccggtgaagtgaagatcatcgtcaatgcgattggcggagagcatgcggtcaacggctatcgtgcagccgttgaattccatgacaagctgtactttgctgccgccgcaaagggtcagccgtacctgctggaagttgatccgaacagtggtgatgccactgaaatcgtgtatcgttccgctgccatgaccactggtctgaagaagggctacactgctggtatccgtggtttgaccgtggtcaacaatcagcttatcgccagcatgatcaccgataacggtgccactattgtggcttcttccaacccgtcagcaggccaggattctttcgccactatcgctacccagaccgagggcctgtacaactatccggcatgcgctgtaactgatggagtgttcggtggatgcgtgtgggatatggtcggcttcaagggcaatctctatgtcactatggtgactggaaccgcgaagaacaacaagcaatccttcgcactcgtgcgcggcacgcaagataaggaaaccggcaagtggaccttcaagccgctggtcggcgatccggcagacggcgccaagtacgagtggggtttcggagcgagtcgttccggcgcagccaacatggtggtatacaagggccacctgtacatcggcggctacaacgatccgatgaacgctttggagaaggccatgcagatggatttctccgacctgtacaaggatctggagagcccggtcaacctgtggcgtatggatgttgacgaagacggcaacgaaaacttcgaaatgctcgccggcgaagccaacaacaagtacttcggcgattccaaaggcaccatcgatggcaataccatgctgtccggcttgggcgacagcgacgagcagagccgtcacctgaaccagtatgtgtggcgtatgcagtcctacaacggcaagctgtacgtcggcaccttcgacatcagtgatcttgcatacccggcaacccagttcgccaacggcgacattctgaagcgtactccggaagagtggaagaagcagatcgaatacatcaagatcttcttcgactctctgaagaagaatgaccagaacggcacttccggtactatcgacacggactctcaggaagcctccaagccttccgagtccgaatctcaggaaaccaccaagccgagcgatgatgacatcatgccgttgaacgaaggcgaagcatctgagagcgatcaagctgcacaggcagttgaagaagccggcaagaccgacgaagtggccgctgacgtggctaccatgcagcagctgctggaggacatgggcgctgatctcaactccaagcagaccgacgtggtctcccctgacggtgtcgctccgcaggccgctgaaacctacacgctcgacgatcgttaccagttcctcgcatccctgcagcggctgctcgacctgtacaacaagaacaagcagtatctgccggaattcattaccaacgagctcgacaagtggcttaccgaagagaatctggagaacttcatcgacttcgtgggcgtgctcagctacctgcattactccaacgatgagactcgtggctttgacctgatcgtctcctccgatggcacgaacttccagaccatcagccgtaacggtttcggagataacaacaaccacggtctacgcgtgttcgccgtcaccgattccggtctggcaattggcaccgcaaacccgtaccatggcactcaggtgtggctgctgaatgatggtgaaatcaagaatgctgagctgacgaatggcgatgcattcgactacgacaagtatgatagcgataagaagagcgccaacgccaacggtctgaccgttggcatcaaccccaatggcaataccgtggaagacgtgcagtacgactaccagtcactgaccgccggcacggattacaccgtggccgatgacggttccatcgtgttgagcagcgcattcctcaatggtcgcgaaaccggcagcaccggttctgtggtggtgttctacaaccagggtgcacgcgtgcgtttcactgtgactatcaaggacagcactccgaacgcaccgaagaaggatgatgacaagcagaatacgaagcctgccgcacacaagaaggcaaacactgccaacaccggttccaacgtaatcggcgttgttgtggtggtcgctgttctggttgtcgcagcaggggcattgttcgtgttcaagcgcaagcgttcctgaattgccagagcctgttcttaggactcattcctaagttcgtccgcatataacaatcccgtatgattcggttcgccggaatcatgcgggattttttattttgcaggaatcgcccatctcacgtcatgtcaaactgccatcacaagctgatttcaatgtgcgatatgcaaccatgtggaagttccgatacgggacccattgaaaatggcacgcaatcctacaaataacagattcaccgcaagccacagcaatgccatacgcagcgcggaagacgcctgcatcgcatcgcatatccaaccaatcgcagcaagacagggtacatatattgcagccgtcgccgtacacgtcaatgcaagataacggtaatcccctgccccaatcagaatgccatcaacagcccacatccaaccagccaacggcaatgtcacgccaacaaccaccataccgacagtgagcaaatgctggatctcaatcgactgagaaaacagcggggacgcacaccatccggcaatcatcaaaccaataccgattaccgttcctccgcataatcctgccctgccagcgattctcgtcaaacgcatggcttcatcctcttgacgggcaccaatctgcgcggcaaccaacgtctgaccggcaataccaatggcatcaagcatgttcaacacgaaattccaactggaattcaccacctgatacgcagccaacacttccacgcccatatgcgtagccagcaccacattcgccaccaggcatgcacgcaacgcaagcgtgcgcaagaacaacaccgcaccatcgccagcactgttcaacactcctgacaaacgcggccgtaaacgggcaccttccgcacgagtccacaacatcgcaggaacaataagcaacactgccatgaaccattgcgaaatcagcgtggccactccagacccaaacacaccccaaccgaatccgagaataaacagcagatccagcaacgtattgagtatcgcacccagcgtagcagctaccaacgtgatgcgaaccttctgcagtccgcggaaaataccgttggccgcatacaccagcaacatgccgggaataccgaacaccacggcacgcacgtagtcaaccgcgttatgcagcacactcccttgggctcccatggccatgcacaacgggcgtgcaataacgaacagcgccacagacaccaccacgccaatgattccagccagccacagaccatcaacgcctgcttccaagccttctcttcgtttgccagcgcccaaaagacgccccacctgcgatgtggtgctatacgcaaggaacacacatagccccactacagtgagcacaatggttgacccgaccgacagaccggcgagcgcctgcccgccaatatgtccgacgatggcggtgtcgatgagcacgaatgctggttcggcgataagttgcccgaacgttggtatggccagtgtgagaatggtgctgatggtggtgcatgatgcgttgtttgcggtatctgtttcgtgagtattctgcgaagttgatgtggtcataatcgtaagcgtctggcgtgttggggactacatgtgcagtgtaaggtcacgtgtttcaccattgccgttgattgctcagattatgactatgcctgttttgcgctgttgagaatgccgttgaaggttttcgctgattgtctgcataaaggtagaggggcatataattcccgaaccgctcgtgacgcatagtccaagctcctgcgagacccattcggccctatccaaaccctagtggattcccgaatccgccttcgcagtaatacttcatgtgaccgtcgaacttagccccgaactcgtcaatgggctaccgcctggtctcaagcccatgagacactaggaaccatgactacagttatcatgcgcaccaccgaaggtgacatgcgcatgatgcttcttctctgggatgcgacactaggaaacagatcactgaagattgttgaaatcccagtcaaaaccgctccaagagccctgaacaatcccgattttcccgaaaaatagaatccccacggccgaaggatagcaccttattcaaaatcaccggcgtaggcaattactctttcttctaatggtttttcaagaagtagagaaagacaaaacaaccgatggccaatggagacaggaaaagacgaaaatggggatgcgtcgtcgcctgcaaagacgcggacggaaggatcgtctcctggcaggcccgataccagagtcccgtcaatcccaggcaaagaatctaccgccgattcggattggaattccagaccgaggcgtaccgctggctcgacgaggagcacgcgctcgtcatcgaccataaaaaggggatccgcaggtggacgcatccgtcggcgaggacgatgcacggcagggtcctgttctcctcatacgcgacgcgtttcgtcgccgacctgcggaagaaggacgggtcggagctgagcggcagaagcaagcggatccagaaggcggcgttggacaaactgctcccctggttcggcgagacgcccatgtgcgacatcaccgaggaattcgtcaacgaatggtacgcgaaggcatgcgacgaggtacgtccctccgcgctcgagcacgcggtctggctgctcaagcgcgtgatgagggccgcgaccgagcggcagccggacgggggtccgccgctattgtcctcgaatccatgcaatctcgtcacgaggaagagaccgtccaaaagacgcgagcaggcgccgatgaccaggcaggagatcgacacgctggtcgagggcttcccggaatactaccgtctgtcgatccatctcgcgctgctggtgggcgggctgcgcatcggagaggtctgcggactgcaactcagggacatcgacctcgaccacaggctgctgtatgtgcggcattccgtgacgcagggtccggacgatctgggcgaataccggctcgacgagacgaagaccccggaaagccaccgagtcgtgcccatccccgccccggtctgccgtctcatcagggaacatatcgacaggttctgtcccgacagggatcccgacacgatgctcttccacgcggtcaggcacccggaacgggtcctgaacccgacgacgatccaacggcagttccgcaccgcgaggaaaagaatcaaccgcgaggacgtgacgttccactccctgcgcgcgacgcacgcgacgatgttcatgatccagggcggcacgctgcgcgagaccatggacgagctcggccatgtggatgtcgacgtggccgtccgatgctaccaacgcgtggtgccgaggcacaggcgcgacgtcgccgaacgactggcgctcgaatatctccccgccggggatccggccggcatcaaggcgcagatagcccagaaggaagaggaaatcgaccagctgcggcagaccgtcgccggactccggagaagactggaagagctcgaagacgacggagacgggcggagccagtccggataagcatacccaaaaccgaaaaaccgaaaaaccgaaataatgaaaaaccaaaaccggtggagaccggcatcaaacggaacaggcccacgcatctaagcgttgcggcatctgccgtcgcaacacttagatacgtgaggcgttatccgaaaatcatctcgacctatgcctgagtttcggcttttcctgccctggaggaacgatggcacgctgataggagtaatgctcgcacacatgttgtctctgtgcgggagacatgtcgtatgccttgttcgccggttgcgcatactcaccaagatgggccagatcattcgacatggtcaacggttctgacaacggcttgacgattctcctgaacatatcctcaaggggacgcaggtcgtttcgttgcatccccgcgatcgaggcttgatcgttcgtccttttgtcgatgagtccccaatcaaaatgccagccggcctcgcgcgcgatgatctcccagaaaatgcgttgcgtccgcccgttgccctcacggaacgggtgaaggatgttgaagttgttgtagctgacgctcagacgcttcacgaattcttcatgaccgaggcctttgaaaagatcgtcaccgcgaagcaccccctcggagtagcgaacccctatgctaaacagctccaacggttggaagggaagcccctcgcccttgcccatgtcgatggttcgtatctcccccgcccagtcgtacacgtcctggaagaggaaccggtgtatacggcgaagctgttccagcgtcccctccgcaggtgggagattctctctcagaatggcggcgcgggcggagcagagatcgttctccgcagccgccagcgcatccttgtccgtggcgcccacaaggttccgcagcacgttcgttcctggaatcaggtagggatcgaagacacgcgccatcgtcactccaatccgtaacggcgacgggtgcgggaaagaagctcggcgctgccgatgctcccccgcgcatattctccggcatcgcgtatgaaggccctcgtcacgtcaccgccttccagccgcacggactgcaccgacagtccgacgttctccgtgcggcggcgcatctcggattcagatatcgttccgaacattgcacctccttttctctttagattctagcaaaaccgacggcccttagacggagccgcgcctgattccgctcctaaagtccttcattccagtcgcaatcctttcgccagatgccacgcatgacacgtcaggcacgccaccgcaccgtcatcgcccagaaggagcgtcagatcggcaagctccgggacgaggtggaaaggctcaggaagatcctgctggaacgggataccggaaccggtgaaaaccgggaaaccgttttacctaaaaaccgaaataccgaaagaactacataccgaaaaaccgggatatggaaacactggaaaaccgagacaaggagaaaccgatgaacgagaagaccctcgaaccgatggtgatcgcgctttgagactgcttatatcgttttggacggaatgagcgtcaatcagaaagttatgtatgatggtttcgcttatttatctcggtaaggagaatcccatctcatacaagacagtattcggcatggacgctttcgatagacatgacaccgatggaggaaaccaaaccgcggattcagccagcgatataaaggtgtatcctgagtccgcttcgggatgtttgattaacgacttgggcaagttgctgaatatgaatccggatttctatagacgacggatccgccgcattagaccggctgcgattgccgtcgggctgagcgccatttgcctgattgccattttcttgattccaagtgaatcgaatccggttttccagaatttcttcagcgcactgtttggtttcttcctcgggttggcctcctcggcatatgagaagttccgcaaatgggccgaacgagtcaatcagaccatgaaagacgctgaaggaagtatgccgatatgggaagccatatataagaattccatattctacgatgaatgcttcataacgcttccggcggcacgcgtatccccaacctgggcacaaagagcatggattaaaatcaggttcccctcattgtcgcgcaagtggcataagtattttcgcaacggaatggctgaacctggtttgcagccattatccaatgagaggaaacgcagaaagcggcttcattacctggagtcgctaagccgatgcgtcttcatgctcgaaccgtatcaggcgactcttgattatctactggactattcggataagatcctcggggagaaaattcgtcaggataaaatcctaaagggatatcttcagcctgtcgaaggaatctacatttaccaaaaaaatgtaggtaaatgacgcatgccaagataccggaatacggaaataccgaaaaaacgagataacggaatcggtttcagcccccggaatccatcaccgtacgccccttaccgaagagatggtcgaacagcttctggcgaggggcagaactgtcaacagcagcaagcaccagaccatgcttgccatcgctgccattaaaaatgacgacacggacgacatcgtacagaagaaaatacagatgaccgcaaagttcgtggacgacttcgcgacggttgccaggacataggcgaacgggcagtcccagcccctcgctcaacgcctccaccgtgatgatgaaccgtatcggacattcctcggacatgagatccacgtctttgagctcgtccacgttgccggtgttgtatggaggatcgatgtagatgcaatccactttgccttcgtattcgggcagcagggccttgagtgcttcgagattgtccccatggatgaccatgttgccgcaatcggatccatgcgaatccaaaacgctcttttcagggatgcgttcgagtacacggtacggcacttgagggtggtatgcgaccaccttgttcttccccatccactccaagtcggtgctttcggcctaatggctcatatggcacccaggaccctcgtgatcaattccggcactcttgccatccccgtcttgccgggcaaggttctgccgcagcgtgtcgccgaacctgtccaacagatccgttttgctgcgaatggcgtccggcttccgacgcaatccctcgaccagttcgatgaacgcgtgttcctcctgttccacgcagtcgaggaacacgaaacagaacgccacgggatcgccgtccacctgccaggtctccagactgcgggcatagtcgcgcttggcgtcatacttgatcgccacgggacgatagccgtgcttcagcagcatgaaattgagcagctggcggccggtccgcccgttgccgtccatgaacggatgaatattctcgaacatcgcatggaagccggcggccctgagcagcggatgagcgccgctcgcgtccagcccgtcgatcagggcccgcaggtcgtcgcggatctccaacggatcggcggtcttgacgcgggtcgcggtgatcctcgccagataaccgtaggggcggaacgtgccacgggcgaacggctgcaggtccagcgcagtcacctcatggacgcgccggaccagttcctcatccagtctcctcccctcccgggcgtattcgcgcacgtaggccatgccatccgcgacaccgcgcgccgcgaacacgtaccgcgccggcgaatccgacgggacgaactcgccctccaaaaccagggacgtgtcctccaaggtcagcgtggatccctcgatggcgttcgaattgtaggtgtagcgcaccagccagtcgcggtcgtaatccgccagcgccatgccctcgacgccgtccagggggtccagtgcgcgggcacggtccttcagcgcgtcgattcgtcgcaggcgttcgacgattcccagctcgcgttcaaggccgagcagttcctcgggcagttcctgtatgcgctgcgatagctcgggattggccatcatgtccctcttttcgtgttccggttgcaaagtccattattccagccgcggttcgttccgtcctgcggcctgcatgtcatagggaggcgcgccggccgtcccgggtcgattcgaacgccgcggccacctcttccgataccggcatgcgcatcgtcacccggccggtttcctgcgcggcggcacgtttcatggctcggcgttcggccctggtgggccgttcgagaatccactcggcgaacgcgcggataaggatggacgcgacgatcacgccgatggatccccagaagcacgggacaaagtccggcttggagtggtcgtaccagaaccagacaatcaaagcgaggatcaacgccaggccggcggccagggcggcgagcttgtggaacacgagggcgagcgtgcggatgggatgcgtgaccagccccaccgccaacgcgacgacgacgagcagtgagacgaagcccgcggcgatgatggcgacgcccaggtatatcgcgagcatatagagtccgaacatgatcggccttccttctctcttctattccgtttcttcggacagataggtgtagtcgacggcgacgccctccgcctcaagcagcacggcggcctcgcgcacggcggcggcgcggcgcttcacggattcctcggcccggacccagtcgggcagcccctcgggcaggtcggagacgcgggagaacgagagcacggcccgctcatctcccctgtgccgttccacgatggccgcgacggcgcgcctgtgctcggcgagatagtgttcgagcatctcccgcatcctttccgagggttggatccggtatttctccgactcgtatttcttgaccatgtccacggtgaggttcgcgagcacggccgcgtcgtgctgggtcatgccgatgcgttcgcgcgtcgcgcgcatccacgccttggtctcgctccaatcctcttccgtcatggtccctcctggatataagaaacccggatccgcctgcgcgaaccgtgattatacttttagtataatcacggttttcgacagggcggacccggcgtttcccgggtcacggccgcggccgtgacccgtttcgtcactcggactgtgccggcgagttgccgtcggcgtcggctttgcgctgctggtcgagcatctgctgctggatcaggacgcgctgcgcgctcatcgtgttcgttcgggcttttgtacatcacgcgcatgttgctcgcggagacgctggtcttgagccagaagagcaccacggacgggctgaaccggtcgccggtgacgtcggttctcccccgtcgcgtaggtgaattcggtcatggtctgctgtgattcggtcattttcttttcctttccttgttgtcgttgaagtcaaatgcgatgcccttgtccttgtcgatgaggagcgcggcgtcgaacctgctgcccttccttgagatgaagccctcgaggctgaccttccggccgacgagcaggccgcgcatggtcgtgtcggtgatggtcttgccggccacggtcgtccaggcgctccagccgcatccctccgtggtcttccatgtgccgtcgggttgtttctcgcgccggttggtggagcattggaacaccttgcccgttttgacgacgggcttgccgcatcgtgggcatgggccgaacgattccgtgttccgtttcctcgtctgcacatggtcctgccggacggcggcctgggcatcggccgggatgccggcggcgaggtcgcggaactccgtttcgacctccgcggcgtccgtctgtccgtgttcgacctccgaaaggcgtcgctccatgccggcggtcaatgccacgtccttgagcttcggggcgaccacgtcgatcagggatcggccctgttcggtggagcggagctgcttgcccttgcgttccacgtatcctgtgcggatcagcttctcgatcacgtcggcgcgggtggccggcgtgccgatgcctccggaatgggattcgtcgtcgtccaatgcggccttgagttccttgtcctccacccagcggctagcgtgctccatcgcggcgagcagcgtcgcctcggtgaatggcttcggcggcttcgtttttccctcggacagtgtcgccccgccttgcgggaccggcgcgatggagaccccgtcggtgaggttcgcggggatgatgttgtcagcggcctcgtcctcctcgccatggtcctcctgcgggacggcatgctcgatggcgtgccagccgagggagacgggctggtcggaacggctggtgaaacggcattcgccctcgggcagaagtcgaccttcgtccggatgcttctcgcaccaatgcgggtcgatgttcgcgacgacgttcgtcacgtcgtgcacgtagtcgtcgcccacggcctcccacatgcgtcgcaccacgcgcgtcagcacgagacgttcgtcgtcgccgagctcatcgagcgccgccttgtcggcctgcatggtgggaaggatagcggtgtggccggccaccttcgcgtcgttcacggtcagttcgagatgtggccgttcaggtttcgcggacggttcgatgaagccggcggcgagccggtcgccttcggtgaggccacgcagcgtgtccaggtcgtcgtgcgtgatgtactgcgagtcggtgcgcggatacgtcgccagttttttctcatacagggattgcaaggcggccaaggtgcgggcggcggtcaggccgtgcagccggctcatgtccttctgcaatccggtcaggtcgtacaggcggggcggcgcgtcgtgctgctgcttgcggtcggccttgaagatcgagaaggcgaagtcgtccgagttgacgatccgcagcagcgtctcggcgtcctcccgcctgtccagtcgttcgccggccagcttccatccgcccatcggggcgacgaccttccagtacggtcgggccacgtagccggtaatgtccctgtcgcggtccacgatcatggtgagcgtgggcgtctgcacgcggccgacggtgaaccgcgcgttgtagacgagcgaataggcgcgtgaagcgttcatgccgatcagccagtcggccttcgcgcggatcatcgccgaatcggcgagcccctggtattccgtctcgtccttcatggacgcgagggcgtcgcggatggcgtcctcctccaggctcgcgacccacaggcgtcgcatcggcttggagactcctacatgcgtcacgatccgacggaagatggcctcgccctcacggtcggggtcgcatgcgtcgacaagcatgtcgacgtcgccgcggcgcatcagtcctgcgacgaccttgtactggcggtctgcgcccttgtcccggctgaccttccattgccagtcgggtgtcgggtcgatgggcagcgtgtcgaggctccactttccccagtcgtggttcttgtattcgtcgggcgcggccaggtcgacgaggtgtccttgcgcccaggtgaccaggtcgtcgccgacctgcacatagccgtcgtgcttttccatgtgcccgccgaccgcctgggcgatggcctggccgaccgagtgcttctcggcgatgatcagtcgcatctcgcatcacgtccgatcatcagtagttgccggacgcccatgcgggccgtccgtcgtccgaggtgtcgggttcggcggcgtccttcggggcgggctcgtcgtccgcctcctggacgtcggatccggtcgtctccggatccgattcggcgacggtttccggttcgggttcggcaggcggggttttccttccgcccggtgcggcgacgagctcgcccttcgcgtcgaacgcgatgttcttctcagttccggtcatcgccagcttgtccgcgatcatcgtccggctcatgccggggaacgcctcctcgaattgcctcgccgcgtcgcgcagcgcctgtgcgcttttgcggaagttgtcaagacggctgtcgaacttcttcgccgccgtctccttgcgtttgaacgactcgcgttcgtcgcgcaggaagtcgtccacgtaatcggatgccatggtccgtttcctttccagtcttgttttcatcggttcccggtttcgagccggctggaaccatggtcgcgcgattggacacgcgccggtttggacagtcggactccgtcaggatcacacgcttgtgatcctggcttcgccggaaacggagcgcggccctgggccgcgcgctatcttcgccgacccttccgggatttccaggcgtcgacgcctggaagggaacagtcggccggccatggttcatcatcacagccccgcgcccgcgtcttcggaactgcgtgttccatgctccgctccgggagggcttcgcccgattatcccgaagcgggcacggcccacgcgtcctccaccgcgcggcgggaccgcgaggctgccccatatccggcgaaaggaaaacaggaacgccggcgggacactaaggagtggaaccatgcagatggaaccgatggaattgcagcacaccgtcttcgagaccgacgggggacgaatcgacgcgatgtggagcgacgtgcgtctccacgcgggcgacatcatcacgcccgacgacctcgacccgctgctcgaaaggaacgggtggatgctcgtcatcagggactggtggttcaccgacgagccgttcgggcgcgcggaatgaaaggagacatggacatgaaggagaagaacagggccgaggaatggttccgggccaaacacgacgagctcgccgaaacggcgcgtgccaacctcgccgcacacgacttggaacccggacaggaggcctaccatctggacagcctccattatgcgaccgccgaacagatggaggccatatgcccgacgggcatcgacttcgaccggtacgcgactctggcgaacggcagcgtcggatacgacgaggccgacgcgcattgggccgacgcgggatggtgggacgaacaggcgcgagccatgtgggacgaggtcgacgacatccctgacgacggcctctactggacaagcgtcgaagactaaaacgtcatcgccgttcccggccaagtgacgccccgggaccgatgccgcccgcatgacgcgggcggcgcctccggcggccagaggacgactaccgtcctctggactccacgcgccgggaaccgttcccggacccgacagggcgtcgccgtggcacggaggccacgtctcgccgacgggaaacggagcacggcaccaatgccgcgcgcatcccgaggattttcttttgaccggccggctgacgccttgatcacagcggcacgcggaacccgtcaacgcccgcgcagcgaaacccgtggtttcgacgcgttctcatgacggaacccgctaccaccgctagcgctttcacttgaccatccggtcaaaagaaaaatatcctagaatggaagacaacgaaaacaaggaggcggacatgccggtcatcagcatgttcttcggaatcatcatcaccatgaacgcggacgaccatgttccgccgcacatccacgccagataccaaggacatgaagcgtccttcaccttcgatggcaatctgctcaagggagacctcccgcgcaagcagcgcaaactggtcgaggcatgggtgctgctgcatgccgaagagctggaagccgactgggagctagccttcaacctcgagcacccattcagaatcgacccgctacgctgacaaggaggcaacggacatgaccatcgactattcaatcaaagtgacccaatgcgagcccatgcccggctacaagctcaaggtcacctgctccgacggcgcgaccggaatcttcgacatgtcccgatacgtcgaccgcggcatgttcaaaccgctcaaggacccgcagacgttcgaccgcgtgcgactcgcgttcggcgtgccctcatggcccggagacatcgacatcgccgcggaacgcgtccgctccgacatgcaaatcatctaggaacccgcacacccctgccccgaccgtcatcaagacggccggggctttttcatgcccgtatgcatgacggacatgacgcgccaccaacgacccaccggccccgcgattttttcgcggggccttttcatttcccgcgctccgagtgtccaaacccgccgctgtttccacgacggacgattggtgtaagacaccggccattccctcaaggccatgggcgaaaggagcaaggagtgaacgcgattatccttcacggcattccgcaatcatgccgtgcgaaatcgctcccaatcaatgaaattgatatgggagtagcaagcgacgtgattgtagctacaatcactcgattcgcgatgcgaatcggcttgccgggaagacccatgccccatagtcggcggagcctccagaccgctcgcgcggcatcacagaaaacccaactccgcacctccaagagaggtgcggaatgagctgggcagcaggcagagatcggaacatctgcaagcgaatcacgttcactcaggacgagtgggagcaggtgcggaatctgtatgaggagctgaccaggtacgcgccggagcaccggtcgttcagctcctacgcgcgcaggatgctgtccgaacgacgcatccacgtcaccgagatcagaccgttgacggaccccgagccgatcgcgcgcgagatcgaccgcatcggcgtaaacgtcaaccagatagcccactgggccaatgcgaacgagcacatcacgcccacccaggtggaggagatccgcgcgtcgttcgaccgcatcgagcagctgctcggcgacctgttcgccgacaggcgcgaagcccggaaggacgcgtgagcatggcggtggtcaagctcggcaggcccgtgaaatcgaatctcggcggcgacaacggggcgatggcgtacatcatcaagcccgccaagaccgacggcggaagactggtcagctcgaactacgagcggaccaggacggaccacgacgcactggccgaaggcatgctcgacgacaaccgcaggtcgccgcaaggcatccggaagaacagccggctggcctaccacatcaagctcagcttcagtcccaaggaccccgtgacgccagagcaggtgcacgagctcggcgtggagttcgcgcgccggatcaccggcggcgaatacaagttcgtggtcgccacgcacaccgaccggcaccacctgcacgaccacatcatggtgtgcgccgcatcccggtacgggcagcatctgaaggccgagctgcccaaggacatcatcgaccagtggcgcgcggtcagcgacgagatatgccgccgcgaggggctgagcgtcgtgttcaaccccgtcgtggaggaacagacgcgcaagatgcgggacggtacgacagccgaaggcgacgacggaacgtcgccggcgcgcgatcccaaatacgtcgatgaagcatccgtgcggagcgcgaacgaaccggagtcgacggcgcggaaggcctcgggcggggagccgttggagcgccggtacggcatgtcgatggaggagatctacgcggccgcgaagggcatggggaccaaggaccggatccgcatgctgatcgacttgacctcgtccacggcggagaacttcgaggactggagggacatgctcgacatccgaggcgtcggcgtcgaggtccgcggccggcacctcacatatacgctcaaggacaccggcttcaaggtccgcgacgagaaactcggccaggcgtacgacatgacgaacatcatggccggattgcaaagcacgcccgtcatccccatcacgttcaaccgccggctcgtcgccaaacagaccaggaagacggtcaccgtgtggctgccaggcacccaccgaaggaagaagatcacgttcgacgcgaagcgtctcgtggacgacggcggctccacgctgcgcgcgttccttccccgcgaccgcgaccagatcatcctcgacccgtccaaccggtacgccggcaagaccccgacgaccggcctctaccagtggttcggcgagcccacgagccggctcgaaccgcagaccacgcccgaacggctgcccctcagatacggggtcagcccggcccagcagcggtactaccaggcgcaggcgcgccgcctcgaccgcctcgccggcgaggcgaaggcgttgaacgcggcgatccgatggacccgcctcgcgggcggcgacagcgccaagggactcaggctgctgcgcgggaaggtccgcgaatcgcacgacgagctccaggccgccgtcatcgctttgcacgacgcgatccaacgcggcgaccccgacctcgtggccgagacgcgcggcgagatggaatgccgcgaggccctgtgcgaccggtacgaggacgagctgtccgccatcgaacgggagatccacacgacccgcgaccgcgagcagacggagaccgagcagcgcgaacagcagcacaagcgtggacggtccatctgaaccgtcccaggaaacaccaaccgacaacagaaagggaaccgcaatgccaatcgaggaacaggctgaggagaagatccagaacgccgtccagaccatcatcaccggaggcgcgaagctcatgctcagaatccccaagggcgtggccatggcgatgctccgctccggtatgaagctcgcaaagaccggcgtgcacgccgcgggcgcggccgtgaaggacgggatcgacagcggcgagatgtccgagaaacgattgcagaggaagaaggacggcgacctgcacgagctgcaactcgacgactcgaccatgcgcgaggtgcagcgcagcctcaagaccgccggcatcgactatcacctcgaacgcactgaccggggccagttcatcctgcacttcgccggcagggacgaggatcacgtccgccacgccgtgcaacgcgctttcaaggacatgggactggacgtcgccgacgaagacttcgccgtcgagcagacggaacagcaggaacggacgacggaacggacccgcaacgaaccggaaaccccggcacgggagacgcccgtcgaaccggccgcgaagcccatgccgccccagcgcatcgcatgggacttcgtggatccggaggtcatggagatggccgcgaacagcctcgccgcccggcatcccgaactctcgtgggacaagctcatgggcgacacgacatggaacgagcagaccggccgcgatttcgcggaccggatcatcggcaaggccgccgccccgagcctgcgcgacgagctcgacgccatcctgcgtgacgactacgggcagggcgcgcaaacccaggagcagaaccgtgcgcagacgcccgagccaagccgggagacgccggcaacggagccggaaaaccaaccggaacccacgccggccgaggcccgggcgcaggccgagcaacagcagacacaggacagagcagacaatcccatgccggccggcaaggagcaaaaaccgaagccgatccggtcgaagaaggcactgctcgaacggttcaagacccgactcaacgagaacctcgccgaacagaagaaccacatgccacccacccagaacagggaccgcacgccccgcaagggccgttgaaaggaagccacaatgaaccagcaggaacaggcgacgaaaagcgccgcgatcttccaggacaccatcaacgggaccaacgatccgacaccatggccggtgaccatgtgggcctcgtccggcgacacgatatggacggctggcacggcaaggacggccggcgaggactcggtgggcatgatctacggtcctggcgacaccatcgttcaccggaacacgatcgccggcgacaccacccgcgccaccgaatccttcgccatccgaccggcggacgggcagagcccgatggacgcgatgctcgcgggcatcgaacagtggaaccaccgtcatcccgaccggtgggacaccgtggccgagccgggccggtaccgcatgacggatccgacgacgggccggccgctcccgatgggatggagcgacagtctcgccgtggccgcgtccgcggcgggccgcctcgaccccgacctgctccaagccagcctcatgcagaacgcggtcgagcacgagccgcgcccctgcgtgttcttcctggaggacaacggatacgacctcatggtcttctcctggcaccgaaaccagcagggactgttcgacgcgatgaccttcaagcacctgcaatacgacgacctgagcatgcagatcacgaccatcagccacagcgaagacatgagggaatccttcccagcgaaaagcatgagcgacggcgaactgctcacccaaagccgcgtctaccgggacgaataccagcactggcgcgaacaggacggcggatccgtcgcccagggcatgaccggccgcgtcatgcgcagcggactgctcaaaccgggactggagcagaagccgctgctgaacctgaacgacggacggcgcgccccggactgggacgagttcaccgaccaggccgccatctcgatcctccagggccgccccgtctcaccgacgccagcgctcccccagcaggaacagccagcgcagtccgccgaccccgccaccgagacgcagacaccggcctggacggccgcgatggcgaagcaggtctggccgaacgcgtgggtggcgaacaggctcgcgcatacctatatattgcgcgcgaaggacggccgcgactggccgaagatgatcgtcggcctcccccgcggcaccgtcatcgacggacaggacctgaccggctgggccaccgacatgttcatgagcggaaagaaccagaggcagaagaacgaggggcgggcagtcaacctcagattcaaaccagacaccccggtcgaactgttcaccggccgcggcacggaacgccgcaccatgcaggtcgacccgcagacgctcgtccagacgatcatcgacgcgcagaaacgcaaccgcgacgccgaggagacgctcgacacggcatcggtggaactcgccgacaagaccgtggaggaatcctggccgcaaatcagccgcatgcagggccggttcacggaataccagcgcgctggcacgtacaagccggccgtcgcaatgaaatgggcgcgccgactcgtcgaccggaccgccgaaacggacgaaggacggtggaccagccgccaacgccgccaggccgccggactgctcatccaggaactcgccgccgcgcaggagacactggccgaaccattcgcccacgaggacgaataccggcaaaaacaggccgaactcgaacgactgacgtccaaacccgacgagacccgcgagacggaaggtagagaccagaaaaccacgcaaaaggaaaggagcgagaacatgccattgacccaggaaaacgtcagacgactgctcgaacaggaccccgacatcaccggcatcacccaaggcggcaacgccatgggcaactacctcgaggcaaggctcacggacggacgcgccgtgcagatcgacttccacgacaaccccgcatggaaggacacggaccgtctggccggccggatcgaggtgtcctacgccaaccgcccacaagcggaatggcaatacgacgacaacgacatggccgaccgcgaacacaccgtcatcgacccctccgaccccgacgcggagggaagactcgccaaggcggtgaaggcgagggaggacgccggatacctcgtgacgaaggtcgaggaggatccggccatactctacgagcggcaccgcaaggcgtcctgcctacacgcgagccacatcctggaacgatacgactcccccgacccgaccgcggtcgggatcctccacggcatcgtaagcgaggtcaacgctcacgaccccgagaacgacatcgccgcctacctcacctacccgtccgacaaggcggtccagctcgccggcgacggtctcaccgaagcggacatcgcggagaaacgcgagatgggcggatgggacccgcggacggacccgctcatgcgcatcaacgagcagggcgactggacgggcgtcacccaacagcaggccgaccagctcgtctgggacaaccgcgacgagatcctcgcccgcgcctcatacgacagtgaactgtccacgtggacgctccaccagctcgaccagctgaaggagccccagccggcccagagcctggaccgcgaccggccggaaccggatcgcgaagcacccgcacagacagaatccacgacaaagcgtcgcgggccaagactgtagatcctctccagccacgggcggcgcgcttccgcgcagccccgcattcattccacacgaaggaacagaagacacacatgacaacagaagcaaacgaccagccggaacccgtcatctggttcgagggcaccctcatcagagatccgcagccgcacggaggacaggacgactggctgctcgagacactggccgacgccgacgggccgaagatcaccatccatgccagcggcgaggatcactcggcgaacatccgcgacaacgcgcacaagggatctcgcctcatggtcaaaggcaccgccggagacgagggctccggcatcgatatcgaggccacaagcctcgcattcgaccccagccacgacgagccggacggggagcaatgacacggaccaccgtcagcggcatcagaccggacaagaccggcaccggcgaatggatcgacatcaacagtcacgtcggccggctcatgtccacgatcatggccggcggccgaccattcagcatcgacgccgacccggccggcatgaccatcgtcacgcccctcccacccccggcagccggcccggacacggaagcggccggcgggaacgactccaagaccggaacggacccggacgaagggcggatcaccagcaggaagacgctgtacgaacggttcaagacccgactcaacgagaacctcaacgaaagaaaacaatagaaaggaacaaccatggaacgaataagaggaatcgccatcaagacactgaccatcctcgcgggattctggctcgccgacctcgcggccacccgcgtccaggccggcatcacggccggcgaaagcgtggaacggatcatggacgacatgacgaccatgctccagcatccgaccgccctgggattcgaccggaccagcctcctgtgcggactgggcggcgcgtgcgctgtcggcctgttccacctctaccggtggagcacgagccaacgcaactggagggacggcgaggagtacgggtccgcacgctggtccaccagccgggagatggccccatacaccgacaacgacaccaggcagaacctccagatgacagccaccgagggcctgagcctcgacgcccaggccacgcgacgcaacctcaacaccaccgtgatcggcggatccggttcaggcaagaccgccacgcacgtcatccccaacatcctcaagggcagcatgaactacgcctgcaccgacccgaagggcgaactctacgcgaagaccagcggaaaactgaagaagatgggctacacggtcaaacagctcgacctggtggacctgaccagcgagacgaaattcaaccccatgcgctacatcgaccccgacaagcccgacgtggcgatcatgcgcctggtcaccaacatcatggacaacaccaacggttccacacccaaggagcaccagaccgacgacttctggaccaaatccgaacgcagcctgctgaccgcgctcaccgcgttcgtctactacctgcccgacgacatcctcaaggactgcctgaacatcgacgcaggccagaccctcaacgcggtcgccgacatgcgcgatctgctcgaagccagcgaacaggacgagaccaaggaaagccaggtcgacgccgtcgcccggaccgccacggagatctatgaggagacccgcgccgaatggaatcgcgacggcgcggaccacgacgatccggacctgcgcgaggcatggcgtctcgcccagggcctgaagttcgcggcccgccagtacaggcccttcacccagggcgcgggagagaccaagaagggcatcatcatcagcctcggcgtgcgtctcgccccattgacagtcggcccggtccgggagatcctctccgacgacaacctcggtatcgaccggatcggcggatatgcggacgagcacaagggcggatacaagcatcccaacgggaagacggccatcttcctcgccctgccagacgaggaccccaccttcaactttttggccgcgatcttctaccagtgcctgttcgacagcatcatccgccgctgccgcacctaccccggcgaatgccttgccacaccattgcactgcttcctcgacgagttcgccaacgtgggacgcatcccgaacttcgacaagctcatcgccacgatccgctcgcgcaaggtcagcgtcagtatcatcctccagaccatcgcccagctcaagacgatgtacaaggactcgtgggaaaccatcgtaggcaactgcgactcggtgctgttcctcggcggcaacgagcagtccaccactgaatggctcagcaagctgctcggcaaggaaaccatcgacatccgcaccaccagcgactcgaagggcgtgtccggcagccacaccaccaactaccagcgcaccggacgcgaactcctcacacccgacgagctcgcgcaattggacaacgacaaatgcatctacagcctgcgaggactccacccgttcctcagccgcaaggcatggccgggaaccgccatcgccagaccgaaatccacgctcaggcactccaaagaatggaaggcagcggcatgaagcccaacagctacacctttcacgaatcagagccccggatcgctgccaggcaatccggtgcccccgtctgatggcgtgggcacggaccatcccggcgaggctccgcccgtattggtggaggacgacgagcctcccgaagacgggcgtcgtccggttccggaaccggatccggaacttccttgggattgcgattggcttcctcccgaatatgagggcgtttgccgctgtggagccgattgggattgcgacgcctgggcctgctgctgcgcggcggcggcagccgcggccgcttcctgttctgccttggccttcgcctccgcgtcggccttttccttcgccgtcttcgattcgttgacctctttcacggctttcgcgatcgcatccgcgtcacgggtcttgaccgccttcagcagggtctcccgggtcttgtcgtccgccaccctgccgtcggtctgcttgtacagcgcgttcgcgtcgtccacggtcttgtcgagcttgctgtcggcgacggccttggttgcggccttgaggtcggtgagacggttcttgagctctttggtcgttctgtgcagcgacgccgtggtcctgtccaggtcggatgtggcggcgtcggacgcgcaggaaccgctgatggtggtcgtctttgcgcccaggagccggttcaacgcatcaagggtcttgggatccgcgacctggccgcgactggtgcctttcaatagtttggaggctttggccgtggtcctgtccaggtcggactggatggtcctgcgtgtcgcttcggccgagtcgcatgcgctgattgcggtctcatgcgcctcttgccgcatggcggcgacgtggcggtttttgatttgcagtcccatccaggacacggctatgaggctcgcggccatgacgatcgcgacgagcgctttcccggccgggaagacgcggcgcaccttcagatcgtcgaggtcggccgagtaggtgacggccgccgacagccctcctggtctttcggtcttcccggtttccgtcggctccggttccgatatgggcgggaggctcattgtggttggctccggggcggcgacctgttcgagcgccgcgaaatcgccgtcggcgtccttcagggccttctccgcggaatcgtcgggatgggactgttccggctcggcggtccgggtctcatccacagattccatagatgccggcacgggttcctgccccggctcgtcttccggcggcagcggcgcggacggtatggcgacgcgacggcggccgcgcatggacgcgggcggcagcggcgcggcaccggccgtgtcaaagccttgctcctgcgcggtatgccaccattcggcgagctccggccacgcgtgtggatgttcggcgatcaggcgcatccatggacgccaaccgggctcgttggccatggcgtacagctggtcgaccgtaagcttggggctgagaatcggctcacccgtcttcctgtcgatcctggtcattcctctccgccctcgtctttgatgaggactggctgatcccgttcgtttgccctcatcacttttgttcctctggtttgccttcatgcacccggtatccgccttccaatgggcccttgaccgccgcgcatcgccagccgtcgtcagtgagcgtgtagtcaagcacccaggatgcctccagcccggtggatacggcgcatgtcaccacccgccgccccatggacacggggaagccggtgaactcggtctcgggcaatggctgcggggctatggatgatgccggtatgtcgaggccggcggcatccggcgtgaagtattcgccttcgagttggcctcgttcgtcgcccatgtagacgccgagcgctttcggcgcgagatcggcgcacggatcatcctccgtcggcgtcgccggctcggtctcttcgtctccagccgttttttgtccgggttcggttttcgttcgcggccgggcgacggtgctttgcgtgtcctccgcggttccgttgccggcgcatatcaccgcgacgtttcctcccaggatgaggagcgcgaccgcaaatcccgtcgcggcgatgatcctgttcctctttggttccatgcttggttttcctttcaatggatgtagcggacgccacttccggctgcggccagttgggaggcgctgatttcgcgtgtggatacgacgccgaggccaagcacgttggactcgctgatcaggatcgacccgtccccgcggacctcctcgaccatggcgacatgcccgtagccggcggacgcgcccaatactcccggttggaacacgatgacgctgccggcggatggggagccgtccaccgtgtagccggccgacgccgcggaacctgcccatgtggcggcgttgccccaccctggtatcggttttcctatgtcggctcttctggtcgcggcccaccaggtgcactgcccccatgggtatctcgtgtccggcgtgatgccggccgtggacacgatgccgccggagaccgtcagtttcggttcgagggagccgaccgtaccaccctcggcggtccccgttgcggtgtatttggtcgctgcaagttccttgatccgccgcacatagttgatggtttcctcgaagggcggcaccatgccgtatctgagcacgctgcccaggccagcgttgtacgccgcgagggtcagctccaacgtgtcgccggtcagtttcccggacttcttggccgtctcgacctgcgaggcgaggccgcacatgtagttgccctggctccagatcgcgtcgtgcgggttccagatgtcggccttgccgtctccgtcgccgtccttgcccgcggacgcccaggtggacggcatgaactgcgcaatgccctgcgctccggcggagctgccggccttcggattccaaccggactcctggtcgatctgggcggcgatgacgcccggcgtgacgacctggcagatggatccggcgcggatcacatcggcctcgtattccgcgggcacgcccgagaccgtggattcgctggcgctggatcccaggaacgcgcccatggcggccagaagcacgccgagcaccgcgagcatggccgcgatgacgggcatgatgggaaggctgatggaggcggcccccgctatggctcgggatacgctcgtgcgcgcgaagttcgcggcggcgcgggcggcacgcatggcggcctgtccggtggctttcacgctgcgtaccgccttgacgggcgcgcggcgacgccgccagatgaatttggccgacgagttgacgcccctcacgcctgtgcgtgccgctttgaaggacaggtcgcgcgtggcgcttcccagcttcgacgcgaagtcgtcgtcggcagcggtgagcctcgcgccggtcttgtccatccagcccatgccggtggatcccatccgtttgacgccccggcctgcttttccaagacctgcgcctatgcgtttgccgatccgccggctcgccttgcctttcgcggtgaacttgccgatcttctcactgggcttcgcctcggacagcaccttgggtttaccgaccgccttgcgcatcccattgcccgaccgcagggcgcgtttgccgcggttcatgacgcggcgcgccctgccggccgtccagcccacgccgtgcatggtggaggacatgccgtatatgccggcgcggcccgccatctcggcggcggtgtggcccatggaatcggcgatgtcggtccggtccgcaccgaactgcgcggcgctggacaccacgccagtggccgcgcgtccgatgcgggcgcgcgtgcctccggcgtggtgggcttgggttccgctcatgcgtttactttccttcctggaaggtcgtggaatacagacggtagaggtcgccgcccgcggggatgcgaccgtcgaacggcacgtaagcgctgccgatcttcatgagtccctggccgggcagcacgccggtgaagtactgacgctgctcctcactcagggtcagcagctcgcacagggcgtccgcgtcggtgctgttctggctcaggagcatgaggaaatcgctgttggacagcatctcgcgcgcgtcctggaggtcgaggatctcctcgacgttctgcgtgatgccggtgacgccgagcccgtatttgcgggcgcgcttgtagatgtccttgaactgggcggcggcgtactggttggagaagaagcggtggaactcgtcgacgtacagccaggtgcgccgcccgttggccttgttgcggatgacgcggttccacacctggtcgatgacgaccatcatgccgaacgtgcgcagctcgccggacaggccggacacgtcgaacacggtgaaccggttggacaggtccacgttggtctgcccgttgaagccgctcatggagccggtgatgtacgggttgagcgcgtcggcgaggtaccggctcacctggtcgccgcccgcctgcaattcgtcgtgcaggtcctgcaatgtgggctggaccactcccccgccctggttgcggtagcgcgtgtacaggttgctgacgcactggtcgacgagtcccttctggagcgggtcgaggccgtcgatgccgcctatgagcgcgccgatcatggagaccacgttgttggtcttgtccttgacagggtcggaagccgagtcgtcctccaggacgatgtccatcgggttgacgcgcgtgccggtgccggcgctgatctggatgatctgtccgccgaacgcggccgcgagggcgaggtattcgcgttccgggtcgatgacgatcacctcgtcgtcacggttgaggaacatgccggcgatctcctgtttgacggtgaaggatttgccgccgccggacgtgccgagcacgaatccgttggagttcatgtggctgcgccggtccgcgaggatcgggttgccgctcctcgcgttgcttccgtagaacagtccgtgcggctcgaacacctcctgcgtggtgaacgggatgaggatggccgcgctgttcgtggtcagggtgcgtttcatgggcagagggttgttgcccagcggcagttcggcggtcagtccttccatctgcatgaacttgaggctctcggccgtgcaggactgcgcgttgaccttggccttcacgttcctgcacgcgacttccagctcctcctggcttgccgcggacactccgatcacgatgatcgagtccacgagcctctggttggtggagcgcagctcgtcgcgcagttggccgagctgttcctgctggtcggcgaggtcatcgggaaggtcgtcggggtcgaggccctgtttgcggttcttgcgccgctggtccatgacctgcatcttgacctcggcgttcttgcggcgcacgagcgtcatgctttcgccgcggtccatggggcgaggtggatgctcacgtcgacgcgggcgcgcagtccggtcaggtcgttgaccagctggtcggacagttccggcggcaggctggacacccacatggtgcgatgcaggtatttcgagtccagggattcgatgtccagctggatggggttgcgcgcgtcgatgctccacgggcacacgaggtccttggtgtcgggcttgccgggctgatgctcgaaccggcgttcgtcgaaccggaactcctcgccgggccggagcacctcggccatgaggcgcagccggtgctcgcggtcgagccgggtggccttgcatgcgtcgatggagcgcatctggctgacgaggttgttgcacagggcgttcagggtcgcgacggcggcctgctcgtcgctttcgcggacggtgacggtcagggtcttgacggtgctggtgttgcggctgacggattcgagtttgccttgggcgagacggttgtagtcgagccggtagtggtcgaggctgtcaccggtctcgtccatcatcacgtcggcgaggatctctcgcacgccgcgtgagcgcgtgtaggaggcgatctgcacgctttgcccggcctcgaagctgttgatgagcttggcccaccggtcgatgatctccatctgatgggattccgggctcagctggtagttgatgtcctggaagaggatggtggcgctccaccgtccgtcgcccaggctggcgatcccgttgcgcagcatcgcgtcgtagccgatgagctgcttgacgcccttcggcagacgcgtcgccttctttctccgcgccttcgccctggcttcggcaccgccttcagccggcgcggcctggggtttcttctttccgaacattcctcacctttccttgatcgtcggtttcgcgccggtgcggtatggtctgcccggaccgtcgagcaggtagacctcgcgctgcgtgtagtggcgcaggatgtatttcaggtatttctcgggcatgaggccctttggcctcacccatccccatatggccacgggcaggccgggcgggaagatcaggtacatggcgaggttggggtccatgcccaggccgaaccacaggccgatgtaccctcccccgcacacgacggcgaggatgacggcggcgaggcactgccgccagctcatccccatgaacaccttcgactcgatggtggtcagttccctgtagacgggcatctgcaacgccatgatgattgcttcctttcgtggattgcgttgtgtttcattcgccgccgaagagcttcttggcgacggagttggccgccatgacgatgccgatgagcatgacgctcgccaagagcaggccgatgaagttgtccatcacccagccggagaggctgtcgccatccttgaacttgctcgggttgagcgtgccgcccacgagcgtgcggtacatgaggatcgccagatacagggtcgcgcactggaacaccagagacgcgtactgcttgaagtagttgatgccccactggcgggtctcctcctgggcgatgaaagcgatcggcagcgggttgaacgcggtgagcatgtatatctgcacgaaacgcaggaggatgacgacggtgacgacgatggtcgcgcccttggagacgaggaacgggatgagcagcaggatcaggcacggtatctggcccatccagccggcggagtctatggcgtcgcgcatgctgtcgccaaggccgaggcccgacgacgcgccggtggtgagcgccgccgaatggatgccgccgagcacgccgtcgccgacctcgtcgatggcctggagcatgagctcgctgtgctgggccgcggtgaacacgagcgtgagcttgaacatcgccatggcgacgagcttgacgcccagctctcggtcgccgtccgcccgggtgctgaccctggcgagttccaggacgcacatgatcgccagtatcgtgctggctatgggtttgaccgccgagcgggcgacggtcaggctcagctggtacatgcccgcgttgtattcggcgggggtcttcagcaggtcggccacaaggtcgtcgccgacgccggaccctatcgagttgaggatgccgacgatgaaatcgaccatgcgcggcctcccgtctacagggcgatgttggagaacagggccgcggccgcgatgatcagaccgccgccgacgacctgccagacgcccgactgggtggcggggccgttctggtccttcagtcctccggccagggtgatcacgccccacacggcccacaggccaccgccgatgatggcgaactggctgaaaagctgcaacgcactggtgacgacgctgccgctgtctgccgcgatggtgattccgtacatgatgttttcctttcgacttgttttggatgacatgaccacggtatggccgtcgagaaggctccggtttggacgttcccgacgaacccgaagaggctcggacgatggtatggaaaaggccccgccgaccgttcgccggtggggccgtcggtgagcttgaggtccctggcccggaaccacgcgccctcacccgtgctggaatcgaccttgctggtgttggtgatcttgaacgcgatctccagcgagtcgccgtccatcttgagcgcctgcttgacgtcgtcgcggtcgccgagcctctcgccggatttcacgtcgtacttctccaggtgcaggcccggggtcatgtccggcgtgcgggtccacacgacgttggattcgaggcccttgtcgttgaagtgctcggtgaaccggttctcgacgcggccggcggtcttgatgcgcttgcactggatatacgcggtccagtcgttctcgtgctccacgtcggcggacacgagcgcgcggtacgcgtccgtggcggtgatgacggcggtgccgtccttgtagtcgagggtgaacaggtcaccgccgaacttctcggaatcgaagccgctgccggcgagcttgtcgcccttggccgtgatcacggcgccatccttgtgcaggtcgcgcgccgcgtacacggcccacaggccgcctccgatgatcgcgaactggctgaagaggtcgagcgcgctggtcaccacgttggatcccgccgcgaggatgatgctgtcatgtccgttcattcgtccctgccttctttccttggcttggcttgtttgacaggtcaaaggtaaggcgcgcgcgacggggccgggtcggacaccttcgcggggggacgccgcatcttccgttggatatggagcagttggaacacttttatctcaattgaatcagaatgtcccgcgagcttcagcatgttgcagaatgtcaatagactatacttggcaaacgtggaacaggattcagatattaaagatgaaattgtccagcttgttaaatttggacttggtgggcagttgaatgactttcgtatgtacgtgtctagattgatacgcaaatacagggtcggtgatgcgtcgttctcaaaggcgttggaatcgttacttcagtccagcgatgtgcccgatatgacaccgataagggaattaggccatgcgtcacgtcggactggggaggcgccgatccttcccgtgggccaacgctccgatgtggagaagccattcctgcctgagcggattgtcaaacaggtagagggactgctcgaggagcgcgagaacgcgtcggtcctcgcccttaacggtctttccccgacctcgacggcgatttttaccggtcctcccggagtggggaaaaccatgaccgcacggtggatagcctcccagctcggaatgcctatgtaccggcttgatctggccgagacgatcggcaggcatctcggggagtcgggcaacaacatcaaagcagcattttcgaaggttcgtgtcactccgggaattctcttcctcgatgagatcgacgccatcgcgaagaccaggtcggacgactcggacattggcgagatgaagcgcgtagtgactgttctcctgcaggaacttgatgacaggaacccggcgagcctcatactcgcggcaacgaacaacatgtcactcatcgatcccgccgtatggcgtcggttcgagttacgaatagatttccctatgccggacgagaagcagatcatgaatgcgcttgaaagcgatttcagcgcatcggacagtcttggaggggtttcggccccgtggattgaagccctgggcatcgtgatgaagggggcgcctttcagcgaggtgagatccgtcgcgatgcgcataaggaaacggtgtgtgctgaggcggtgtccggcggaggatgccataaccgaatacataagggagaacacggaagggctgacccacgcgcagaggattagccttgcggtcgcgctcgtggagaccggcgcggtgacgcaacggctcgcctccgagatgaccggggtgtcgcgccagactatacgacgcagaactgagaaaacgaattcgaaaggatgattcatgggacggcattatctgataggacacggcgaacggctgtctgaaccgattgttcttccccgcggcggggcgacgccgaaagatatctacacatacgaggaatcgcgtgcgcggttgcagccggaactgcacagtgcgattgcaaatctgccggacgatccggccctcgcgccgaatgatgtgcacgtcttgcagatggtgttgcatccgaagtatctggcaaagtcttatcatccatccgggctgctcagggcggccggcctgtccttggtgggcagcaagccggtacgaatcacaacggccgacgatccagacaaaggtgcacgtctgtctaggacgttgctggtggcgggacacaggcaatcgctggagcatttcgattccctgctgcaggaccccgacgttcgatgtgaagagtacgcaggtatcaaggacatcgtcagaatcgagcgtatcgacaactacgcattcgatgacaagtatcatcccgcgccttccaatgacgcatggtacgaactggttctccatgagctggacgaggatttggcgccagataatacccagaagttcttggagctcgcggaaaggctcggagtaaacgtcgaagagcgaatgaacttcaaggccaataatctgttgtatcttccgattcggggaccggaagaagccgtcaaacggcttgctgaatactccagcgtccgcgctctgcgcccaatgccgaggttggggctgagcccaatcagctccgtgaggagcattcgggaacccgttacgcttcccgaacctccgagtacggcgtctcagctgggggttgcggtgcttgacggagggctgccgccggataacccgatatcgtcatgggtggactatatcaaggcgaatcccgatgccgatgatgacgagcggtttttggaacacgggttgggggtatgctcggcgctactgttcggcagccttaagtccggccagcagccgctgcgcacgcggataacggcggtgagggtgcttgattcagaaacgaggtccgatgatccgatcgcgatgtataaagtgctcaataacatcgagaatgtgttggaatcgtaccccttccactacgtcaatctcagcctcggtccagatttgccgattgaggatgacgatgtgagcgcatggacgtcggttcttgaccagattctttcttccaaggacatgctgctcagcgtggcggtcggtaacaacggtgaaggggatgccgaaagcgggaacaaccgcatcgaatcaccgggtgacgcagtcaacgccctcggagtcggggcgtgtgattctgaggatgtgtattggatgagagccccgtattctgctgtcggcccggggcgaagtcccgggatcgtcaagcccgatttggtggcgttcggcggaacggagggcaatgaattcatggtgcttggccctggaacgtcacctgcagcggtaccggttatgggaacgagttttgccgcgcccaacgcgctacggcaggctgtgcgtatacgcgagatctgcggcccggaaataactccgctggtggcgaaaacgctgctgattcatgcagcggaacgcagaagggaagacaatatgagcgaaatcggatgggggaaggttccatccgacgccaccgaaatcgtcacgactgaggacgggcgtgctcttgtcatctacaagggcagcatcaggccggggaagatagtgcgggcgaccatacccgtgccgccacggcttgatcatggtgacgtaaagattagagcgacgttttcttttacctgccgggtggatccccaatccccggattcatatacgcgttctacgcttgaggtcacgttcaggcctgacgcgaaccgaattgatgagggaaagaaaacggcaaggaccgattccttcttcagccgcaaccgcatgggaacgtccagtctatatcccgtagaggccgagagaagatcggatcaggggaagtgggagacggtactgcactccgagaggcaattcaaggcagcgagactcgccaagccggtgtttgacatccactataacgcccgtgaagagggtggcgcatcgctcagcgtaacggacaagttggaatacgcgcttgcgattacgatttccgccccaaagatcgggaatctccatcagctgatactggacgcatatccccagctgatttctcttgatcctctccttggcgtgtgacgcgcgtttcgtcggggttcgccggtgtccggtgtccgacggttcggtgcgcaagggaaaggggtggcaggccggatccgacctcattgggatccggtctgccaccccgttctggtttccatggtgcgcgggaaggggttcccgcggcgtgcccccgccgggagtcgaacccggcgccgtcacaaaggagaaaacaaagacggtaccggtgggggccttgggcgcgtccgggaagggaaaggatccgggcgcgcccgtgggcctgtacggcggatcatggggaacggtccgccgcacgggcccggggtcaggttcgtcggatcactcctccgagccctcggtgtcggccggggccttcgcctcgcgtcggcgggacgcgatcagcagggccgcgcctccgctgagcacgacgaccgcggccagcgcgatcagcgcgatgcccgcgccggtctgggcgaggctcttgcggtagccgttccagtcgtcggtggcggactccaccttggtgtccgcgcagtagtccttgccgtcgatggtcacgacgtcatcggacttgctctcggtctcggcctcgggcttggagccgtactcgtcgtccgaggtgccgtcaccgaacggggccgacgtgtcgaccggacattcggtcaacggggtgccggtgaccttggctcggtcggtgtgggtcttggtgacgcccttgagcgtgccggtgacctcgacgctttcgccgggcttgagcaccttggtgtcccagtcggccgggtacttgaggtccacgacctcgccgtcgccgacgatggtggagtcctcgagcttgatgtccttggtgcggaacaccgcgccctgcttcgtgtcggggtcggtcttgctcgtgttcgtgatggtgaacacgatctccgtgtcgccggagacggtcaaagcgtccttcgaattgtcgcggtcgccgttcggccagccggacttgcggtcccacttctggacgtcgatgctcggggtcatgtccggggtgcgggtccacacgacgttggattcgagagtcttgtcgttgtagtgctccgtgaactgattctcgtggcggtcggtcacggcgaggcgcttgcactggatgtaggcgcgccagccggcctcatgggagtcgtcggacacgaggccctgtagcggtcggtcgcttcgatggtgacgacgttgcggccgtcgacggtggccgcggagagggtgaagaggtcgccgccgagcttcgagctgtcgaaaccggagccggcgatcctgtcgcccttggacgcgaggacctcgccgcctgaaagcaggtcgcgggtcgcgtacacggcccactggccggtgtattcgtcgaaggccgggtcgagggagtcgacgatgtcccacttgtcgacctgcgggtaggcgcggttggccggcaggatggagctgtcgagctggtagaggaagctgcggcccttgtagatgctcttgccgttggcggatgcgccgccgaccttcacggtgacgtccttggccgggttgatgggcttcagggggttcgtgacctcgttggtgtccttgcggatcttgttgagcacctgcgtggccttgttcttcacggtgtagccgtcggtgaccttgatgacggtcatcggcatggtcacggtgtacgtgtggccgagaagcgtctggtcgatggcgggctgagtgagcgggtcatgctcgtcggactcgctgtaggccttgaggtcttccggctgcgggtcgcccttgacggtctcgcccgtcgcggggatctcggtgtcgaccagcttggcgtaggcgtagagcacgccgtccttgtcctggatgttgaacttggaagtgacgtccttgccggtctcgtcggtgatctccacgttggtggcgtcgagtttcaggtactcgtcgtcgtagtcgtcggtcatgccgagcctccagaccttgtaggcctggttgtcctgcctggcgtcgatgtcgacgcggtagtagatctcgtctcccagcagggcggtcttgccgtcgatgctgatcgtcgggtccttctgcgtgtccttcttgacggggtcgagcttcggcgggatgttgaacacctcgttgctcggggtgatcgagttgttgagggtcagcacccacttgttgccgaccttgtggtcggtgggggcgtcgtcggcgacggttccctcgaagcggacctggaggcgggggctggtgccggcgcgccactggctgatcgtctcctggtcggtgacggtcagggtgaacatgtgcttggaatcatcccacgtggtcgtgtacttcttcttggacaccggcttgccggtgtccaggtccatcatctccagggtctgcttgtccggtttcagataggcgtcgtaggagtcggtgaagctcacggacttgacctcgtaggcgaggtcggccggcagttgcggctgggtgttgagctggtattcgaccttctggccgggctggacgactttgccgtccacgctctcctggtcgccgccctggctcgcctcggacacgacgtccttcttgaccggtgggatgtagccgcagatctgcggttcgttggtcggttcggtgtggttgttcacggtctcggagccgctgttggtcaggttcttgccggtcggtgcggcgcagaaggtgagctcgtcgcccgcggccttgccgtagtccttgcggacctgttccgcgcccttgccgtcggcgaagttgatcttgccggggatcaggagcgtgacctgcttcgggttcttcagtcccttgagccctttgaggtaggaggtcttggcggcggcggtggccttggtgccttggactgtgatgtcgaactggtcggtcacgtccttgccagtgttgacgatgtcgctcacgctgctttcgcggtcggtgcccgcttcggcctcgtagacgcggatgttcttcgtgtcggcgtcgaagatgtagtcggcggcagtccagtcgtccgtgaggacgagcttcttgggcgcttggatcagattcttgccgatggtgccgttgacgacgctgccgagacggctaccgtcgaggtaggtgtgcgagtcgccgccggtcttgttggtctcctgcgggtcgatgacggcctgccatctgccgttctgctcgaagatccaggacttgtccgggttcggctgccaggtgtcgaactccttgctgccggcgtcggcctcgggctcctggttccacttgccggtcgcgtggtccttgaccttcctgaagtccttcggcttgctgacggtgatgtcaaagctgaactcgatctcgtggtccaatggcatctcgcccttgtcggccgtgcgcacggcggtcacggtgttcgcggccttgtcccatccgatctggaactcgccgctcacgtcgcggtcgttgtcgctcttgtcgacgagacggtagttgtcgacggtgcagtcgacgccgtcggcggtgatctcgtccttgaacgccatctcgtagccgcccttgccggtgccgtaggtgatgacggtgcggttggtcatgccgtccgcgctcacgccctcgtcgatggtcttgaccggcggggatggcggttcggcgctcacgctccaggtctcggccggatccttgtcggccgtgtcgacggccgcgttcatcctgccctgcttggcgatctggatgtcgatccagtattgtccttcctgccagtggttcatgccgaagtcggcgggcgtggcgaggttgtcgagccgggtgtcgccgttgttggcgaaggtgatcggcttgctgaccgtcttggcggcgacgtagccgttcttctggccctcgtagtggatgatggcggtgccgttcaggctttccttgatgctgctgccgttgttgctcgcgtgcaggatgtcgctgatcgggtcggtggagccgaccttcagatcggtcctctgcccgtgcgtggtggagacgctcagcgtatagttcggcgggacgggctggtacttgtcaagcgcgatgatgacgatgctggccgtgctggacacgtaccgttccatgagcttgtccacgctcgtggacggatcatcatcaaacgcggtagaggtcttatagtgacgagtcccagcatagttgtaatcgcctggtgcgatgtacttgttccagttgtccttccacacgctctggtcgtagatgccggacccgttccatacgctggtggtcgtgccgttgcccgagaccgcgccgaccgcgacgacacggcagtcgccgtcgccctcgcctggatggcgctggtggaaaccgtccacgcaacggtcgttcgcatccttcaacgcggctgcggccttgccggctgagtcgtccatcctcacgcccgcgttggccatggcgctgctcacgctgttgatgtcggtcgccggaccccatgagccggacgcgtcgtccttgtactgccagaactgcgttgccgcgccgctgccgccggtgccgggcctgttgccggcctcgccgccggcgtaggcggtgcccgcggtcaggccgccagccagggtgaccacggccgtcagcaacgccaacgccttccgtttattattggtggaaaccaatgttcctctcctttcagagattctgcacttgactatgtcgggtcgggaatcgcgatccccgaccgataccattgcaacccggtttcactgactccggtttggacattcgcgcaggagacaggaaagggccgtcccacggatgttcgtggaacggccctgaaagagaaacggagtcgaccggcttaatgttggattgggatggagcaatcctccaaactacaggcacctggatcaccgtgtccgccgctggtcggccccgaccagcctgacccaccggacgacgagccgcccgtcgaatccgaggatgcgcccgccgaaccggcgtttgtgtaggagcggcccgaactcgtgccggcgttcgtataggacggcgtgtacgactgggcctgccgttgcgactgtgcggccgcagcggcggcggcctgagccgcggcctcctgttcggctttcgccttcgcggcggcctccgcgtccgccttctccctcgccgtcttcgattcgttgacctctttcacggcttttgcgatggcgtccgcgtcgcgttttttgatggcgtccagcaggcttgcgcgggtcttgtcgtccgccaccttgccgtcggtctgcttgtacagcgcgttcgcgtcgtccacggtcttgtcgagtttggacgtttcgaccgcgttcaccagcctgttcagggacttcccgtgcgtccagtaccatgccgtgttcgcggtgatggccttcgtggccgtgaccacggcgtcccttgaatccgctttgcaggacacggtcttcggcgtggatgccttcatggccttggataggacgtcaagggtcttcgcgtccttcacgcttttcacgtcggtcttcgccatactggcggccttgccgttcaatagcgcgttgtacgcggtcgtcgcgacgtggagacgttcgctcgctgccgcgcagtccgccttggcttcggccatgagacgatccgtgtgggtcttccacacgatgccacccgccgcgagcagcgcaatgacggcaacggcgataatggcgacggcccgtccgcgatgcggtttcttcgtcttctcttccataggctcggacgaaagttcgaaggtctcctctttctctgtcatttgtcctccttgtttcttaggctcacagcttatcggatcggcggggccatccgcatcaagaatcatgatgcggtccatcattcccctccattcaagcccaagtacatctcgagggcggaatcgaccacctcctggatgcgcatgtcgtgttcggcggcgtaggtcttgagcctgcgtcgggtcgaggcgcgcaggctcacgctggtcttcacccagccctccgcgtcgttcggtttcacggtcctccggtttttcggtattccggtttccaccgattccggtcttccggtatccgccggttccgtccggtcgctgttgagcagcgcggtcaggtcgcgcggacggggcgtcaggttcatgttcctcacaggtcctcctccttgtccttgagctgtcgcatggtctgcttgagttcggcggccaggtcgcggtactcgtgcaggcgggacccgcgggggcgggtggatttcgcgttgaggatgtcctggcgcttcgggatcagcgtctcgaagcacgcgatgtccgagtcgtcgatccacgccagcgcatcacgcagagcggtcgtgttggcctcggtgcggcacaggaggatcgcggcggggatgccacgattctcgcacaggctcttcacgccggcggcctggtcgaggtcgatgcggctggggctcgagggaatgaccacgaggtccgcgttgttcaccgattcgtccaacgcgcgcccgtacggggcggaatcgatcagcacccagtcgacggggtcgtcgagccggtcgttgatcccgtgcaggtgcttgatgtcggccggcgcggcggacatcacgtcgaacggcagcgggtctccgatctcggcggccaggtaccaccagtccttcgcgtcgccctgcacgtccgcgtcggcgacgagcacacgctgctcgccccgggactggtccacgagggcgcaggccagaaacacggcgctcgtggtcttcatgctgccgcccttgccggtcgccaatgcgatcaccatcggctcgcgggtcttcttgtcgttcatcggtttctccttatttcagtatgtcggtatccggtttttcggcattccggttagttggtttttcggcattccggttagttggtttttcggcattgcggtttatgccgcgtcccacgcggatcgcgacgggaagcggtcagaagaggctgccctggaccaggcccttcggcacgggctcggtcgggaggaacagcggatcgtcgtgcgtgcattcgcggcgcgagcgttggcggcgtttggtccgtcgccagtagtcgcggccatcacggcgcatgcgtgcggcccagtccgggtggtcggccagccagtcacggacccgactctgtgggatccggtgcaggccgccgtcggcgatgtggaggtcgcgggcgatcagtcgggcgaggatccagcggctcgcatagtcgagcccgccgtacacggccttgtccttccagccgttgacgagagcgcggctgatgcagtcgaggcgcatggggcacgcggcacacagcatgcggcccttgccgcgcatccgttcgtcgaccaggtcccggccatcgtcgtcggtcgtcgtgttccacatgcgatccgccatggccgggtcgaccgcggcgattctcgcgcaggccggcatcatgtcccgcccgttcatggccgccgtccttgcgtcatcggcgtcttgcgggcctggaggcgtcctatggcggtttcgccgggattgcgggcggcccatgcccgggcgtattggatcagcaggccgacggccttgggatggccgaggcgcttgttgcgccagtagacggcgtgcagctgccagatcaggtccgcgtgcccgtcgagctgcgggttggcgaggaggaattcgccgaagcccgcctcggaacagtcgatgcgcgtggtcatgccgtcgcctcccctccggccgtcgcgtcctggccgtccaattcggccagcgtctccacggcccagtcgggcagccatggcgcagcctccggttccggcacggccgccggaaccgtctgtgcgtgtgcgtcgccgtctgtgcggccggctgcgaggatcatgtcgtcgttgagttcgtcccagtgtctggcgagggcccggccggtgcggatgcgtttgggccaccaatcgccgttcatggcgaagccgatcgcgtcgaccatcacgagggtgggccattgcgctccctggtcgacgagcctgcggtacaggccgatgatggccttgcggtcggctttggtcggtgagggcgtggccaggccgagcatcgagcgctgctcgccgagcgaggcgaggacccgtccggccgcttcggcgatctcggtgtcgtcctcgtcggattgttcggttctatttttttcggcggcggtcgccccgcttgcggggagatgccccgtaggggcagaggggaaggagggtttactcggagggtttacctggagggttttatccttatatatacagccctgcgagatttgcagtgctggaggtgcggcatttgcagtgctgggggtgcagctctcgcagtgctggccctgcgggatttgcagtgccgtttccgaatcgttttccagccctgcgagatttgcagtgctggaaatcggcttcgttccaacgttttccggcagcacgtccttggattcgccgttttccactatggtcgacgccatggggtccacggtcccgcccatggtcgcgggatcctgttccgccgtgtgcgtctccctgatccacgtgagggtcgacgggtcggattcgaccgcgaggtcccacacgacctggcagtactgtggcagacggttcctgccgcccttgccgaggcgcgcataacgttggtcgccgcggcggatgaacccccgctcctggagagtcttcaacgcggcgcgcacggtgcgttcgctcagttcggtgacgttgacgatggtcgcgatcttcggataggctgcggtgccgtcgtcgtccgcgcggtccgccaagtagacgagcacggccttcgcgctggcattgcccacatggcatctgaaggcccatgacagtgcgatgttgctcacggccgctcctcctcacgctgctgggcggcacggcgttcggtgtccagtctggcggcctgctcgtcgccgagacgtgccgcccggcacagggacagcgtcatcagccatgagaacgcgacgaacacgatcaatacgattgcaagccagttcacgcgagtctcccttccatggacgggtgcgccatcatcgacgccagacgacgggaatcggtggaaaccggaccattatggcgggcgaatgccgccacaaccgggaaagtccagaccggcgcctgaaaatcccggttacactcgggaaacacagagcaagacatgcggaatgctttagtaaagtcgttcacgtgtgatcactactccaagacaatgcattgagcggccacggaccgggatccggcaagatacgggatccgcggccgctcggaatattggttgcaccgcccgtccccgacgctccaacatcgggaacgggcatttttcttttatcgattgcagagaaagagagaattccaaatgagatcagaccatcgcaccacctccctcaacgaacctgatattcgtccggcgagaaaccacgccgaggcagaggaaatcggaagtctcctgctcgaagaaatcgcgcatccaggattcattcctggaccagagttcgtctggcagggtcaaggctttctcaggccgacactcataggcgcatggtcccagaaccgcttggtaggtggtgcctcgctcagtccatacatggaacacaccaaggcctttttggggattggtcgagcagacgcagcgcaggcggtcacacggctggtagctgaaacggacggcattgccgtcagccccgaccatcggcgcgaaggcatcggacgaaagatcaagctgttctgcgactccttcgcggcacagcaccacgctgcgatcatggtctccgtcaccaccaacgaagcagcggcaggcctcaacaacaaaacgaaacacatcgtgtttagacgatgcgacggcctcgtcatcaaatacgtagacacggtcggcaagccactcatatggcttcatgacctggatgggacgatccccgaagcggcatggtccgtctccgtactcggcaaaacgtatggaccgaccatagtcgtcggtgagcaacgggccatacggagtaaaaacacctcccaagacaacggcgtgcaatggatccttgccgttgatgcatttggcagcgacatcaacgcctagcttctccgggtcgatgacaatcggctcgtcaaaggcgaagtcgtccgccttcctcaccttcacatcgaaggacttgccaccgccggacgtgccgagtacatagccattgaataacttcatgccgccctcccctcggtcaacagcaggttcgccaccacccgttcgcgggtggagagctgtgcatcgacctcccggaaggcatgcgtgtaggcatgcgtggggcggagccaggtgtcggccagcccgcaggtctcgccaaggcgcagcgcgagcaaggcgcaggccgggcagaggttcagaatccgggaatcgagctggtcgatgtagtcgcgccagccgttttcggcgagaaacgcgtcgaagccgtcagacgtctcctcgttccagcgggtcgaccagattgctgtgtggcatccgtcgcacacctccacataatcgctccggccctccggccagttatactgctcgaaaattccaccagccatcacataacctcctgtacaccattggggaaagctgtctcatatggaatgagatcctgaacgaaatcggctgagagaccatactgttcgcggagaacggcacagtctctgcgctgccaatgtgtatgcagattgactttctgagtcacgctggccggcgactgatggagctgaacagcaagctggcgatgagttaatcccacctccgccatccacctcttcatattcgacatcgttaaccccatttcagctaagttaaaatttctaacctcagtatatgggttggtttttttaacctcaagttaggttaatttacagcgtgtcgaaatttaaaaaccgcatctccacaatgcggtttcagcactagagaaaggaaacttttaaatcaaagataaaattgagccaccatgacggcccattcctgcaaaggtcttttcacagaagcaatcagacgaggcttttgtccatccagaatatcctcatctatacaaaagtttccgaataacgcatcacaatatgcgcaaccatttgacatataacgccccgccctacgcgaagatcgatatttaatttgcttcgcggcgggatgcccagcaatttccaaaagctccttagcataacacatatctatgctttcccaagcttccaccaaggaaataccactttcgcagtcaaggggacaaagattagtaattgccacagaggtccgtccacatctccaacaggatcgatcaatgccatatatccctatatctacgacctcccccaagcgatgcaacgttttttgagcagcaggaagaaaaacattcgacaacatgagttcgcccatgcagacattttttcgccccgtaaatgcaaacatgcccaataggttagcaatattaaacattgtttgatatagttatctttatttggaaaggattaaccgatggaagtcacggaaacttcagaacaggtgaagatagaagcgcaacgttttgaagacgtagcgcgttacaacattcgccgctatatgcgattgaccggcaagattcagaaagacttagcccacgccttaggagtttcgaggcccactatcaccctgatgcttaaaggagaaacaaaacttaatttgcggcaagtgttccttattgccaaagctcttggcgtgacagtcgaagatctcatcgatgatacttattattgccaagatgaagagtttatgaaaaagctgaaaccgacgactgatgccgagaagccaggtgctttggtaggtgccggtgcgcccaggttccttgtcagtcccttcaaccccgacgctccggccgagggcggaatctcgggtgcggctaaaggtgccttggctggtttcgtgccatccggagtcctgtccggttcgggatccccgtccatgccctcaaagcatgacgggattggggttcccggccggtctcaagcccatgagacactaggaaccatgactacagttatcatgcgcaccactgaaggcgacatcaagatcaacctgttcgacgacaagaccccggaaaccgtggccaacttcctcggcctcgccactggcgagaaggaatgggccgacccattcaccggccagccgagccacaagccgttctacgatggtctgaccttccaccgcatcatcaaggatttcatgatccagggcggctgcccgctgggcaccggcactggcggcccgggctacaacttcgatgatgaaatcgttccaggactgaccttcgatcgcccatacctgctggccatggcaaacgccggcctgcgccgcggcatggacggcaagatccacggcaccaacggctcccagttcttcatcaccaccgtgccaaccgaatggctcaacggccatcacaccattttcggcgaagtcgcggatgacgagtccaaggccgtcgtcgacaagctcgactccgtggcaactgaccgttccgatgctccgctcgagccggtcggcatcacttccatcgaagtgctgaagtaagtttcgcatcaacaagacttacggcaaaacaatgaaaagcccctcgcgtgaggggcttttcattatctccgagagaatctacagcagttcagatgagtctcacgaccgcactgatcgtgtcatattttgcgtaaacgaggttcggcggagtccttggcaccggtgatacgatacacatcgaacacgccttcaatcttgcgcactgcggcaagcaaagtattcaaatgctgggggtcggccatttcgaagctgaattggctagtggccacacgatcggttcccgtggaaatggagccggaaataatgttcactccatggtcggaaagcacgcgcgtcacgtcgctcagcagatgcgggcgatcgagcgcctccacctgaatcttgaccatgaacacgcccttggtactcgtccactgcacgtcaaccacacgttccggctgacgcttctgcaagtccagcatgttctggcaatccacacgatgcacggacacgccctgattgcgggtgatgaagccgatgatgttgtctcccggcaccggcatgcaacatcgggcgagcttgacccaaatgtctcccacgcccttgacggaaatgcccagcgagctggtggtcttcttggtgcgttccacctgcttgagcggcagagcctcctgctccacctcctcattcacctcgtcgctgcccgcatcacggaccagatgcgagatgacattctgcgtggaaatctgcccttcgccaatcgccacgaacacggcttcggcattggcaagattcagctcatcagcaacaccgaccaacgcctcgggagtcagcagagtcgcaatcggaagattgcgcttgcgcatggctcgtgtcagctcgtcacgaccttcttcgatggcctcggtacgacgctccttgctgaaccattggcgaattttgttgcgtgccttcgggctcttggtaaagctcaaccagtcacgagacggaccagccgattcggacttcgacgtaagcacctcgacggtgtcgccgttttcaagcttggtgtcgagcggtaccagacgtccgttcacgcgggcgcccatggtacggtggccgacttcggtatgcaccgcgtaagcgaaatcgatcggtgtcgcctcggcaggcaacgatacgatcttaccttttggagtgaacacgtagacttcggcagcacccagatcttccttcagggagccaaggaattcattggaatccggggtctcactcgtccagtcggcgagctgctgaatccacttgaaattgtcagcctcgctcagctcctggttctcgccacgtttacgatcggacttatcgggcgagctcagcgcacggccagcttgaccgttctccttgtacttccaatgcgcggcgataccgaattccgcacggcgatgcatgtcccacgtacgaatttgaatctcgacaggcttgccgccagggcccaccaccgtggtatgcaggctctggtacatgttgagctttggcatggcgatgtaatccttgaaacggcccggaacggggttccaacgcgcatgcaccgcacccaacgcggcatagcaatcctgaatcgtgtcgacgatgatgcgcacacccaccaaatcgtagatattcgcaaaatcatgaccacgtacgatcatcttctgataaatcgagaaatagtccttcggacgtcccgttacgtacgccgtaatgttctgttcgtcaagatcttcgttgatctccgcgagaatctgcttcaaatacacgtctcgctggcctgcgcgacgggccaccagcaccacgatctcgttgtagatcttcggatagagcactttgaagctgagctcttccaattcggttttgatcgcgttcatgccgagacgattggcaagtggcgcgtacacgtcaagcgtttcatgcgctttcttctgcgcgctcggagttttgacgtaacgccaggtacgcgcgttgtgcacacggtcggcgagtttgacgaccagcacacgcacgtcgcggctcatcgcgaccaccatcttgcgaatggtttcggcttgcgcggaatcgccgtattccatcttggaaagcttggtgacgccatcgaccaaaccggtcacggtatcgccgaactcggcgcggcactcatcgagcgtatagtcggtgtcctcaaccgtgtcgtgcaacaggccggcggccacaaccaacggtcccatgccgagatcggcaagaatctgcgccacggccaacgggtggatgatgtacggctcgcccgatttgcgccgttgcgaagaatgctgcttgaccgcacgctcataagcgcgctcaagaatgcttatgtcctcatcgggatgatggtattcgcacatcttcaggatcggctcaagcggatcaagcggattcgtgctgatctcgcagcccaacattcgggcagaatgaacctcacgctcaacgtcacccatcgtccacctcctcgctcgcaatgctccctatactacccgcgcctcaccgtgcatccgaggcatccgaccgcgtgttgcacggccaaatacccccgaaaccattgagacgtcagcgtttgccgattcctctgcgactaagccagtgcgttcagctcaggaagccacgcctgtggaaccaaacccacgctcagcgcgatccgacccaggcagcgtttccgcctcgatgaacttcgcttcgacgtaacgctgaataaccagctgcgcgatacggtctcccggatggaacgtcacggtgtgttccggatcaagattgatcagcggcaccttgatctcaccacggtaccccgcgtcgatggttcccggcgcattgagcacagtcacaccctgcttgacggcaagaccggaccgtggatgcaccagagccacgtaacccgctggaagggcgatcgccactcctgtaggcaccagtgcccgctggaacggcttcagcgtgacttcctccgtagtgcgcagatcagcgccagcgtcaccggcatgggcataatacaattccgccggatggtcaggatccagcgactttaccagaacctcgacgttttccggttcgttatatgcttcgtcgaacgccatcaggcagcgcactcctgacacaccggctgaccgtcgtcagtggtgtaggcaagctggctacggtgcttcaccaggaagcattcggagcagatgaactcgtcaccctgcataggaatgacggtcaccgaggcgtcctcattgctgaggtccgcaccgggcagctcgtaatcttcggcgatggcgttctcgtcatcgtccatatcgttggaagtgttctgggagctcttgcccaaagcctggagcgactcctcgtcctcgtctttgttgcgcggggaatcataatcctgtgccatcgagattcctttcgtcatctatggtgcttatgcgccataggatacatgacttttaccccgcataggatacacgaatcgaaatactcgtaaaatccgacacgtggggcacaatggaataaacagaaattcttgaaggaaagtggtgtgttgtgcctgggaattcactcgaggaagcgcggttcgatcatgtcagcgacaccggtgaactcgtctttgtttcaggtgccggaaagttcgctgtaaagatcgacgaagcgcttgaaagagccattttggaggccaagcagattcgttccgaagtacaggaggaacagaagacacgcatcccacccaccctgccgatttcgcaaattcaatcgttgattcgcgctggcgccgatcccgcgcgtgtcgcggaaagatattcgttaagcgaagcgcttgttcggcgtttctcggcttcggtcgaaacggaaaagcaatatgcgatcgagcagtttctcgccgttccagcgccgaaggaaagccgcgtacgcacgctttccgaactgatcgaacgcacttttgcggcagcgcgggtgcgcttggaagatgtgacttggaaggccaccagacttggcttggagccttggaaaatcagcgctcagttcgtctcctccggtcacaatgtctgcgcggaatggtcgtggaacatgcacgacaatgccgtaagctgcctgaattccgcagcacgaaaactcattggagaacaggacacgtcgaaagaaggacacgccgagaaacacgccgatgaaaattttctcgtgtcactgaatcttcccggaaattccgcacggtcggcgcgtatcgagcaaacggtgtccgcatggaacacgcccgagccgtccatgcctgcggcccgtcccgcggcagcgccttccgttccgatcgcgccaatcggcggcgtgtctaatgaatccgacacgcctgacacgccgaacgcgccagccatcgcatccgacttgcctctgccgagccgaccggagaaccctgctgcaggagccaatacagccagcgcaacaaacaccgacacacgcaataccgttccatccacgccggagcctgcttcgaacatggcgaacgagaaccagacacttgacccgcatagccagaacaccaccaaatcgaagcggcgtgccggacgttccgccgtgccaagctgggacgaaatcctgtttggcgactgaagttaggccacgtcgatcaagcagggaatgtcggattcgagcatggtgagcgacccgtgcacgcttggcaggtgcatcgccttttctgcttgcgtacgtgagtccacaatagtgacgactttggcggccgatacgatcacatcgccgatcatcggttcgacgcgagcttccaccggcccatacacgccttcatccattgcctgcgagcgcgtgcgcacctgcgcacggtcctccagcacgctgcgccatcgtgtggcgatgtcttctggattctcgccttgttccgcgtagagcatgacgcaacgcggctcaccgccgacatgggcgacgccctgcatgagccgctgatcctgtgcaatgtcaatcacagattcgggatcagtggtgatcataccgtggtccgccacaatcacaatcaatgtgcctttgggcacgctgcggcggagaaggccgagctgagcgtcaacacgctcgtacgtgccaatccatttgtcggaatcccaaccgtaattgtgcccgaccttatcggtatcacgcagatacaggtacgtcagtccgggcgtttttgccgcttgcgccgcggctgcaatccgttttcgcggatcatcgttggaaatgtagtcgctgccccgtaacgccgcctgcgtcaacgcggaaaaggcgaatttcggcagtccagaactggtcactcgaacatcctgcgcgctcagccgttcgaaaatggtcggttgttgctgcaattcaagcggaggaattgcgtttttgaaggaaatcagctggcatatttcatcggttttcggattgagctgcgtgtaaccggtcataccggtcataccggggcatgttcccgtaccgaaggtagacatggctgcgacggtggtgcttggcatgcatgttgcgatgggacgttgattggcggtgtcgttcatcagcgcacgcaagtagggggcatgtcccagcctcatgttgagattccagtagccgagaccgtccacgagcgccacaaccacggaagtcgcatcgggaatgccgagcgctccctgcaaacgcttcggatcaggatggactgccgttggcatggggtatccgatggcgttggaaacagcaggaagtaccgatgacaggtgcaacgctcccccacgggttccttcagatgacacgtcatcgccgtagcatgccggttcggtcatggtgagcagctcttcgacgcttggcacttcaacactcataattcccattcaagcaccgcggcggtaccggctggtagcattgctaggttgattaccattacttttccgtgaggagattcaccgcatggtgtcgcaccgcaaaccggcaaaaccagcctttgacccgcgtacggtcaaagagaacatcgtcgaaacaccgttgaatgaggagatgagcaagtcgttcctcgaatacgcgtattcggtgatctatgcccgcgcgttgcccgatgccagagatggtctgaagccggtgcaacgccgcatcatctatcagatgggccagatgaatctcaatcctgatcgtccgtatatgaaatcggcccgtgtggtcggcgaggttatgggcaagttgcacccgcatggcgactccgccatctatgaggcgatggttcgtcttgcgcagccgtttgcgatgcgattgccgttggtggatggccatggtaacttcggttcccttgacgacggtcctgcggcctcccgttacactgaggcgcgtatggcccaggcagcgcttggtatgaatgccaatatcggtgagaataccgttgatttcacgccgaattacgataacaagctgcaggagccgactgttttgcccgctgcgattccgaatctgctggtcaatggcggttccggtattgccgtcggcatggccacgaatatggcgacgcataatctgggcgaggtggttgccgcggccaagcatctgatgcatcatcctgatgccacgttggaagagcttatgcgctatgttccaggtccggactggccaagtggcggcgtgatcgttgggcgtaacggcattcgtgaggcgtatgagaccggacgtggcgcgttgaccacgcgttcagtgacgcatatcgaaaatgtgacggcccgtaagaaagccatcgtcgtgacggaactgccgttcatggtggggcccgaacgagtgctggaacgtatttccgagggtgtgaagaatcgcaagctggaaggtatttccggggtgatcgacttgacggatcgtcataacggcactcgtcttgtcattgaaatcaaaaccggtttcgatccgaacgccgtgcttgcgcaactgctcaagcacacgccgttgcaagacaatttcactatcaacaatgtggcgttggtcaacggccgcccgcacaccatgggtttgaaggaaatgcttcaggtgtgggtggaccatcgtcgtgtggtgattcgccgtcgtagcgaattccgtaagaagaaggcgttggagcgtctgcatttggtcgaaggccttctgcttgcgatggtcgacattgacgaagtgattcaggtgattcgttcgtctgacgatgctgatgccgcgaagacgaagctgattgccgtattcgatttggatgagattcaggcacagtacattcttgacttgcgtctgcgtcgtctgacgaaaatgagccgcatcgagcttgagtcggaacgtgacgatttgaagcaacgtatcgaagagttggatcgtattctcgcttccgccgaagcgctcgacaatgtggtgatctccgaaatggatgaggccgtcgccacgtatggcacgcctcgtcgaaccgtattgctggatgaggatgccgatggtaagcttgtgcctgttgtggcgcatggtgatgatggcgtgtccgcttcggctatggccgcagcccgtgccgccgcaacggtctcttccgcagcagctgatgttgccgcagccgctaaggcagcgacgaaggccggtgaagacaatgcggccgctgtggcattgcagattgacgacgaaccatgtgcggtgatgctgtcggccacgggtttgatcgcgcgaacctccgaagatgcgttggaacgttgggagaatcgttcttctgccgacaaacgtgtgagggacgatcagattatttcgattttccctaccaccacacgttcctcatatggtttgatcacatctgccggccgtctgattgtggcgcatgtcgtggagttgccggttgtgtctgcggatggtccgctccatgtgactggcggcgtccatgccgaagagttgatcggtatgacggaaaataccgatccgattcgcggcgaacgcgtgattgctgcgattgccatgccaactgccgatgattccggtgatcatgccgcagaacctgctcctcttgcattgggcacgcgtaatggcgtgatcaagcgttggaatcgtgagtcgcccaccacgatggattcatggagcatcatcgatttgaaggatgacgatgaagtgctggctgccgctgaagcgcgcgatgaggatcgactggtgtttgtttctaccgactcgtctttgctgacgtttgatgcgaagaacgtacgccctcagggccgtaccgcgggcggcatggcaggtatccgcttggctgaaggctgctcggttgccgcgtttgcggtgattcccgccaacaaggtggcttggaattacgaggagggagacaatggcctgttctccgcgtctggagccgtggtgttgacggttgccggcgattccgaagcactgccgggcacggagaatggttcagcgaaggtaaccccgttggagatgtacccgacaaagggtcgcggtaccggtggcgtgcgttcgcagcgtttccttaaggggcaggatacgttgatcctcgccttcgtgggcacatatccggtacatgcttccacggagggcggtgccggcgtggaattgccgaagccggatatgcgtcgtgacggttctggtacggaactttccgcgccaatcgccatcgtcggctgacccattgcaatgtgacgtgcccgcgttttgcgaagtttggaatcgtttaggattccgttcgtaggacgcgggcattgttgttcctgcgttttcgtccgcgctgtcactatgcattagcgatgatgatctttttcaacagtaaagtttcatgccttgcggactatcgacgaaacctgcggcgtaaaggatttgccggtattcattgcgtgctttcaatgatgttccgttcatttcgctgaagctgatgctgccgctgggttggcgctgcaatacgtaggcaagttcggcgcatgacggtcttaatattgtttcgtctgcggtgaagctgacaattttatggctttttggtacggagaacagtaccggttcgccttgtttgagcacaatgatggacccggatctgcgtgctggtttgaggtaatcctgttctggccaggcgattgcggaaccagtgagattggcgggatcgatcacgtcgagcgcaacgcaggattgactgtgccattgcgtgtcgctgcgcagcgcgtcgacggtgtctcgttccgcgaattgtgccgcgccaaaacctttcacgaacatgcctcggaccagtgtgccatgttcttccattcgtttgagtaccggatagagcgctgaaaatcctccggcaatccgttccttgtcaaccaaaggagcggcaatcacgccgtatcggtccagtaatgagtcgatgagcgccagctcacgctcctctacacttgccgtatgcgccatgccaatgccggtatcgctgttttcgagcatgcccggctcgataacaccgtctagtggtttgtttggcataacggttcgcccgtcgccacaagatactgcggaccataatccactcagcgccaatggtgttggaggacgcatggtgacgcgtctacgcgcggcacgacggggtgcgcgaacggttttgcctccgtgcagaagcgctcgtactggtgcgaacgaactgttcgtcattttcccctgccataccagtgaccataaggcttcttcgaactgccgctcgccccatgccggaaagatgatttcgcccgtttcggggttcacctgcgcttcggcatgctcaagccagatggtttttgtcacggctgaaagcagttgaataggaaatgctccgccaccgcttaacgccgttaacacggcatccggcatgatcaacgtttcattatcgttcagcttatccaccgccgattcaggctggttgagcagcaaggaacctgctggatagaaggcgatctcaccagcttctttggcgttggatccacttgctttcgaaccgacccacaccacatccgacgatgagatgagttcgtcgagcatactaggctgatagtcacgcacacgtgccgggaataccatggactcccataccgaagcgttcaggaacacgccttccaactgctcgatgacacgcatcagaccatcaacgccttcgtagcgttcacctccaacagggccaacgccctgacgattaagcagaaacgcctgatagacgctcggatcgaccggtttgacggcctttctggccttggcaagagacaatgctcgaatacgccggaaaacatccttgtggagccattgctgaatatcgttcttttcggaagtctcacctgaatcagtgaatcttcccttgatgagttctcctcgggcatccagttcatcaagcgcatgcaccgcctgagccgcgtcaatgcccagttcggcaatcatcttgtcagcggtgaatggtccatgcgttttggcgtatcttgttacgcgcccgctgatatcttcttcggcgagatcattccagaatgttcgcccagcaagctcgccctccacttgtgtaatagcttcggcgtccaacaacgatgccatatccgtgcttcctagaagccgttcgagcacttccagatccatggacagcaactgcgtgcttcgttcggcttggggcacgtcatactggtacatcaccgatccgacgaagccgaacagcatgttctgcgcaaacggagaaggtgtttcagtagttgcctccgataaaagtattgttcccgcatgcaggcctgtcataatcgtgcgtaatgccggcaaatcatatacgtcctgcaggcattcgcgcgcagtttccaacaagagggggaagttcttgcaagtacgagccgcattcaacagttgcgcggccttcaaccgctgctgccagagaggcacacgcttaccgggacgtgtgcgcggcagaaacagtgatctggccgcacattcgcggaatcgagccatgtaaagcacgctttcgccaacttgcgtctcaacagtgcgttgcaattcgtccacgtcgaatagcaacagctcacgtgtaggcaaatcgccgtaaccgtccggcaatcgtaaaacaatgccatcgtcgaccgcgtacacttgaccgtcgaaaccaaaccgctgtttgattcgagtggtgatggctaacgcccaaggctcatgcacgcgcctaccatatggtgaatggatgatgatgcgccaatctccgccttcatcccggcaacgctccaccacgagatcacgatccgaaggaatcgtaccggtcgcttcacattgctcgtcaagcagtttggcaagattgcttatggcattatggtcgagaccatctcgctccaaacgttgcgcggtctcacggttgaactgtgcttccaatacagtctgagccgtattctgatcaccattctttgctggttcacgcctatgcaatccttggctgagctcacgcgtcaaacgcccttgcgccaatccgaaaccataatcacgcccatcctgatccccatgccaaaatggcaagcgcgcggtgcgcccgggagcaggaaccaccactaccctatctcgtgtgatctcctgaatctgccaggtggaagtccccaaagtgatgacatctcccacgcgggattcgtataccatttcctcatcaagctcgcccactcgccgaggacctggaccagagccctcttctggaagcaccaccgcgtacatgccacggtcgggtatggtgccgccactggtcaccgccaagcgttgcgctcctggacgtgcggaaatcagctttgcctcttcgttgtattgcagcggtggacggaatgcggaaaagctctcactgttgtaggcgcccgtcatcatgccgatgacagcgtcgaacatagaccggtcgagattttggaaaggtgcggaacgacgcacaagctcgtaccaatcgttcgtggaaagatcttccatggccgcggctgcgacggtctgctgtgcgagcacgtccagagggttgcggggcatatgcaatggttctatagccccttccctcatgcattccatgctggttgttacgccaataatctgttggcgggttatggggaagaacaacgcgtgcgagactccgccgacattgtggtcggcacggcccactcgctgcaatcccgatgcgatcgacaatggggcggccacctgaaccacgagatccaccgaacccatatcgatgccgagttccaggctggaagtggccaccacgcaacgtaattcgccgcgttttaactgttcttcgatctgtttacgtctatcttttgacacggacccgtgatgagccatggcaatcgcatcaatgtcttcatgcgattcaaccagcatggtggtggatcctaccaccgagtcatagtgcccggcaaattgctcgcggccctccggtgagcccaagtcacggtgctcactcagatcagttgccaccgtgccctgtttcgactccgcatacatgtcgttgagccgtgcggtgagcttctccgccagtccacgcgagttgacaaatatcaatgtggttcggtgccgcaacacctcgtcgagaatggaccgttcaatgaccggccataccgaaccgcctgtagcgctggtgtcgagcatattgcgcaatggttccacggcttttaaatccatggccggaacagcgccggggttcaccaccgttaccggttgcgaaccaccgagaaaccgtgctacttcctcaacgggattaacggttgccgaaagccctatgcgttgcactggatgcccaatcaacttatcaaggcgttcgaggctgacagcgaggtgcgcgccgcgttttgtacctgcgaccgcatgaatctcgtcgacgatcaccgtctccacgctcgtcaatatgctgttcgccttggaggtgagcagcaggaatagtgattccggcgtggtgacgagaatatccggcggatggctgacgattcttcgacgttgttcaggtgtggagtcgccgctgcgcatggccacttcgacatcggggatgggcagctccatcgcctcatactgctgggaaattccctgcaatggcagttcaaggttcttcgccacatcagcgccaagcgccttcagaggcgaaatgtatagcactttgacgccacgcttcgttttcttgcgggagcctttccctgcagctttttgttccgcatggctcttggctgccgcgatttcgccatgaacatccactcctgcggaacgcgtcccgcccgccataagccggtcaagagccgaaaggaacgcacaaagggttttacccgaccctgtgggcgccacaacgagcacgttctcgccggaatggatggccggccacacctgctgctggacttcagtgggccgactgaacgcatgtttgaaccatgccttggtcggctctgaaaacaggttcaaacattcgtacatacgttcgatgatcgcattaccgcaagacgttattcatcttcgtcggcaacccattcgagcacatctcccggttgacaacataacgtctcgcatatggtatcaagcgtggaaaaccgtatcgccttggcccgcccgttcttcaacaccgaaacattgaccggcgttatgcctatagcctccgccagctcattgacgctcatcttccttttggcgagcatcacatcaaggttcacacgaatggccatatcagatcaccgctgccagttcatcacgctgttcgatggcctgcatcaacagcgagcgcatcaccaccatcaacagttcgaacgccgcgatcagtagaagcgccgccactccgaccgccagcacgacgtatggaaacatttgcccgtcaacccccatcgcagccatcagaaagcgtgaaggcgacaaccagatttgaccgaccatcacggcgagcaccagcatgccttcaatccccgcatatacgagaatgtgattcacccaacgcatggccttgccggaaaagacatcacgtttttcaaccaaggtcagcaatctccacagcggcaccaacgcgaactcgaagcaagcgacaatcagcactgcggcaaccgcatacagccaatgcatcgagtcagcgtcggcatacttggaagcaacgccagcggatgccgcaatcgcactgaactgcagtccgaggcagcatattgcaattatcacaatcagcacacgcaatacgccaatcaccatggaacgtttcgctgcggaattcggcatgatatccgtctccttcaatccaataaacctgaatatcgataataatctatcgatattcgatatgcaaatcttgtgaaagtatgttagtcgatatttttctatcgtttttcgatatgtacgatgacgtccaacatatctcagaaaggaatcattatcatgccggaaccagccaacacttccccatcgcagacttcgcaatcccaacaatcatcgccattaccagaagcacaagaaacccaagaaacaccaaaaacacaagggagccagccaacacatgaaccatccgcgcatcaggaggaacaacctttggcgaaacccaaaatcacgcgggaagaaatagcgcaacgccccctcaacaaacgcgcggtcatcaccattggcgctgcatttctcatcactttcgcattcgaccgtctgatctgcagcatacctccgacatggcttatcggatatgaactgccggttttctggatcatctgtgctcttaccgtaaccgcgctgcactggaaaaccgcacgaaaacaagttcttgtttggcttgttttgggaagcatcgtcgccattggcgtgtggaatacactcgctcagtcgacctggtgctattcgagaaatgacgagtacgcgctcaccacgcaattcgttcaaccggcgttgcttatgctgcactgtcagctggtcaacgggcgttacgatgttcgccgtccacttcaagttgcctggaattggcttaccggctggttgcagcagccgtttattcacattcgcgattttgcggaaccgttttccgtcatattcgcaagatttgcagtcgcgtcgaagcaacgttcgaaagcgcgcgaaatcggcattgcgctactgatttccactccattacttctgacgatcgtaccattgctcatcggagccgatcaaatagttcaatatgaagtgctgaacgttttcagtgatttcaacccgatgacgatcactctgcacatcatgttcatcgtgttgccgtggcctttgctgttctcactgcttattggactcgacgatgaacccacttccacgcctccggagcaacgattctccctcagctcggtaactgcgttcgtggtattggccgtgactttgactgtgtacatgctgttttgcatcgtacagatccggttcctgttcgcaggattgttcaccgatggttcgatcgcactgccagacggattgacctatagcgaatacgcacgcggcggattctttcaactgctggcagtcacggccattaatgtgacgctatttggtttggcgatcgcactcgcgccacgtacgcgcatgctcaacgcggcactggtagcattgctggcgttaaccgccgtcattctagcttcggcggcgcttcggttaggactgtacatcaacgcatacggtttgacttggctgcggtacctttcggcgtcatttatcgccctgcttgcgatcgcgattctgctatgccttattcgcctgaaaatacgacaactgccattggctgcaaccatgaccgcactgcttatcgtatggtacgtggcgctcggcttcagcaacccgaaccatatatgcgaaatccacaatgcggctcatggtatcgcaatggcaatggcgacaacaccgtatcagtcgatggtctgaccagcgcactttttacgcaggctctcgtgcatgatcatcatcagcaccaggaaagccaacatgtacagagggaaccacagcacactgatatgctgtgcgatcaagccgaataccggcggcatgcacatcgagccgacgtatgcgcatgccatttgcatgccgacgatcgcctgcgatttgtcttcgccgaaatatgccggcgtggaatgaatgacgcacgggtagatcggtgcgcagccaagaccgacaatcatcagtcccataatggtgccgatattgcgaggcagcggcagcaacatgatgacgataccggtcagcaccagcgcctgccccaggcgaatcatggccggatcattaaacttcatggtcagaaaaccactcgccaagcgacccacggtgatgccgatgcagaacaggctggcccacatagccgccgtggtcttatcgatgcccttgccaagcgccatgtagctactagcccacagcatggccgtctgctccaatgcgcaatagcagaagaacatcaccaggatttctttggcgccacgaatggcgagcacacctcgcacaccaagcggtttgcgagtttcatcattggccgttccgtcggattcgccggaaacttcgcccgtctttacctcggaacgcttcttccacagtggcagactgaaaataagaatggcggtgagcacaacctgcagtatggagatataacggtagccccacgaccatccttggccggcgcccaaggcgaatcccatgatgtatgggccagtcaacgcgccaatgccccacatggcgtgaagccagctcatgtgacggctctcgtagtggatcgccacatagttgttgagggccgcgtcaacgccgcccgcacccaagccgtacggaatggcaagcagaatcagcacccaatagttaggagcaacggaaaagccgaacaatgccaacgccgtcaacgccacggaaaccgcagtgaccttgcccgcaccaaaacgcaaggtcatacgatcggaaagcaacgcggaaacaatggtgccagcggaaatcgtcatggaaatgccgccagcccacgaaatgggagcacccaaatcgacactcatcgtcggccatgcggcacccagtaccgcatccggcaggccaaggctgatgaacgccacataaatcaccgcaagcaaaagattaaccacgccctactccttcttgatcggtagccgcagaagacaatatccgccattattgtaagcacatatagctaccaatcggtaactacttgattgcactgtctaccgtagaatcttcaatctttaccacacgggatcgcataccatcttcactaaaaaataccctccgaaacgtcttgacgtagcggaaggcgagctgacgacaacctcgatcaggtatcgatcttcgaacggtcgaaatcgtcggcattctcaacgatgaacgctttacgcggcggcacgtcatcgcccatcagcagactgaaaatctgactggcctgttcggcgtcttccatacggatacgacgcagcatacgtgtgcgtggatccatagtggtgtcggccagctggtcggcgtccatttcacccagacccttatagcgctgaatgtcctcgttatagctgatgtgcttcttatcaagatcagccaatttgccggccagctcatcgtcggaatacgtgtagatatactcccccttgtgagctccggtcaaggcgatgcggtgcagcggaggcacggccgcatacacgtgaccgtactcgatgagcggccgcatgtaacagtagaacaaggtgagcagcagaatgcggatgtgcgcgccatcgacatctgcatcggtcatcataatgaccttgttgtaacgtgcttgctcgatgtcgaagctcgctccggagccagcgccgaccacctgaatgatcgccgcgcattccttgttcgacagcatctgcgacaacgacgccttctgcacgttgagaattttacctcgaatcggcagcaacgcctggaaaccggaattacgcgcggctttggcggtgccaagtgcggaatcgccctccacgatgaacagttcggccacatcgtcattgcctggctggcaatcagacagtttcggtggcatggatgccgattcgagcgcgttcttgcgtcgcgtcacctctttggtcttacgtgcttggatgcgggcgtgcatttcgccgacgatcttttcaagcacgcggccggactgttccttatagccacgtttggagccggtgatcatctcgccgaactgcctgtcggtcattttgctgacgatcggcttgacctgcgcggtgccgagcacatccttggtctgaccttggaactgtggttcggcgatacgcacagtgacgacggcaaccagacctgccagaatatcgtcacgttcgactttcatgttggaatctttgagattcactttgagcttacgtgcattgtcttcgatggctttgcgaatctgcttggtcaggcccaacagatagccatccacatgggttccaccgcccggggtttccaccacattgacgaagctgcgcatggtggtgtcgtatccgttggtccaccgcatggcgatatcgacggcacaatttctcgtaaccttctgcgcgtgcagttcaccgccatcgccaacggcttgggtttcctcaacataggtgtcttcgccagtgatacgccaaatagcggaaaccgcttcgcctttggacaggtaatccacgaaatccttcacaccgccggtatggcagaattcctcgatacgggagtgggtatacttcgatccctgaggttgtgccgcaacatcggcttcctcgatctgctccgcagcttcctcgtgcccggcagcgtcatgttcagattcatcgctttcggcaatttcctgcggttcatcacctgcagcatttgcaatatcgtcgacttccagcatttcgtcgactgattcatcgccggtttccggaatattctcatcgataacagtgattttcaaacccggcaccaggaagctggtctgcctgacgcgatcaatcagctgctcgtagctgaattccgcggtgtcgttgaaaatctccggatcagcccaataacgaatgcgagttcccgtggtcttcggactgaccttgccaatgatttcaagctcagtcggacggtttttacgcgtgcgtttgaatggcgcatccggagatgggtgctccggatcagcatcggtatacacaccaggatgaccctgatggaatgacatatgatgcgtcttgccgtcacgatccacttccacgtcaagacgggagctcaacgcgttcaccactgacgagcccacgccatgcaaaccgcccgaggctccgtacgaagagttaccgaatttcgcgccggcatgcaatttggtcaacaccacttccacaccggtaagtttggttttcggctcgatgtcaacagggataccgcggccgttatcggccacttccacggaaccgtcgctgtgcaacgtcacaacgatatgattgcagactcccgcaagagcctcatcgacggaattatcgatgatctcccacaggcagtgcatcagaccttggctatcggtggtgccgatatacatgcccgggcgcttgcgcaccgcgtcaagaccttcaagcacggtaagactacctgcgccgtaattgtccttgtatttcgccattttcctcattctgacttgcagttttgcttcggttttcatccataagaacgtcttgtagacgtaagaagtcgagaaattcgatattcttaccgaatttctcgacttcattcacctcttgtttcaatcactgatcaaggaagtcacgcagcgtctgcgagcgagacgggtgacgcaacttcgacatggtcttcgactcgatctggcgaatacgctcacgggtaacgccatacacgcggccaatgtcgtcgagcgtcttgggctggccatcttccaagccataacgcatcttgatcacgccagcctcacgcggagacaacgtttcaagcacctgcctgaactgctcctgcaacagcgagaaggcaaccgcgtcggacggcgcgatggcgtcggtgtcttcgatcagatcgccgaactcggaatcgccatcctcacccaacggcgtatgcaaggaaatcggctcacggccgtacttctgcacttcctgcaccttctcgacaggcatgtcgagctcgcgtgcaagctcatccggcgtgggttcgcggccaagatcctgcagcatctgacgctgcacacgagacagcttgttgatcacttcgaccatgtgcaccggcacgcgaatggtacgcgcctggtcagccatggctcgggtgatggcctgacgaatccaccacgtggcataggtggagaacttaaagcccttcttccagtcgaacttctcgacggcgcgaatcaaaccgaggttgccttcctgaatcaaatccaagaacagcatgccacggccggtgtaacgcttagccaacgaaaccacaagtcgcagattggcttccagcaggtggtccttggcccgcctgccatcgttcgcagcccacttgagctcacgcttgcgtttgaagtccatctggtcggattcggtgtccagcaggtgctgggcatacagaccggcttcgatacgctcggacagatcgacttcctgttccgcattcagcaggctcacacgaccgatctgcttcaggtaatccttgaccggatcagcagtcgcacccgccgcaatcacacgacgcttcggattgccggatggggtcagattctcatcatcatcgtcatcacgcaccacgaaagcgcccttttccttaggctcttccggctttttgcgttcttcctcatcctcgtcgtcatcatcttcaggttcggattcctcgtcgtcgtcgaggtcatcctcgtcatccgaatcgacgtcatcgagatcggcgtcgaaatcgtcaagatcggcgtcgtctacctgagcgtcctcatcgtcaagtgcatcatcctcgagcggctcctccttcttggcaggggcgctcttcttcgcggtagtcttgcgaggggtcttcgttgcggtggttttcttcgccgcactcttcttcgtggaggccttgcgcgtggcggctttcttcgtggaggtggtcttttcggtcagatcagcctgttccatgcttgccgtcgtttccttggtggccaaacttatcctcctattgatcctgcctcgaagcgtataccacatggacccacttctggcaagggcaaatcgtcaactatgtgagtaaaccatcttgcaaggacgattattcccgcataatgaggccttcacgcgcaagtcacgccactttacggcgtgttgccttatgtttccgacgtccaggcaggaccaatacgtcgttcaaccgccgagcatacaatcgccgccagcgaacattgatcatctatcgcgagcgcgctgatggctgatgccatggctccttcctggcccatccaccacatgatgtagctgatcacggcgaacggctgcgcccgatatgtcttcggaatcatatcgataatgtcgaacagcatgttgatcgcctgatcgcaacgtttcatatcgggtctggctaggggatcacggaatgaatcgctgagcagctgttccagacgctgcgcattacgagacagcttgggtctttcggcgaaactcatgagaaagtctcggtcggcgtatcgttcgtcaacgatggcggaaatgagaaatacgtcacgaatggacagcatccgattgatgcccaccgtagtccgcatgatcatattccggtcaagaccgcattcggcatggaattcgccttccgaatgggaaacgctctcgtccgatgcctgcgcaagcgcgtccatccatatgaaaagcggttcacgaatgaacgaacgcactgtttcgcccacgccgtcggatctgcaatccctttcgaatcggctgatggcttcttccatttcagtcccggtgatgcgtccggttttgttggttgtcattattctgccctccttggcatggtctatcggcttcctcgctcgccgcttatatggcactatgcccgatgagccgatgcgatgccgcttttttcgaggcctgtggtcggaggatggcttcttcggcgtttcgcaaaatgatttcggtaccgcaactattgcaatcattgagatttggtcttgtcgaatgcctgtggataactgttggtatgactagctcctccgatttggaacagattgaatcacgcattgtttcgttggtgaaggatttcgcattccttcatgcggacgattcggttgcctcctcttgcaggcctattgccgacatggtcgccaagcaggcggtcacgtcaagtgagggtggcaagcggcttcgctccttgctgacgttggattcgttccgcgcattcgcttcggaggatgtgcgagaacgtgatttcgacgcgctgctcgatttagcgtgcgcggtggaagtgttccagaccggtgcgctggtgcatgatgacatcatcgatgattccgatctgcgccgtggcaagccgtctgcgcatcgcgcattctccactggtacgcatagcgaggccattggccatggcttgggcatcatgctcggcgacatgttggccacggcaagcgtggacatcgcggacaaggcagcttccaagctcactcatggttccgatgtggtcgcggcattgctcaacatgcaccgcgaggtcgaagtcggtcaagtacttgatttggccgtagagctcaatccgttggacgatccagacgaactggtggaagcttcattgaacgtattccgctggaaaaccgccagctacaccaccattgccccactggaattcggcatgcttgccgcgggtataggcaaagacgatgcgaggaagcaggcattggcagtcggcttgcctcttggattggctttccagcttgcagacgatcttctggatgttgtcggttcgagcagcaatacgggcaagcccgttggaggagatatccgcgaaggcaagcgcacggtgcttctagccgacgccatcaacgcggcgaacgacacgcagcggcgagagctcatcgacatgtgggaggccgattcgcgttccgaaactcaagtaaaacgcgccattgaactatttgagcaaacaggagccatcgaacgttcccgcggtagaatcgcggatttgtggaatgaatcgaaaacagctatcgaaacattgagcctttccgaataccacgagtcactgctcatcgaggcctgctcacgtttcgtgccaagtattcacgtccaaacacgcgcgtgacacgcgacctgcgtgttttccaaccaacatccggacaggacgcgcgttcgttgcacaatccgcaaacctctgcttgtagactacaagtgggaacacgttcgaacgtgagttgttttgaagaaggaaccgtagcgatcaaccatgagtgaagctccacacgcccctgaaggtcaggtcatcgagggccggtatcgggtcgtcagcagaatcgccgatggcggcatggccacggtgtaccaagcggtagacgaacgtctggagcgcacggtcgccatcaaaatcatgcatacccagctggcgcagggaccgcaccgggaccagttcgtggaacgattccatcgtgaagcccgttcggccgcggccattgccaatccgcatatcgtgcaggtgtatgacaccggcgaattcgacggtctcgattatctcgtcatggagtatgttcacggcgtgaacctgcgttacgaaatgaaccagcagggtacgttcagcgttcgagagacgttacgcattattggcgagacattggatggcctcgcttccgcacatcgtgcgggcgtggtgcatcgcgacatcaagccggaaaacatcttgcttaacgaccgtggccatgtgcagatcaccgatttcggcttggctaaaacggtatcgcaggccacactctcctccaccggcatactgctgggaacagcagcatatctagcaccggaaatgattgagaagaatcaagccacacctcagggggatttgtattccgtgggcatcatggcttgggagatgctcgccggcaacgtgccattcacttcagataatccagtaacactggtattcaagcatgttcacgaggatgtgccaagcattgccgccgcttgcaaaggcatcaatgaaggcgtggccgcattccttgcccatctcacggctcgcgcggtcgaggctcgtccagcagacgcatccgttgcgttaaccgagctgcagcgtctgcaatcgacgcttgcggtcagcgattggcagtatcgtcttcccccggtagacgtcagcgcttccgacggtgccgcgcccgcaaataacggtgcgccaaccaatgtcggcaatcctgttcctcccgctcccccggcaccgccgacgcagcaattcgatgatcgcacacgcaagctggacagggtcaggacgaacgcaacaaccgtcatgccggtgcagcaacagaacatcgatccagaagcgacgacacgtttctcgctgccggcagacggcatcgtcaatagccttgacaatgccgtcgacagcgctgcatcgcaatcccccatcgcgcaaagcgacgaatccggcaatactccaaacagcaaatccgcgaaaaagcgtcgcacaccgctcatcgtcgcaggcgtggtggcgctgctgcttgcatgtggcgccggcggttgggcatggtggtactatcagggccccggcagctattggaccatgccccagccggatggtatgacatgcgacgcgtccgcagcatgccccatcaccaatgtgaagtggagcgactacgagagtctgctcaagatttccgatatcgaatatgaggtgtcggaagagtatagcgattccgtggaggaaggcaatatcatctccaccgacccggcgaatgtcggcgatcgcggcagcaagcgtcgtagccagaaagtcaaggtcgtggtctccaagggagtccggcaggcgacggttcccgccgatattctcgacgcgaccagcgcatccggcaaggatccaatcaacgcgctgaagaaggctggattcgataatgtcgagcagaccgcggcttctgatgacacgtattccattgacgtgcctcaaggggcgttgctgtcgttaagtgtggatcccggcgccacattgccgcataatacgacgatcaccgtcacggtgtcgcaggggccaaagccagtcactatgcccgatatcgtcggcaagacgaaggacgaggcacagcaggcgctggatgatcttagactcaccaccaattggacggaatccttcgacgacaagattccacaggggcaggtgatttccgcttccgtcaacaacggtgatacgttgcattggggagacagcgtcgacgtggtggtttccaaaggaccggaaaccataaccctgccgaattatgtggggcagaaagcctctgacgccaaagccgcattggaaaaactcggattcacggtcaaggtaagttcgcagctcacgttggattccaatcaagacaagaaggtcgcttcgcaggatccggtaggtggcaccgaagtgcgtcttcgcgacgagaacggcataccaaccaccatcacattgaagatgtattcctcactgttctaaaaaatgcattacctgctttgccaaaacatcatggtataggcataaggaaagccccggctcgtgtagtgtcgtgccggggcttttctctttggtttctcagctgttcgcctgttcggcggctttctgagccttaagctgttccttgactttctgagcgtattcgttcacgtattcctgaccgctcatcttctgaatttccatggtcacgcgatcagtcagcgtgcgcaaatcgtcgtgcgtgatctggtcggcgggcttcttctccacggcaatcggttcgccgtagatcactgtggtcttgcccttaccaggaataatctgaccgggcttctgcaactcgcgagatccgataatggcggacggaacgattgggcatccggtttcaaaagcaagtcgcgcagctccggtatgacctttatagaggcgaccgtcagggctacgcgtgccctcaatatgaatgccgaacaggtggccgtcttcgaggatttcacgcgcgtggttcaatgcgccaagcgatttcgacccaccggaacgatccacggggaacacgccaaccgaagtgaaccaccacttcttgaacttgcctttgatgcccttgccttcgaaatactcggctttgcccatgaaatgaatcatgcgcggacaagtcagcggcaacagcgcgtcatcgatgacggcaagatgattggctgcgataatggcaccgccttcgcgcggaatgttttcaagtcccttggcagtcggtcccatgcggtggatggcgatcggtcctaggcctttgacgaaaaaccagtagagcatttttcacgatcctcctagcggatggccatccgcttgattacagttatcagtatgactgacctcaacaatagcaatgccgatgaagaacgcccaaatgccgcgccgaatggtggcgaaggggcttcttcaaatgcggacgatttggatgccgcatgggctgaattcgcaagttcgcatgccgacgatttgcaggccgtggagcattctcgtagcgcgaaacgttttgaaaagcatgcgcagcgccgtgagaaggaggcgttgctttcgattcaggatttggatcagggcacgttcactgatgacactccgcaaggtcgtggaccgcgcgatttcactggttccagctggttggacaccgatagtgtaatggatcgttacggtgatgatttcactcctccgaatccctccatcggtcatgtcaagatatcgaagttggtgttttgggtgcttttgatcgctggtgtcgccggtatcatcgcatctgcattcatgcctgctttggctgggattttgggatcgattttcggtgtgtgcacgttgattggcgctgctggattgatcgtacagcacaagggacatacacaaacccgccgcgatgttttcgatgatggagctcgcgtatagcaacatatggagaagactgcatcagctacgtcttttgtgctcttctctgtgatatttgtcgctgcgatacgtataaggcgtgtctcgtcgttgagtgttttgacgagacacgccttatacgttcttatgatctgctatttcgccgaatatcaagctttcttggactgggcggcggtgatccactggtcaagcagtgccgaggccttgcctgaatcaacggtttcttcggcaatggcataggccgctttgaatcgttcagtcaggctggcatcagctggcacctgatggccgtccgcaacaatcgcggatgccgcgttgagcagggcggtagtgcggaaaggaacgtccttgcctgcaaggaagtcacggaacagctgagcgttgagctccggctctccaccctttaagtcagccaccgtcaccttgtcgagaccaagctccacagtcggatcgaattcactctcagtgactttgccgttgctgaactcccagatggacaccggaccagtcggagccatttcgtcaagtccctcgcttgacgtgtacaccatgccggtctgtccattagccgcatataccgcagccatgatcgggctcattgcgcgattggcacagcccaccgccatgtgcttcggcgaggccggattggtcagaggtccaagaacgttgaatacgcatggcatgccgagcgccgcacggacaggtcccacgaagcgcattgccggatggaatgtgcgtgcgaaagcgaatgcgatgccgcattcgttgccgacctcagcaacctgttccggttccagatcgagcggcagtcccagcgcctcgaagcaatcggcagtgccgcacttggaagaggctgcacgattgccgtgcttcacgactttcgctccggctgcggcagccaccaccgcgcccatggaagacagattcaccgtcgcggcgccgtctccaccggtaccgacgatatcggtggtctcaccgtcgatatcaagtttgatggcatgggagaccatggccttggccgctccacgcacctcatccggagtcaagccaagctgctgctgggttgccagaaccgcaccgacggccgccggattagcgttgccgttcatgaggtcatcgacgaaccactcggattcctcggcactcagatggtcccctccgaccagcttggtgaggatcgacttccatgtgatttcagccatgatgccctccttgacgcttcagcatgtcacgttgttgatacgatatcgccgccattgtaaccgttctacatttcatggtttttcaacgtccatatcacgaacaggtaattgcagaaaagcgctcatcataaacaacacagacattttcaatatctatcttccgcatatcgggcaacgagcatgaaacaaaaaggcggtctgcgaaaaatccgcaaaccgccttcattatgcgcgaatcatcagagcatcacacgatatgtcactgttcgttctgtccgtggcacatcttgtacttacgaccggaaccgcacgggcactgggcgttcttgccagttcccgggaaggtgcggccatccgcccacggagagcgcaattcctcgctcttcgggcgcttattggcaggaaccttgccctcagcatggctgatcggctgcatgcctacgatgccaggctcattcttctgttcttcggccagttcgtcgatgacggtcttctcggcctcatcgtcggtttccggctcggcaggagcggtttcaccggtcggctgcgcttcgctatccaggcccatcaccgcttcggctgcgttcacggcctcttcctcatcggattcggtttcggcgtcttcggtggtggcgacacgatcgatgtcaacgtggaacagcagctggatggtctcctccttgattgcttcaatcatggagttgtacatctgatagccttcgcgctggtattcgaccagcggatcgcgctgacccataccacgcagaccgatgccgtccttgagataatccatctcatacaggtgttcgcgccacttgcggtcaagaaccgcgagcacgacacgacgttccagctgacgcagaccctcttcaccaagcttggcttcgaagtcggcatactggtcctttgcgtcggaaacgataagctcctgcagggctacgatggccttgtctcccttgagcttggagacagcgtccttggcggcttccggatcgacggcaatcgggtacacggcgttcagagccttgaacaggccttcccaatcccaatccttcggcttgtcagaacccttgttggcgcccttgatgtagctcaataccgtatcgtcgatgaacttgaggatatcctcgtggatgtcttcgcccttgagcacagcctgacgctcggcgtagatgacggtgcgctgcttgttcatcacgtcatcgtacttgagcacgttcttacggatttcgaagttgcgggattccacggccttctgtgcggtgcgcacgcccttggaaacgctcttcgcttcgatcggctcgccttccggcatgcccttggccataacgcgggccacgagctgggtgttgaacagacgcatcagatcgtcttcgagcgacaggtagaaacgggactcgcccggatcgccctgacgtccggaacggccgcgcagctggttgtcgatacgacgggattcgtgacgctcggtaccaagcacgtacaggccgccgagttcaacgacctcttcatgctcgtccttgacctgctccttgatttcggccaaggtgcccggccaacgcttctcgtactcgtccggagtgtcatccggagaatagccttcggacttgagcttcgcatcggcaaggaactcgacgttgccgccgagcatgatatcggtaccacggcctgccatgttggtagccacggtgacggcgcccttacggcccgcgacggccacgacggcggcttccttgtcatgctgcttcgcgttcagcacctggtggggaatgttggcaacgtcaagcagggacgacacgatttcggaggattccacggaagcggtacccagcagcaccggctggcccttcttgtggcgcttggcaacatcgcgcacgatggcggcaagcttctccttcttggtacggaagatcaaatcgtccttgtcttcgcgaatcatcggcttgttggtcggaatcgggagcacgcccagcttataggtgcccatgaactccgcggcctcggtttctgcggtaccggtcatgcccgacagcttgtcgtacatgcggaagtagttctgcagggtgatggtggcgaaggtctggttctcagccttgacttccacgttttccttggcttcgattgcctggtgcagaccttcgttgtaacggcgtcccggcaggatacggccggtgtgttcgtcgacgatgagcacttcaccgccagtcaccacgtagtcgcggtcgcgcaggaacagttccttggccttgatggcgttgttcaggtagccgatcagtgcggtgttgttcggctcgtacaggttgtcgatgccgagataatcctcgatcttgttgatgcctggatcgagaatgccgacgaccttctttttctcgtcgacctcatagtcctcgtcacgggtgagcttgagcaccagacgtgcgaactgacggtaccaacgggtcacgtcgccttcggccggaccggagatgatcaacggggtacgggcctcgtcgatgaggatggagtcgacctcatcgacgatggcgaagtggtggccgcgctgcaccagatcggacttttcccacgccatgttgtcacgcaggtagtcgaagccgaactcgttgttggtgccgtaggtgatgtcggcgttgtactgcttgcggcgctccggcggtttctggttggtgatgatgcagccggtgctcatgccgaggaagcggtagacacgacccatcagctcggcctggtagcttgccaggtagtcgttgacggtgacgacgtgcacgccctggccgtcgagtgcgttcaagtatgccggcagggtcgccacaagggtcttgccttcaccggtcttcatttcggcgatgttgccccagtgcagcgccgcgccacccatgagctgcacgtcgaagtggcgcaggcccaaggtgcgcttggatgcctcgcgcacggtggcgaaggcttccggcatgagcttgtcgagggattcgccattgtcgagacgctgcttgaacttggcggtctggcccttgagctcttcgtcgttgagcgctgcaatctcatcttccagcgcgtcggtcgcctgagctacgtgctcaagcttcttgatctgtcggccttcgcccattcgcagggctttgtcaacgatatctaccacaatcactccctttgtgtatgcgagttatctcatctgagattagtcgctgtttaacgatttccgaaaaacaccgtccattttacgtaactttcagcttgttgcggccttcttccattcgacacaccaccttcagacatgaaaaagaggcccgcacatacactgcgcgagccccgttcggtcagattatctccctatccaacctgttgcacgtcttacttcgccacattctccggggtgtcgatctcgaagacgccatagctccagccgtgacgatggtagacgacggacggacgaccggtctccttgttcacgaacaggaagaagtcatgtccaatcagctccatctcatacagcgcctcatcgatggtcatcggctccgcgatatgcagcttgcgacggatgacaatcggggtgtcgcctacttggacttcgacggactctcccggacccagctcagcggcgacggcttcggccgggctgttattcggcacttcgaccggctcctcaacttctggagtcggctcgacgacaccaagatcgaccgggaccggatcgctgtagccacgacgatgatccttgcgacgatcacgggtgcgacgcagacggagggtcagcttgtcgagcgccatgtccagagcgctgaactcgtcggcgctggaagcctcggcgcgcaccacggtacgacctgcgatgacggtgatttcaacgcgcttggcggtgtcggcctgacgcggattgccctcgtgcgacaacacaatctgaacacgctgcgcatccggggcgatagcggtcacacgattcatcttgctttcgacaacgtcacggaacctttgcttaatctgcgtatgacgtccggtaacgacgatttccatgtggacctccctagactcaagcggtgttacccgctatatacggaccaaacagctgcttcgctgttcggtagtcaacattgtagccgcaacattgtgatttcactgaaaagttgacgcaagaaaaataaagtttttttgattttcctttcgtccgtttttttgctatcatagtgcatttgagacctcttgatggccgcgaccgatccgtcggttgaggaacttccgggctccatagagcacgatggcggataacgtccgcccagggcgacctgagagatagcgcagcagagaacagaccgcttatcggtttcgaccggtaggtaagggtgaaacggcggtgtaagagaccaccgggccactggtaacagtcggccgcatggcaagcctcatcgggagcaaggccaagcagaaggcgtttgagggctgctcgcccgaagccttcgggtaggctgctagagcctgacggcaacgtcaggtcgagatggatggccatccgtgcctgaggcacgacagaacccggggtataagaggtctcactcctttatcacaccgaccgattcccgtggcgaaacagtgtttgaaaaccgcataaccactatgcgaatcagtcgtttcagacgaacaattcctgtgcgattttccgcagaacttcaggattatggcctttccgcccaccagcactccagaaccgtcttttacgcacctcgacatccaatccagcagtttttcttgctgtccgacgtcccagctcccatgcagcctcggcgaacacgccttgggattcggcctcatcgcacacacgttgcgcgagctggcggtccacacctttgcgtttgagctccatgaccgctcccctataccccatcagtcgtgatgcgcagtaccgcaccgcggactgggcgtacgcctcgtcgtcgatgagacggacccgaatcagtctgacgatcacatcgtccaccacctcggaggcataccccttgccgatgagtcgctcccgtatcgcgcctgacggacgcggcgccgcatcaagcagccgaagggccgcctccctgcatgcatccaaatcattcggatcgtcaggaatccgcgacacgccgactgcgacacgccctgagtgtcgtgcgtgtcgcgcacgcctcggcgtgtcattgccgccaatggacggagttcggtcgtaatcgaattcggttcgaccggcctgcggccgaccaccgcaggaaagggcaaggcccccaacctcggatgataccggctggaggccctgctgttcaagaaatcgctcagcgctgatcatacgtcacgccttgccggctgacttggaagcctttgccgcgcctttggctgcttccggcttgccagcatccgctttcgccttctcctcgcttgtggcattagacgcagaagcctcattaccatcttcggcaaattggtcggtgggctcaatgagaccaaactcggccttcaccttattctcgatctcttcggtaagctccggattgtctttcaagaattggcgtacgttctcacggccttgacccagttggtcgccaccataggtgaaccatgatccggacttcttcacgacattgacctgcaacgccatgtcaagtacggaaccttccttggaaatgccctcgccgtacaacacgtcgaattcagcggtcttgaacggcggagccatcttgttcttgacgaccttgaccttggtgcgattgcctacagcctcatcaccattcttgatggtctggatacgtcgaatatccatgcggacggacgagtagaacttcaacgccttgccgccggtggtcgtttccggattgccgaagaacacaccgatcttctctcgaagctggttgatgaaaatggcggtggtgcccgcctgagccaaagcgccagtcatcttacgcaatgcctggctcatcagtcttgcctgcaaaccgacatgactgtcgcccatttcaccttcgatttcggccttcggcaccagtgcagccactgaatcgatgacgatcacgtcaagcgcaccagaacgaatcagcatatccgcgatttccagcgcctgctcgccgttatcaggttgggaaacaatcaacgaatcagtatcgacgccgagcttgcgcgcatagaccgggtcaagcgcatgttccgcatcgatgaacgcggcgacgccaccgtttttctgggcattggccaccacatgcaacgccagtgtggtcttgccggaggattccggaccataaatctccacgatacggcccttcggtaggccgccgatacccaatgccatatccaatgccagcgatccagtaggaatcacctcgacatcctgctcgggacgatcgcccaatcgcatggccgatcccttgccgaaactcttctcgacctgcgcgagcgccgtatcaagcgcagcctgacgacgcgggtcgatgccgttcgcggacttgttctgtgcggctccctttgccgcgctcgtctgtgccatgactactccttttgctgactatgacgaatggtggcttcaccgtaaggccacggcattcgttcccgcaaatctaacggccgttgtggtcggaggatatgcgatctaacgagtcataaccaacatttcttggaaaatcaacgttttcacgcgatctgaagaatttggaaacagcccgtctaggttgttgtctgtggataactatatcccaacatgcgaacatctgttcgaagaggcgtgttgtgttcggaaaacgtctcagcgcaccggcataggaggcgcgttatggtccttgccccaacgctgggaatcgggaatgcccatctggtcgcataacacattccagaccactcgcggctcctcaccagcgccaagcgcgtccaccgccgtcatgccgccaagacgatcaagcacctggtcatgcgccagcgctcgaccatagctacgaccaagcacctcttcaagtaactgccaaaattcacgttcctgcacgtgccccagtgtacacagacttgaatccatgtacagacacgaaaaacgcccggcgaacaatcgccgggcgtcaaccttacattcgaatcaggcagccacagaatcgagatagtcagccaccatgcgaagcatctgggctgtggacagccccaaggactgcgcgatggacgacagcagttcggaactggcctccttctggccgcgctccacttcggaaaggtaccccaaagacaccccggccttttcgctgacctcgcgaagcgtcttatgatctcgcgtgcgcaggtcgcgcagcacatggcctatggcttcacgcagcgaaacctccttagcctcatcgggctgttcctgagcgtgcggcacagcatgcgtgcgtacccgatcggagtcctcttcctgccacattcgcgtcaatgcggcctgacgctcatccttggcctttttcgcagcgcgcgcacgaagcacctgctgctgcgcgaacatcacagcgcgccgctgagccggcgtaagctccctgacacgagctccggcagcctgcgcagtcgcaggagccatagccttgagttccctctgctctttggtgagtgtcatcatttccattcatcagcccctttttcgtgcgtacgtctgtccactatggtcaacactcatctttgtggattattcctgtgaatccgctgaaagctccctcagcttttgcagaatacaatgcacgacgccgcgtcgcacgctctccctatctccctgcaggcgaagctcaaaagcctccgttcgccgagagcgaacacctccgaacccctccggcagggaacaaccgacatatgcaagacctgccggtttatttccatcaggtccaggccccgccactcccgtggtcgacaatccaataacgcagtcgccatccccctgctgccgatacagcctcgccgttccggcagccatctggcgggccacttcaggatggacagccccctcgctgcgcagcagttccgcatctacgccaagaatcgaggccttggcacgaatgtcatacgtcaccgcggaaccgagaaaaaccttcgacgctcccggcacgcgcacgaaagcgtcggccaacaggcctcccgtcaacgattcggcggctgcgatcttgaaatggttggtttcgcaatatgcaagaacggccgcagccaattcatcgcattgcgattggttggcggcagccgtctggttcatagattcagtcatgaatgccttacttggtttcttttccggacttgcccgcggacttcttacggccgccgaacgtattgaccagatactcgccaccggaatacaggcagagaatcagcgcaaaataaatcagcgcatacgtgatggtgtagtagacggtcatccacatcggggtgtcgttgaccccttccggcgccaagctccacataggcagcatgagcatggccagaccaatgcactggcagagcgtcttgtatttgcctgcctgggatgcggcgatgaccttgccgcccgtgtcgatcacaaagaagcgcatgacggtgatgccgatctcacgaatcaggaacagggcggtcacgacccatcccagcaccggattgccaaattcgttgaagatggcggcaacgatcagtgtgccgcaggtgagcagcttgtcggcgatcgggtccatcagcttgccaagttcagtgacttggttgtatttgcgggccatccaaccgtcaagcttatcggtgcatgccgcgatgatgaagatgacagcggcaacccaacgcatggtgacgttgtccacgccccacgcgccggctttggcgtacagcgccaaaaacacgatgaccaaaatgatacgagagaaggtgacaaggttcggcggcacgttccagccgtcaagcaacgatgatttgcgttcttcttgcttttccataccgttcacgttaccctgacacttctacttgcttaccaatttgcgtttcatacggagcgttccccagtcacatcgccgcttcggaatccgccgccgaagagactcccgaactcagcgacgaggtctcacccttgatgaaggcgagcacctgcggcaagtcctggggctgcaccaacacctcgcgcgccttggacccttcggacggccccacgacgccacgtgactccagcagatccataaggcggccagccttggcgaatccgacacgcagtttgcgctgcaacatggacgtggaaccgaactgcgaggtgacgaccagttccgccgcctgcagaagcacatccatatcgccgccgatgtcttcgtccggctcaatggccttcttgtcggcttccttggccatttcctcgatatcctcacggtaatgtggcttgcgctgggtgcgtacgaattccacggcacgtcggatctccgactcgtcgacccatgcgccctgcacacgcaacggtttggcctgtcccatcggcaggaacagcgcatcgccctgtccaatcagagtttccgcgccagtggagtcgagaatgactcgagaatcagtggccgacgaggtcgcgaacgccaaacgcgaaggaatgttcgccttgatcaggccggtgaccacatcgaccgatggacgctgggtggcgagcaccagatgcacgcctgcagctcgtgccagctgcgtgatgcgttggatggagctttccacatcattcttggccaccatcatcagatcggccatctcgtcgacgaccaccagaatgtacggatatggagcgaccttgcgcttcgatccggcaggggcatgcaccttgccggcgcgcacggcagcattgaagtccttgatatggcggaatccgaagaattcaagatcgctgtaacgagcatccatctccttgaccacccattcgagcgcctgcgcagccttcttcggatcggtgatgatcggcgtgagcagatgtggaatacccgcgtatgccgatagttccactcgcttcggatcgaccatgatcatgcgcacctgatccggcgtcgccctcatgatcacggatgtcagcatggagttgatgaagctggacttaccggaaccggtggcgcctgccaccagaagatgcggcatcttagtgaggtccgccgttacaaaatggccttccacatccttgcccacgcctgtgagcatcggattcggatcgtttctcgccttgtccgaacgaagcacatcgccaagcaccacggtttcacggtcggtgttcggtatttcgatgccgatggcggacttgccttcgatcaccgacaggatgcgcacgtcggaactggccaccgcgtaggcgatgttcttctgcagattggtgaccttctccactttcacacccggaccaagctccacctcatacatggtcacggatgggcctcgcagaaagccgatgactttagcgtcgacattgaactgctggaatgtgaccgtaagagcgcggatcacacgatcgttctccggagtgtgcacggcatgcggcgcgccttgcttcagcatgccgagatcaggcagatgataggggccctccggaatctcaccggactcgtcggaaacgccctctccgttcgatccggcatccagatcgttcacgacctcattggtcgccgcatcgaccatgacctgcgacccgttggacgtgccgtcctcgtcgatgacggcccacgggtcccctacagccacgccaacggatttgatctcgtcggacgccgcctggccggcaaccgtcggaatggtttccgggatctgcggcatggtgccgctcgccaaaccgattgggtcagaggaaagggaacgcaccacaggcgtctgcggcatggcgacggttccaccgaaatcctgagcggaatgttcgtcggatgaaatgctgcgcggccgcgagacgctctggtatggttcgtcaagcatggtttccgccgtttcgccatgccgttcggcagcattacgaaacgcctcatcaccgtcgtaatgatcgagtccgtcctgagcgccctgcttcttggatttcgatgatatccattgctttatgagggagaacggcatcggcttcttcttttcagccgccacatcgtcggctccattatgcgccggcacgccttctgcgaacgacagcgtggtatctcctatacgcacttcgttcgggaattgctcggtctcgtcatcaacctttttatttgcaccgaatccaaaacggaccttcaatgcacgtactttgtcgggaatctcttgaacccctgtattggtaatcagcaacaacgagaacaaaatgacgaccacgaaaataacgatggcgaacgccttggaaagcccccatgccagcgggcagccaagcacatagccgagcagacctcccgcattctgcagcaacgccatgtcgaaaccttgggcgtcggacgcgagcgccgcatcgagtatggagcagacggaccacagaatcatggaccaccccgccaccatacgcacattgccgcttttgcgcttggtctcatatatgaggctgaatgccaccagcgccaaaaagaccggcaggatgacgctcatcagaccaaacaggccggaagccaaggcgtggagcatccggccgaacacgccctgcacccggaaccattccgaagcgcagaacattaccgcgagaatcaccagaataaaacatgcgatatcacgtccgtacttggtcaagacacccatcacaggcgacggctcgaccgcgtccatgaccttggtctcgccggaacgtgccttgcccgtggaccctttgccgccggatttcgtattggaagatgctgttcgtgccataacggtcatgattttacccatgggaggcgccatgacatggcacttcctcgaatcgcacacattttctaacttaagtgaacacgcaatttcactgattggattccgccaagatcgtcaccgtcaatctggaggccaagccggagaagaccgtggataaggtggaaagcttcgacgaatacggcagcgggagtttcatttcaggcgaggtctccgagatgatgctgggtgtaggcgtccgcctgtgcgtctatgacgtcataggcacctgcatcggcatgttcgatgatggccatcgcgttgtctagcagcgccggattgagcgcttggagccagtggatgcgcgggtcacgaccgaaccatcccatctgcttgcgtgccagacgcttcgttttctgcgcaatgtccatgaacgtgtcgttcaggtcacgcaacccgtccaaatagtcgacgacctgctggtaaccgagcgctttggctgcggtgatgcccagcttgggacggatacgttccacttcttcgatgaatccgccttcgagcatctgcttggtgcgaatatcgatacgacggtccagttcctcacgcggcagatcgagaccgatttgcacggtggggatgacgtaccggtagtgcggaaggcttgccgaatagggtcgtcccgtcacttcgatgacttccagcgcgcggatggttcgtctcggattgtgcgggtccatgcgcgccgccgcttcgggatccttggctttcagctcgtcgaacaacgcgcccgcgccttcggttttttcccgttcctcaagcgccttgcgtacttgcggatcggtgccggggaaggagatgtcgtcgatggcggcccgtgcgtacaggccagagcctccgacgaggatcggacgcactcccctggcctgtagttcggctattttctcgcgggcgagctcttggaacctcgccacggacatggcgtcgtccggttcgatgatatcgatgagatgatgcctgacctgcgcctgctcctcaaggcttgccttggccgtgccgatatccatgccccgatacatctggtatgcgtcggcgttgatgatttccgcctgttcgcctttgcgcgccaacgctttggcgacggcaatgcccaacccggttttgccggatgcggttggtccgacaatggatacgaccttgcgctgcatggcaggatcggcgtctcctgttttgtctgttttctcagaggtctgttcagtgtcgaacggcataggtctgccccgccttcagatcgggatcggcgatgaggttgtgacgcccagcgtgggtgatggtggcggtcacgaaatcgcctacctgcggcatcggctcgccttcgggcacaccgacatgcacgagcacgccggttttctcgcgcccggtgacacgatgggtcgcggcgtccttcttgccagatgcgccggtgaccatcacttcgacgtcacggccttcgaaggttttgagattttcttcggtgatgcgttcctgcaatgccacgagtcgttcgaaccggtcttggaccacgtcgtgcggcacctgctccatttcggctgccggagtgcctgggcgcggcgaatagatgaaggtgaatgcggacgcgaatctcgcctcttccaccacacgcaaggttttctggaagtcctcttcggtttcacccgggaaaccgacgatgatgtcggtggagatctgcgcatccggcatggcctcacggattttacgcagaatgtcaaggaacttcgcggaacgatacgaacggcgcatggcgcgcaggattcggtcggatccggactgcagcgggaagtgcagctggtgcatgacattgggcgtttcggccatggctgcgatcacgtcgtcggtgaaggcggcgggatgcggcgaagtgaaccgcacgcgctccaatccttcgatctcaccgcatgcgcgcagtagcttggagaaggcgaaacggtcgccgatgccgtaaccgaacgagttcacgttctggccgagtagcgtgacttccttggctccttcgtccacgcactggcggatttcggcaagaatgtctcccgggcgacgatcatgttccttgcctcgggtggtaggcacgatgcagaacgtgcaggtgttgttgcatcccacggagatggccacccagcttgacaccttcgacgcgcggtcggtgggcagctggcttgggaagtagttgagttcctctttgaccttgacctgcgcatggccttcgatgcgcgcctggtcaagcagctgaggcagggagccaatgttcttggtaccgaacacggcatcgacccaaggggccttttttgcgatcttctcacggtcgagctgtgccatgcatccgccgactgcgatctgcaggttcggacgctggcgcttcagttcggcccacaggccgatggtgccgtacatgcgttccgccgcgttttctcgcaccgcgcatgtgttcatgacgatgaggtccacgtcatgatcgaggtattgttcttcggtggcgggcacatagccatccgcttcgagcacacccgcgatgcgttcggaatcgtgcacgttcatctggcatccgagggtgtgtacgtagaacacgcccttgcctcgcgtggcggtgtcttctgtggcaggttccgcaagtttcgaggcgcgctccgcctcggtcatcatgtcttcgttcatagcattccatgctatcggcagggattcccatcacgcgccgtatgcaccttaatgcagcgtggcatgcggtggaattggagggatgacggcgctttcagcgctttttcagtttttccgcgctccttttgggtacactatggaaccgtgatacttgatagacagagccgcatcaataccagtgaactgcaagcacggctgaagtcggtgactttcgacgatggtccgttgccttccgatcagattaccgagttcattgatcaaatgcaggtgtatgagggcgcgatgtatgagatcagcaccaaactggagattctcgattccgagttccaggtgcgtttctcccataatcccatccatcacatggaacgcaggttgaagtccatcaattccattctcggcaagttgaggcgcaaggatctgccgttgacggtggagtcggtcaaggacaatctgtttgacgtggcaggcattcgcgtgatctgcaattatcgcgatgacgtgtattcggtgtcgaattatctgtccgcgcagaacgatattcaggtgttgcgtgtgaaggattatattaagaatccgaagcagaatggatatcgttcgctgcacgtgatttatgcggttcccgtttttctatcttccggaccgcattacacgcctgtggaggtgcagttccgcaccatcgccatggattattgggcgagtttggagcatgcgctgcgttataagacggatttgcctgacgcgaagctgtcggagcattcgcagacgttgcttgattgcgcgagaagtctgcagaatgtcgaagcgcagatgcagaacattcatcgcgatatcaatggcgcgccgcaggttggcgaggcccctaaggccggctgacgtctgccggtttgcgtttggccgcatgcaggagctggtcgatgggcagctgggcgagtatggtgcccgcgaaaatgagcgcgcagccgaggtaggctcgagtggtcatgatttcgcccagcagaagcgcccctccgactgcggagaagaacgattcgagcgacatgatcacggacgctctggtcggaggcacaagttgttggcctatgacctgaagcgtataggctacgccagcagagcagacgcccgcgtagacgatggcgatccagctttgcgcggcaccggcccagtcgatggatccttcgatgatagagccaatccagctgatgatcgcggtggtggtgatctgcccgaatgaaagcaggatggggtccatgtctcgtccaaaggtgtctatgacgaggatgtgcccggcgaagaggactgcggtgaacagcagcaccatgtccgccagggtgatggatccgaatccgtcggtgacgcacagcaggtagaagccgataacggagatggcgacgctgatgatgacgctgaggtgcactcgtcgacgcaatatgacgaaggcaagcagtggcgtcatgacgatgtatagagcggtgatgaagccggaccgtcccgccgatccggagtaaaggatgccgtattgttggacggtgcttgcggtgaaaagcacgattccgcagatgatgctgaccacgatgggattgccggcccatttcggcatggcgacgattgcgccgttaccgagggtgatggacggttttccctgggtttcacggcgtttacgctcttgttccgctatggtgctgcggcgaaaccaaagcaacggtatcagagaaatggatccgagggtgaatcgggtggctccgaagaacagcggtgttgtggagtccatgccttgcacttgcgacacgaatgcgaatccccaaatgagggccgccagtacgaggcatgccatgccgccaatctcttttctctgcatgagcacccaccgtaaagcatgtctttgaccaacggataaagcctggccacattctggtcaggctttatccgttacgttgaccgaggagcaatgccaataatgtcccatcaaaggctgaaagccaaatgacgcgtgcgtccccaaaacgcaccgaaggaaggcgcacgaaggtacgccgactgaggagcaatgccggggacgctccgtcatttggatttcagtcgcgattgccgaggagttggagaatatacatgaacatgttcacgaaatccaaatacagattcagtgcgcaaaggatggaaaccttcttgaccatttcggggccttgggcggaatactgttcaagcatggcgcgggtggcttgggcgtcgtagacggtcatgccggcgaagagcagaagtccgatggcagagacgatcatgagggtggtgttgccgggggcgaagatcatgagaatcacttcggcgatgataagcacgatgaggccgacgaaaaggatggggccggccttgagcatgttgatcttggtggtgcgtccgaacatggtgagcgcgaagaagaagccggcgcacaatgcgagggaaatgccgatggtgccaagatcgtaggccatgaagatggtgctgagggtgaagcccatgagcgccgcatacacgtagaacatgacgtatgcggtggagaccttcattgtatggatgcgcgcgccaaggtagatggcaagcacgatttcaatgacggcgggggcgaagatgccgatgatgcccgtggtttggatgagtgccaggtacgcgccgctcatttgggtgatgatggcgaccacggcagtgacgatcaaaccaagggtcatgtgcgtgtatgcgctgttgacggaactgcgttcggcctgctcgtaggaataggtggcctgcacgttgactgcggcggtaccgttgggcgcataggcgtactgtggctgcgcattgtactggttgtactgttggttgtactggtattgattgttgaagccgttattctgggcgttgttaccctggggctgctgaccgaatgccataatcgctcctttttgctcgattgcgcatcacgatacggcattttcctgacgatttcatgaatattggcttaatctcatgatttcttcaaagcccgcataggtttcgcgttcgacacggggagtgtgccggacgcgaaagactgggacatgccatgtcagatggcgaacttgtacgtcactttggcggtgtcgctgaaatcgagaaggttcgtcacgtcgacggtgatttcggaatcgtctttaagcacatatccgagggttaccgtgccggttgctcctggctgcagttcagacagataggagccggaatcgtagccttccggattgtccaagtacatggcggtgtcgagttcctgaccgttttggaacactttcggattagccagcatggcgaaggagttgttcttatcggtagtgttggtccactcgtaggtgacgagcacggtcggctgattgttgtagtcgttgccggaacgcactgcggatacgattttgacgtgcatatcggtgagatcgccttccatgtcttgctcgcctttcaccttggtgtcggttttggtggaatcatcggttttggtggaatcatcggttttggcgtccttatcggcgtccgccgacgaggattgcgacgtgcttgtgcccgtgatgtcgtcaagcgccttgctggcggccgattgcatggccaaggtgatgacgatggccaacaccgacagcaccgccgcgactatggacagggctttgccacgctttttgcctcggaacgtgcccacgatggccacgatcgccaataccgcgccgacgagtccgaagatcgcagcgatgttgttgatgattggaatgaagctcagcaccaagccgagcgcgccgaacaccactcccacgatgccacataccgtcgtgccttgcggagccggggacggcatgatcggcgcgggtctcataccgttcggcgctgccgggccgccgttgggaatcggagcattgttgaactcactcatgatctttttctttcttctcgaagtggtcggaacactttcgagcctacgggatcggcttcgttcccggtattggacgaaagtccattcctgcctgcactttggggcgcgcggcttgcgccatcatgcccgatagctcaatggcatgtttccatgagtatgccgataatgggagtcatgagcgtgatcacaaacccttccaccgccgaagtgccagtgcgcaccagaatctggtgcacggtgccgatggtggtgtgcgcgagtttcgcctgtctggcgcaggtgtctttcgcatcccaacagtatgcgcaggatagtgccccctacttgtggatgatcgcgtgcgtgctcgttgcgatcccttcgggtttgattcttctggctcgcaacagttacccgcaagccgtgttctggaccgcatgcctactggtggtggcgctcccctacgattcgctgatcgcgcttatggcgttgacttctctgcttgcgcggagacagggaaccaaagtgacgcttcgatcagtgcttgccgcggcgacaacgacgatctggtcccaggtgcgagacgctttgcatcctgccgaggcttcgatctggcatgcgatcttctccaaaccatataccggagttcggtatggcaataccatggtgatgcttgtcgacgaaagaacgatcatcgcgagcgccgttgtggttgccctgattgcggtggcgatcgccacattggccggattgcatattcgctcgcgcgcccttgcgcgcgtggccgaagcgaaggctcagtcggccaacgagcaggtgagcaggttgcggaccacgcttgacaatcagcagcttgccgatgcgatagccgcggaagcgcatgatacgttggctcattcgctgtcgttgcttgcattgaatgcgagcgctttgcaggccgagtctaggaaattgaaggctgaggccgagcagttgggcaatgccaatgtggctggtatggctggaaagatcgccggcactaccgaggatattcgcaggcaggcctccggcgcgttggatgaggcgcatagtgtgattgacatgcttcgtcatccggaggatgctcgcctgcagttggctgcgaatgatgccgaagcgtcgttgacccgtgactcattgctgcagttgattggcgacgcccgtgccgcgaatatgcggattgatacgtggatcgacgttcaacagctggggcagttagatgagtccatcggcgtgattgcgtatcacgtggtacaggagggattgaccaatgtgcgcaggcatgcgcctggcgctccggtgtcgttgcaggtcgatgcgaaccccccgcaaggggtgcatgtgcacgtcagcaatccgacgatgccgcaatccccctcgcatatggcagacaccaggaagggggccggtcttcctggtttggccaaacgcatacagcaggctggcggaacatgccaatacggttttgaccaacataacgtcttccaccttgatgtacgactaccatgggttgggtgagcaccgaacgcaaccatgacgagcagccgatcaccgtcggcgtgattgatgatgatccgatgatctgccagatgatgcgtctgattttggaggattattcctccggacgcatcagcgttgccttcgcctgcaccaacgcagcagacgccatcgaacatgcgtcgcacaatcctcctgatgtcgtgctggctgatatcgccatgcccggcatggatggcattgaagccactcgtcagctccgcatgcttcccgatcctccgcatgtgcttattctgacgtcgctgagtccaaacaacacggtggaacgcgccatcgaagcgggcgcggaaggattcgtatcgaaaacggacgctccggaagatatcatccgccgtgtggccgacgtgtgcgaaggggagccacagttcaatccggcaagtcaacggcagctcatcggcgatttgcatcaacaccagcctcagtcgcggcgcgatgaggcccgtgccatgctcgacgccttgccggaacgcgaacgcgaagcggtgattctcgcggccgagggcttcaccaatgcggaaatcagcgagaaaatgttcatttcagaacgcacggtcaaagcgcatatttcatccgccgcagataaactctgcatgggccgcgtgcagatggcccgtttggtagaacgagccgacctgccgccacgactatgacatcatgcatcgtacacttgaacacagagcaacgcaatgaggggaacgccatgtcaatcagtgcaacggaaaagcctttaggcaaaatcttcacttcggattaccggttcgtaatcccatcattccaacgcgcatatacttggcaaacggaaaacatcgcgcaactggtcaccgatctgcaggacgcatgccacgacccggacacgccgtatttccttggatcgctgatcctcgtccatgatggacagaccaaataccaagtcatcgatggacagcaacgcctcatctcactttccatcatcatttccgtgctccgcgatctggaagacgaccccgaactcgtggaaaacctcaacgacctcatcgtcgagccaggagacaaactacgcggcatcaaagccgaaccacgtctcaaactccgcgaacgcgacaccaacttcttccgcatgtacgtgcaggaaggcgatctggagggactgttcgatctgcgcgacaacgatatcgaatcgcacgcgcaacgcaacatcgccatcaacaccagacaagtgttcgacgaactcgcgaaaatgcccacacaagaccgccgcgcattcgcatcatacctcgtcaacgaagtcaccctcgtcatcgtaaccaccgacgatctcgccggcgcacaccgtattttcgacgtcatgaacatgcgcggagttcccctcaccgcatccgacgtgttcaaagcaagaactatcgccgaaatctcccccgccgcacgcaacgcctacgcttcacgctgggacgacatcatggatccactcggcgacgacgcacagacgctcgaagaattcttcagcgacatccatctcatcatctcgcacaaagccatctgcacacaactacttgaggaattccgcaaggacgtgctcaaaccattcgtcaaaaagcagaacgtcatctccttcatcgacgacctgctcgcaccctacgccaacgcctggcgcatcatcgaacacccgaccgacgccaacctgccagacgatatcattggccaactcgtatccctcaacgactaccaaaccaccgactggaaaccagtagccatgtgggcgctcgtcaactccatacgcaacctcggcaatcccgacacacgcatattctccacgccgggcacacacactgccgcagcctcgcgcacgtcgaacaaaaacctcgaggaacctcaactccacgaccttgaacgacttcacgacgtactcgcggccctagaacgcgtaaccggcgtggacagtctcaacaggcaaaccccgctcaaccgacgcacacgcgcagccagcaccattcgcgacctcgataaaaaccacaccatccaacaaatccgaggattactcatcaccgacgaagaccgccgcaacgcgctcgcgcatctgcgtggcgacctgcagaccagtcccgccatgaagaaactgcttctggttcgggccaacgagcagcgggccgggcatcgtatcgcccgaccacgcagcctcaacgcgctgccgatcatgccggaacaggtcgcctccgactcatcgtttgcatcatggtctgaggcgacgcgcgaccattgggtcaaccgcatcggcaatcttgcgctcagtcaggctaatgacaagcagatcgcgggattggcatcctatacggaccgtcgtgaccgtatgctgctgtcggcgagttccaaacgcttcccgctcaccgccgagcttgccgacattgcggactgtacgccacaaaccttgcaataccgccaggatgaaaccattcgtctgatcgccgattattggaatatccgttacgatgccgagcgcaatgacctatccacgctcagtgaggagtcgttgcgagtcacggacacgtccacctccccaacatccaaacgcgtgtccatcgcgcaggtgctcgccgctggtctgctcattcccggtgagacgctggtatgggaccgaccgcgcaagggcgaacgttgggtggctaccgtcaccgccgaaggcaagcttcgactggatgacggcagcgagtactccacaccaaccgcagcggcccgtgccgtcggtggcggttcggcgggattgaccgtgtggaagcgcacgtcgaacggtcagaagcttagcgacgtgtggaaggcctatcgcctacgcaagcgctgaaaacgttgttcgttttgatgagtttgccgtttatcgacggtttcctattggcatgcgagccattcgaccgcaagtttcgtacgattcgtaacgttcgttttcgcgagaatatcgctgatacgattgcgaaccgtgccttcgcttaaaaacagtttcgcagcgatctcacgattgtcgtacccctcggcgaccagttgcatcacgtcccgctcgcgctcagtgagattcgcgaaacgaccggaaaaacgattttccccgttatcgccagcttgcgaaacgtgacgctgcgtctgactcgctttattgacatgcagtttccgcaacacctgcgctcccataaccacctgtccggccatcaccgactgcactgcgggaatcaccgatgagacatcctgtttgatcagatagcctttggtgccgatttccaacgcctcggcgatgtacgattcgtccgcgaatgtggtaagtatcaggattttcgcattcggatgggcgtcgatgatctttcgcgacgcggcaagaccgtccataaccggcatttgcacgtcgatcagcagcacgtccggattatcttcttcatactgacctaccgcggtttcgccatcataggccgtccatgcaatatcggccgtgcctgtcgctttgagaatcgtggacagcgacgagcatacgattggatcatcatcgacgattgcgactcgcatcatacgttctccttcgttgttgcggacgctgccgcatcatcgtccgttttgggaatggacacgaacacccgccacccctcatgatacgggccgcacaccgcggtaccgccgagcgcccgcgcacgctcctcgatatccgccaatccaatgcccgaagcatcacgcatcgtcgccgtacgcgcggcatcatggaactgacgaaaacgagcggaagactcccccatcataccgttgatgtttccttgggagccatcgttccacagggcgccatcatcctgtatgcgcagctgccataacgcaggaaaatcacgcaaggtgatatcgacattgcgcgccatgctatggcgaatcgtattgttcaacgcctcgcgaatcgtcgtggcgaaacagcgtgacaccgcggccggagccgcatcgatgccgttgctcaaggtgacgttcactgtactggaatcgtccaaaccatgcgcggatgcctcaatctgcgccacgaaatccgtgccttcgtctttcagatcatgcaccgcgccccgcaccaatgtcatcgcctcgcccaccgtgtcgtgaatctgcgcgaacccttgagccgccggctcctgaccagaaacctgagccaccacttgggccgcttcggactgcatgatggcccgggtaagcatatggccgacattgtcatgaatctcgcgcgctatgcgtgtacgctccgcgagcgtggccacacgaaccgacgcggcgcgatcttcctcgctttccgccaattgcgagcgcagccggcggatctggtcacgtttggaatcctgaagccgcctgttctgccgggtgagcgtgacattgcgcgcgcacaacaggccaaccatgaatcccaacactacatgcaatgccagcagtacggcgatgagtgcagctcccatatcatccgcatgcgcgcctgcattacggcaacggaccaaggtcgccactacgggaatgatccacacccatcgtgcgatgaccgtcgtgatttgcatcgcatcgtattgcggcatgttcggcaattgcgaacgcaagccggcatggttccgtcccgcacggtgttgttcgacgttctgtgatatggcgggcagcatggccgcgttgtatgcggcgaccggcatcatcgcgcaccatgatggcgtgaagcatgcgccgcaatccaacatcaacagtatggcgatggtccatgccgacgagcgcgcgtattcccccaccgcggcacagcatatggccagcaacgcgccgcataccagttcagccgatacgtctccgacgatatacaggtttgcgatcagcccgaacgtgaggaatatggcttgaagcaataatcgccgcatgccttcctccatcgtcgccgcttcttgtggttatgtcttcccagcgtagtgtacgttgccgccgttgcgggccatctttgccacgaaggtgacatttgtcatcttccatatggctgtgttgcgccaggtttatgacctcagacaccatgtcgtctccgtttggtcggagacaatggaatcactatcgtaaacggcggttatcgctgttggaacatgtgaggtaaggagagccgatgagcgagcgtatggaaaggcaaacaggtgagagctccagcagcgcggtcaaggtgtcgaagctggtcaaacggtatggggatatgctggcgcttgactatttcgatcttgacgtgcatcaaggtgagattttcggtttgcttggaccgaacggttccggcaagaccacggcgattaactgcattctcgcattgttgacgttcgatgagggcacggtacgtgtgtttgacgaaccgattggcccgaccagttatgcgctgaaacgccgcatcggcatcgtaccgcagaatgtggctgtgttcaatgaattgacggttgaggagaatatcgattatttctgctcgctgtatgtgcctgacagggcacgccgtcatgcgctggttgaggatgcgctggattttgtgggcttgcgcgattaccgcaggttccgtccgtcgaaattgtcgggaggtttgcttcgtcgattgaacatcgcatgcggtgtggcgcataagccggatctgattttcttcgatgagccgaccgtcgccgtcgatccgcaaagccgcaatgcgattctggagggcattcagcgtcttaaccacgaaggcgcgacagtgatttacacgagccattacatggaggaggtcgagcagatctgcgaccgcattctcatcatggatcatggcaggcatttggccttgggcaccgccgacgagttgaaggcgatgatcgacaccggcgaacgcatcagtgtggaaaccgacgatctgggtggcttgcatcatgaggcgggaacgcagcaggcattggaacagttacgtgcgctgccatgtgtgatgagcgccgattatgacggtcatgagttgacggtacgttgccgtcggggcgatcacaatcttcttgacgtgttgacgttgctgaaatccaatggcacgaatatcgggcatctttcctcccggcagccgacgctgaacgatgtgttccttgaactgaccggcacggcgttgcgtgactgacggaatcatggttcgaaaggtttgacattatgttgcagacattgctggtcaatctgaaattgcatttcagggagaaagcgcagctgttctggctgtttgcctttcccatcattctggcgaccatgttcaatggcatgttcggcaatatcgcggaaagttacgcattgcacacggttgacgtcgtcgtggttaataacgacgattggcgcgcctctccgggcgcgcagatgctggtcgacggcatttcgtccgatactggcgcgaccggtgccgatggcgatcatgcgaaggtcgatgatgacggtgacgccatgccgaaactcatcaccgtcacggaagccgcatctatggaagccgcggatcgagcactgcttgacgccaaggcgcagggcagactgtccgtcgacggtagtgggaaactgcagctggccatttcccaagccacgcaaacatccgccacggatgtgatggcgtcgagcagtggtctggatatttccctgacggtgttgggcaatatcgtggacttgtacaatcgcaacaccgccgtggtggtcaatgccgcgcagcacaatccgtccgcgttgttggatgacgcgttcaccggcagcatcggctcgtcgagtgggttcacgaaggaagtgcagctgacgaatttcaagccaagcggcaccgcacgctactattacgcgttgctcggcatggccgcgatgatggccatgagtttcgcggtgaacgcggtatcgttggcccaggcaaacctgtcggcacttggcattcgccgttccgtcgctcccctgccgaaactgcaacagctgctggcaggttttctttccagttggatctgctcgttcctaagtctgaccgtggccatgctgtacattcgtttcggctgccagatttctctcggcggtcgtgaatgggccggcttgggcgcgtgcttgatggcgtcattcgccacaagcgcgttcggcacgttgatcggcgcaatacagggtgtttccacgagtgccaagcagggattgtgcacggccttggcatgcacgctgtcgctgttttccggtttgtatggctcgttcgccatggatttaagcgatcagatagcgcagcatgcgcccctgttgagcatgttgaatccggcgcaacagattacgaatctgttctacgacattctgtattacgacagtttccgcccgttctttgccacggtgggcgtattggctgcgatgagcttggtctgtcttggtatggcgaccgttctgttgaggaggcaacgctatgaacacttgtaaagcagcactgcgtattctcaaagcgcgcaaattgtatgtgattatctacttggtgctgatcggcacgatgatgttttccatcagctggcagatcatgcgtggctccacagctgccggagcgacgacgtatgagccggaatccgcccgtattgcggtaatcgaccgtgatgacgacgccgagcatgtggctcaatcgttgcgttcctacctcgctttggacggtgagatggtcaccattgatgacgattccatatcgttgcagcaggctgtcgcatcgaattatgttgatttgattgcgattgtgccacaaggtttcgccgagcgttatctgcagtatgcggataacgccacggctacgcaaccgaccatagataccgtcgtcagttatgcttccggagccggatcgctcgcacagctgaaagtcaacgagtttctttcgctgacgcgtaccgcctatctcggcatgccgcaggcacagcgcacgctcgacgccgccatgacaacgacgttggatgctgccaccgccgatatgaaacagtcgcatatcgccgtggtgtcctcggactctgaagacgacggcaccacaccgggctcatcggcattcgcgggcacgctcaaaaccggcttgtatccactgttgctggtcatgccggtatgcacgttcctcgtggtcagcacattcaatgacaacgaaatccgccgcaggctctactcgtcccccgcgcgtctggtgtcgttggaagcgcagcaaatgctgacatgcgggacgttcggtctgctggtatgtgctgcgtataccgcggtgacattcctgttgatggcgctggccggagtgtcctttaccggcctgaatgccgtgaacgtaggcttgtcgttcgtgtcgctgatggtctacacgcttatggcgatcgcttgcggatttctgttggggtcatccggtttcaatgaaatggcaacgaacggtttcgtcaatgtgttcgctctgctggtcatgttcacttccggtatggcgttccccgtggatatgatgccagatcccatgatcatcatcggaaaactgctgcctggatggtggctctgctcatcgatagaccacgtattcggactgggtacggcctcctcgagcggcgtggactacggcgcgtgggcgtcatcaaccggattggtggcaatgttcgcggtagcgttcatctgtctgggcttggccttgggacgcattcggcgagcccgcccgacgttggcctcccccgccacaacgcagttggccaagtagtcgacgccaacactgtggcagccgcatgacgatcgcatacgacgtccacggtctacttgagcatattcctccggtaggctgtgggcgtcgtatgcatgtactgcttgaacgtgcgcgtgaagaatgtcgatgatgagaaaccaagttttttggcgatgtcggaaaccggcatcgatgtggtgtccagcatttccgctccagctctcatacgcacgtcattgacgaattcaatcggcgtctgatcgaccatctcatggaagatctgcgcgcatttcgtacggccgacggaccctgctgaagcaatctcctccagggtgatctgtcgaacgtaattgtgctgcacgtaatcaatcatcttgctcaaaatagcaatcttcggattcttcctgtcgtatttggaagaaccattcttgccatgttcgcccgctatggccgtcagttcacgcaccatcgtataaaaacagctgagcacggtcaacgatgccgtatcatcctttaatttcatattgtcaacggtggcgggatgcatggtctgggcagccggcatctgaccgaatttcgcatcatgcagccgcatcatgcattccagcaacgcggatccatgctcatcttcaggatcacacaccatgtacgggagccgttcgtccgccatcaacggagccacaaagcgttcataaaccatgttcggcatgcacatgcatgaagggttcagcagagtgcaggaaaattcgcaatcggtgccgtcctcggtgaaaccgtaatgcaattggcgcgaattcacgaaaatgccttggccttcttcaagacgaatgctttcgccgttcacgaaataccacatgtgtccacggatgatgtgggtgaattcgaaatcgatatgccaatggcattccgcgcgcatgttcggatactgatgcagcagcgaatgttcggtgaatgagaagaacatcggcgcatcatattgcaccatttccgcgccgttgggcttgcgtccccagttggtgaccggcatgaactcatatggaagacgaccgtcttgcgcaagttcaggctgttccgtttgttcgttttgtccgacctgcacgtcacgaacgtctaatcccatctgtcccatgcaataccccatcagtggatacggtaaataatacgaaaatcaagaacgataatacaacgaaatacagtgtcaacgaataatgatgccgttgaatggaacatgatatgtcacgtcaatcgattgacgtaatacagcagaggaggcagcatggtggaccccaccaatcatccggcacgcgacgaatgggagcgtatgctctccggcgaactgtatgtggccgatagtccgcaacagcaggaagcgaatatgcgcaagcgtcgcctggtgcaggccatcaacacgtccgaatatgacgcgttcaaagaacgtgacgaactgtttcacgaactgttcggcgcatttggagagggtggattcgtggaacccccattcaactgcgattatggatgcaacacgttcatcggcaagaatttctatgccaacatggattgcattttccttgacgtggcacgcatcaccatcggcgaccgcgtgttcttcggcccccgagtgggcctgtacacgccgtatcatccgatcgatgcgacggtgcgttcctccggccctgaaggcgctcgtccgatcaccattggcaacgatgtctggttcggcggcaatgtggtggtcggccctggcgtcaccatcggcgatgatgtggtgatcggtgccggatcagtggtggtcaaggacattccttcgcattcggtggcagtcggcaatccatgccatgtgatccgtgagatcaccgacgccgactgcgaatattgggaaggcaaggcagcggaatatcacgcttggaaggattcgattcagtaaaacgcaccgcaccatcctcacatcatcatgcaatcttccatcacttggcgcgagtttcttcgacagacgttgacgctcgccctgcccatcgcgtttcaacaactgatgctggcgctgtcatcgtgcgccgacactcttatgctgacgaacgtcggtcaaaacgagctgtcggcagtgtctcttgccacgcagttccagttcattttcagtttgtgtcttgccgcgctcacgcttggcatgagcattctggtggcccagtattggggtgcgggcaatacgaatgccgtcgaacgtgtcttggcgttcatcatgctgtatgccggcggattgtcgctggtgtttttcgcattgacgctactcattccggaaacgttgatgtcgattatgacgaacgatgcgacgctgattaccatcggctcacagtatttgcgggtttcgtcggtttcgtacctgttcatcggtttgtcgcaaatgtatttgtgtctgatgaagaatgtgggtgcggcggttaccggaatgacggtaagcacggttggcgtgatcgtgcatgttgcgctgaacgcggtgctgatctatggttggttcggtttacccgcattgggtattttcggcgcggcgatttccacggtgatttcccgagccatcgaactggtgtggtctgtgcttgtagccagccgcaatggccgcccacgtttgcggttgtcgatgatgttgcatccggatgtggcgttgcagaaggatttttggaagtatagtctgcccgtgcttggcaatgagctggtttggggctgcggtttcaccatgtacaccgtgattatgggtcatcttggtacggatgcggtggcggccaattccattgcgaatatcgtcaaggatctgttggtctgtttgagtcttggccttggcaatgcgggcggcattcttgtcggtaatcttcttggccgcaatgctttcgatcaggcgaaggttatgggcgacaggctctgtgtactggtggcggcagttggcgttggaaccggcctgttgattatcgcggcacgtcctttggcgttgcagtgggcgggattgacgccgcaggccacgcgttatctgtcggttatgctgtttatctgcgcctattatgcggcatgcgggtgcatggccaatctgactatcgccggtattttccctgccggaggcgattcccggttcggacttgtctgcgatgcgagcgttatgtggcttgtcgtcgtaccggtcggtctgttggcggctttcgtgtggaagttgccggtattggcggtctatgctttgctgaataccgacgaatgcatcaagatgattcctgctttgctgcattatcgaaagtatcgttgggtcaacaatgtgacgagacagaccgattccgccgtagtatcaaacgcatgaaaaaccggtagcaacaaagcccgtgtcatactgcattgcacagtgcgacacgggctttgttatttgccgatctcaatcatgtgattatttatttcatgagattgcgcagcacatactgaaggatgcctccgttgcggtagtagtcggcctcgcctggggtgtcgatgcgtacgaccgcgtcgaattcggttgtggaaccgtcttcgtgggtggcagtgacatgcaccgtcttcggaataatgccattgttgaattcttcaacgccggcgatatcgtacgtttcggtgccatcaaggccgaggctctcataggactcgcctgcggggaactgcagcggcagcacacccatgccgatcaggttcgaacgatggatacgttcgaagctttcggtgatgacggctttgacgccgagcatgacggttcccttggcagcccagtcgcgggaggaaccggtgccgtattctttgcctgcgagcaccaccagcggaacatcatgttcgatgtagtcgcgggatgcttcgaagatcgtggtcggcttctggtcaaggaaatcgtaggtgaaaccgcccggagtgacctcttcccccacggacgcgagcaactggttgcgcagtcggatattgccgaacgtgccacgtaccatgacctcatgattgcctcgacgggaaccataggagttgaagttcttcggttcgacgccacggtcggtcaggtacttgccagcaggactggatgccttgaacgcgccggctggagaaatatggtcggtggtcacggaatcaccgagcagtgcgagcacgcgggcgccatgaatgtcttcgacgggatccggtgtggccttcatgccatcgaagaacgtctgcttacgcacgtaggtggaatcctcattccatgcgaacagttcgccttctggaacgtcaagtcctttccaacgacggtcgccttcgaatacggaagcgtaatccttcaggaacatctcacggctgacggtaccgtccaccacggcggcaacctcgctattggtgggccagatatccttcagatacacatcattgccgtccggatcctcgccaagcggctgagtttcaaaatcgaaatccatggtgccagcgagcgcataggcgatgacgagcggcggagatgccaggtagttcatcttgacgtccgggctgatgcggccttcgaagttgcggttgcccgacagcactgaggtgacggtcagatcgttggcgttgatggcttcggagatttccggcagcaacgggccggagttgccgatgcaggtggcgcagccgaaaccgaccagctggtaaccgagcgcgtcgagatcgtcctgcaagccagccgccttaagatagtcggccacaacctgggaacccggtgcgagcgaggtcttgacccacggcttgggcttcaaacccttggcatgcgcgttgcgtgcaatcaaaccggctgcgatcatcacggacggattggacgtattcgtgcacgaggtgatggatgcgatcgccacatcaccgttcgtgatgtcgaagtcaccgcggaagtcggtggaaacagcaaccggctcctgcacggtcttgtccgtttcgtacgcgagcaaggtttcgacgaatttcgctttggattcagacagtttgatgcgatcctgcgggcgcttcgggccagcgatcgacggcacgacagtaccgaggtcgagttccaggtattcggaatactgcggttcgacgtagttcggatcggtggtgtcgccccacagcttgttcgccttggcatacgcttcgaccaatgcgatctgttcttcggaacggccagtcaagcgcagatagtcgagagtgacgccgtcgatcgggaaaatgccacaggtggagccgaattccggacccatgttgccgatggtggcacgattggccagcggcaccgaggcgatgccatcaccgtagaattccacgaatttgccgaccacaccatgctgacgaagcatgtcagtgatggtcagcaccacgtcggtggcggtgacgccttcaggaatggaaccggtaagcttgaaaccgacaacacgcggcaccagcatggagatcggctgtccaagcatggccgcttcggcttcaatgccgccaacgccccaaccgagcacgcccaagccattgacggtggtggtgtgcgagtcggtgcccacgcaggaatcaagataggcaagagtcttgccaccgttttcttcgaccttggtcatgatgaccttggcgagatattcgatattgacctggtggatgatgcccgttcccggcggtaccacgcggaagttcttgaatgcctgctgaccccaacgcaggaactggtaacgttcgccgttgcgctggtattcgatatccatgttttgttcgaccgcgtcggcgatgccgtacttgtcgatctgtacggaatggtcgatgaccatgtcggactgcacctgcgggttgatgacctcaggatctcccccaagatccttgaccgcatcacgcatggtggcaagatccacaatgcagggcacgccggtgaaatcctgcatgaccacacgggacggggtgaactggatctcatgactcggctgtgcagccggatcccaatccaacagtgccttgacatgatcatccgtgatgttgacgccatcgatgttacgtaccagattctcgacgagaaccttcaacgaatacggcagatgatcgatgcccggcagatctgcgatgcggtaatattcataatccttgccgtccaccttcagggtgtcgagctggtcgtcgcgcacagacatgctacctccgagctttttggctgtataacacagctgattattcgtcgcctacgatacagccaagttaattcagctctggcgtgtcttcttaaagtatgggacaatactcggaattttcggcaccaaacgcaaacacaccaagaacacgagtgccgaaagcaccattgccaccgccgtcgcagccagcatctgcccggtcggcaccaccagcgcgaagaaattcgccaccggttttacgagcatgcccccgaatccaattgcggcaaaggccaataccaatatgccacgccacgaatgcaacggctttgccacccgcgcaagcacgaacactcccatcatgagcagaataatcgcgttgacgccacgcagcatcgccaactgcgcacccgaatcctgcacattccacttcatgaatatcggcagcagccacgacgtggacaaaatcgacaatccgaccgccacaccgcagggcacagcaaaatgcagcacgcgtttcaggaatcctggaatataacgacgcgtgttcggagccaacgcaagaatgaatgccggcatgccaatcgtcaatccgcccacatatgtgatgtggcgaggcagatacgggaatggtatctgcgtcagcaccacgcccaacgaaatcagtgcggaatacacggttttcacgaggaataggcttgctacacgttccatattggccataacctgacgccctcgcgccaccacatcgggcagatgtgagaacttcgaatcgacaagcaccacctgtgccacggccttggtggcgggcgcagcattgcccatcgcaatacccagatcggcctctttgatggcgagcgcgtcgttcacgccgtcgccggtcatcgccaccacatgctcacctgcatgcaatgcctccacgatcgcctttttctgatcgggcagcacacgcccaagcacatccacgttttccagtacttgcgccagctccgtaatgtcagcgggcagctcacgcgcgtccatgaatcgtggttcatgttcgccggtcagatgcacttttcttgcgatcgcgccgacggttacgggattgtcaccagagatgatgcggcaacgcacgccttgttcacggaaccatgcaagcgtttcttcggcgtcggcgcgaatatgttcggaacagcacaccaatgcgacagggcacgatgccggattgagttttggatcggtttcgtaatcgtcgggcgctgcaccgtagattcgcgcgaccagcagcacacggttgccgtcattggcgagatcattgacttgtttgagtatgtcggcatggtcgccgttgatttgggaaagaatgacttccggcgcacccatcgtccacactgcattgccgtcatagatcgaactccacttgcgcgccgacgagaacggtactcgtgcctcgacagtgccgtccgcaaatccctgttcccgtagtccagacagaatcgcttgccctgtaccgttgggctgtccttcgttcgataggtcgaatagagcctgtctgacgtcatgctcgttcacggtgcctcgcatgtcgtcggggccacgaacacccagcaattccaacgaatcgagtcggatggtgccgtcggtgacagtaccggttttgtcaaggttcaggcaatccacacgagcgagagtctccacggattccagctcctgcaccagcgtgttcttacgtgccaaacgaatggctgcgagcgcgaaattcagcgaggtgagcagcaccaggccttcagggatcataccgaccacaccggccactgcggaaatgaccgcggaacgccattcgccggtcgaaatggccacattccagccgccaacagtgcgtacctgcgaccagatgagcagtacgcagagcggcaccaccaggaaggtcatgaatttcagaatcgtgttgatgcccttgtttaggtcggatacggttttcctgtaaaccttcgcccgtgcggtaagtttggccgcgtaactgtgctctcctacggcggtgactttcaccaacgccatgccggagatggcggtggatccagagaaaatatcgcagccttcgcccttgcgtacggtccgtgattcgccggtaagcatggattcgtccagctccagtccccaagtgtgcacgatctgcgcgtccgcgggcacctgttcgccggaacggatccacatgaaatcaccgagcacgatatcgttgtgcggtatttcaacgtctttgccgtcgcggtgcacaagatagtcggaagccaccagaatcgacagtttgtcaagagtacgcttggctttcaattcggtgcagatgcctatgccggtattgatgatgatgatcatgccgaacaccgcgtctctccacgatccagtgatcaataccataaccatggccgcaaagatgatgccgttgaacaaggtgaacacgttggctcgcacgatatcgataagcgaacgtgaggtcgatgccttgaccacattgtccaatccgctttccctgagggcgatcacttcgccttgtgtcagccccgtctcttcgatgaggggcattgttcgactttcgctcatgattgccagcctaccgtcacactcccgttttccggtcaacttcttgtgaaacacaggtaaaaatcagggaattttcagggtatttcatcaaaagacgaactgctggtcattcataccgacatggtgcaaaaccatatcagtgggtaatcgtggttaccagcatttcccggtcgtgaggatcattattggccacggccacagcagcatcgtcgagcggtatcgcgtcggtcatacgatcgttgaccgtcatggtagccgcatacagtttgttgtctttcggcacggcgataggattgagaagcaccactggaacgcccgctgttcttgcggtttccaaagcatcattccagttttcggcattggcttcgttcgcgtcgattcctgcgatgataatgaggtcggccttgcgttgcgccatgtcacgcacgccttgctgcgcggtggattgcgcgtccacagtgcccgagacggtaatgtacaccggcttgagtttaccggcttccatggcatccattgccatggaatcggcggtgacatcatccgatccaatcatggcgatggacaggctgtcacgatcctccatggagtgcgccaccgcagtattgggagattgcgtatcccccaccgcggcattcgacggcacgcaaccagatagcgccgcgcaagacaacgcaatcgcagtcattccaaaaaacgcacgacttgcgaataacggcatgctcactgttcgtgctttctgaacagcgccacagtctccacatgatgggtcatgggataaatgtcgaacgcgcggatatccgccaattcgtagccaagtaacacgagcgtggcggtatctctggcaaggcttgccggatcgcatgcgatatagaccacacttttcgcttcggcttcggcaatctgcctgcacaccttcgcgcgagcgccagcacggggcggatcaagcaccaccacatctggcttggcgagatcattgcgcacgttggcaagtgttttcgccacgtcgcccacacgcgcatcgacattacccagatgaatgtgcctcaaattacgttgcgcgttccttaccgcagttttgccgccttcgacgctcaacatgcgagtgcgctccgccgtcagcgtggccaacggcagcgtgaacagacccgaaccggaatacaaatcccacagacatgcggatttggcaccgtcaagctcgccgcgtaccaaatcgatcacatggttggtcaaagcgatcggcgcatgcctatgcatctgccagaaaccgcctgcatccacgttgtattcgaattcacggccggcgacaatcaccttttccgtaagctcacggcttccagcaaccacctcgccgttcacaagcacggcgtaattgtctgaaatcggcgcattatcgcgaggttccggaacggatagacgaatctgggaacccggttcgaagctcccttcccacacatgctcacgttcggccacttccagcaacgtacggctggccaacggcatggtatcaatcggaacgcgcacatgcgtgcctcgacggtgcatcgacggacgcccatcagcatcagcaatcatctcgatgcgagtacgccaatgcaaacctcgctccgcatcgtcttccgacatacgctcaatgggcacttccacgtcgacgtggccgagtcttgccatctgttcggccaccgacgtgactttccatttcagttgccctgcaagcgacacatgcaccaagtcagcgccgccgacaccaccgcccatggcaaggggtccagctaacgaccatattggatcagtacggtcttcgctcgcttcgagtacttccaccacttcgcctgtccagaagcgatcctcacgatcatgcggctcgtccaatgcgacacggaccagttcgcccggcaatgcgaatcgcacgaacacaacacgtccgtcaatatgaccgacgcaacgaccctggtcggcgtaccgttcaatgcggatggtcgattccatcagtgctcttccctcatttcggtagtttgtgctgcctcagcatcgtcttcagaaacttcctgcatcatcttatgtcggtgcattggcgtcgccacgatcagatacgagacccaaatcgcgagcgcccagaacggaatgcccatcagcagacgcgccgttcccagccagccgacgtgattgccgagatagagcggcacctgcacgatcagacgcagcgcgaacactccaacccacattgcggtgatgatggtataggcgcgattgagcgccttgtcacctcgccaatcggcaagccaggcacgaaaatgttcagtcggtaacgttcggatgaactcgatgaccaatcctaagccaggcacccggaccagcagtgaaatcgtcagcaaaacaacgtaaaaggcgttggtgagaaatccgaacatgtaatagttacgtgcctcgtgactgttccatgcccagatcaggcagatacctactgccagcaagcctgataccgctcccatgacggactgtcgttggcacaggcgcacgatcacctgcagcacggccaacgcagcggacacgccgatggtcagttgcaaattggacgtgatgacgaacagtgccacgaacacgacgcccggcagcatcgattcgataacgcctctcggaccgccgatggcgtcgatcacggaaaaatcgtcagtattaccggcgtcggcaagcgcaccaagaccagttcgttttttcgcttcggtttcagccatacgtattagctatcggttcaagcggctcaacgcacttcggagaacatcggtccacgagacagcgtggtcttgacctcaacctgctggtcggagtcgaatggacccttcggtttgccgggaatctcagtcttctgctcagcctcttccgcagctgccttcgcagccttgcgttcggccggagcgaccggcggatgcatgggaataaggtcgcgtggcgccaacggatcatcgcctcgttccaccacaatatcagcgaagaactggttcaatgcctttgcttcctcaccctcaggatcggtggcagccttgcctgagaagatgccgcgcaacatccaacgcggaccgtcgacgcctacgatgcgggtaagcaccttgcgtccacctttgacggtaaccggcaatgccagttcggtgccgaatacgccttcgacttccttcgcgtccttgttggcttcaatcaggtcggcacgaacgtcatcccacaatccgagcgtcttcggtgccgcgaatgcctcaatctccacactggaggaaccgtaggtgatggtggtgccaagaacctgctgggtggcacggttggccttcactcgcaattcaatgcccttcaggaacggcagataatatgatcccatatcgaggtactcgtcgtagtcgggaacgttctcatcttccacatcccacggaccatgctcgtcaccgcggccctcgtattcagcggaaggctccggaagcgccacgacttcctgagcttcgtcaacgttttcagctgcgtcgacagcctcttcgttttctccggcggccgcttcaagagcttccttgctctgatgcttcttcttaccgaatccaaacaatcccatgatgttcctcatttcataacagttgcaaccgtgaatagcctagcacctatgcttaatatgggctgggaatcggggtgtgatattccaattcccagtctgttcacgataaaaagtggcttaaatgtcatacataatgctgagcggcgcatgatcggaccagcgcaggtcgtaggtcggagccttatcgatcacgaatccgcaggccgtttccgccagttccggtgttgcgaactgatagtcgatcctccagccgacattgttgtcgaatgcacgaccgcgctggctccaccatgtgtacggtccttggatgtctccggcgagattacgcatcacatccacaaactccagttctcccaaccatttgtcgacatatgcgcgctcctcggggaggaatccggcatgcgtttcgttggctttggcgtttttgatgtcgagcggcgtgtgcgcgatgttgaaatcaccgcagagcaccgcttgttttccgccgtgtgctgcctcgtcacgcaactgttccatgcgtatcagcatggtgtcgaggaaacggtatttctgcttcattttttccggatcatcggtatttcccgcatgcacatacacgcaaaccacggtaatgacatagccttgtggagtttgcatgtccgcttcgatccaacggccggaatcgacgtcatcctcaagtcccggcaatccatatcgtttgtcgacaaccggcaatgccgacaacagacctacgccggcacgccccttgatacggcaaatctcgttcatacgatgcagttcgctctgatcggaaatacgtcccgccgttgagtattcgaaaccgaattcgtcgaaaataggatcgatttcgttttgcggggcacgcacctcctgcatacaccacacgtcaggtgtgttgcgtccggcccactcctcgatgcctttgcgttttgccgctcggattccgttcacattggaagtcgtgatagtgatcgtcatagcgttctagcctagcttgcatacaagaaaagccctcggcacatgccgaaggcttatcttgatgatgttatcgcatcaaatcagtcaagaccgagctgcagcttgccgccggggatggcgccaagcagatcacgggtgtactgcttctgcggatggtcgaagacctcgtcagtggtggcgtgctccacaagcttgccgtgctgcatcaccacaacctcatcggcgatctgacgcacaaccgccaaatcgtgggtgatgaacaggtagctcaggcccttttccgtctgcaggtcattgagcaatcgcaacacctgatcctgcaccagcacgtccaaagcggatacggcctcgtcgcagacaatcacgtccggatcgagagccatggctcgtgcgatggcgatgcgctgacgctgaccaccggaaagctcgttcgggtagcggaaacgcacggaccacggcagttccaccatatcgagcaactcacgcacgcgggcagcacgactcttcttgtctccaatgccgtggatacgcagtggttcttcgatggaacggtaaatggagtacatcgggtcaagcgagccatacggattctggaataccggctgcacgtggcggcggaagtcaagcaattccttgccttggaagccggaaatgtccttgccttcataagtgacggtgcctgaggtcggttcaagcagcttcagcaccatgttggccaccgtggacttgccggaaccggactcgcccacaattgccagcgtggtacccttcttgacggaaaagctcacatcgtcaacggccttgaacatctccttcttgcgcggcagcttgaactcgcgtgtcagatgatccaccgtgatgatggattcgccggacttcagggaatcttcattcaccttgtgttccatcacgccgctggcatcgccaccatgctccttgacggagatgatgcgctgcgaggccaacgacggcgccgccgccaccagtcgcttggtgtatggatgctgcggatgctgcagcacttccagagacgggccggattcaacgacctgccccttgtacataaccacgatgtgctgcgcacgctcagccgccaaacccaagtcatgggtgatgaacagcactgcggttcccaacgaatcggtgagcatctggagatgatcaagaatcttcttctgcacggtcacgtcaagcgcggaggtcggctcgtcagcgatcagcagttccggacggcatgccaagccgatggcgatgagcgcacgctggcgcataccaccggagaactcgtgcggatactggcgtgcacgagtggcggcatccggcagaccagcctcagaaagaagacctgcgatgcggtcatccatggtggagccgattacatacttcttggcgatgtaccaagcgtcatcctcggccacgccgaccttgatcaggtcgtcggccacgcgccaacgcgtttcagatcctgggacccactccgactcgaagtacgccacggtcttgtcgaagtcgtcgccggtcttaccgatcttggacagcgcttccttcgccgcggacaacagctcaggaagctccttggagccaaggaaagtttcatcgtcgttgcctttaagttcgacatcggcatcggcgagagccttcgacagcgaggaacgcttctcatgggcgatatccatattgttggcggccagagcctccttcacctgggtaccgatacgccacaccgggttcaggttgctcatcggatcctgcgggacaagacccatcttgttgccgcgcaacttgtcgaaatccctctgcttgtaaccggagatttcctcgccgtcaagcttgatggatcctccgaccacatggcctgtgcccggaagcagaccaagcaccgccatagcggacgtggacttgccggagccggactcaccaacgatagccacccactgacccgggtatacgctgaaagaggagttgcgaaccgcatgtaccggctggccatcatcagtggtgaagtcgacctggaggttcttgacttccagcagcggaccgttggcacgttgcatggcctcgagcttgttttcggtattcatttcagtcatcgaatatccctcacttacactcacgtacggctcttcggatcaagcgcatccttcacggcgtcacccatcatgatgaaggcaagcacagtgatggcaagtgccgcggacgggtagaacagcaccatcggatcggtacgcagaatggactgcgcattggagatgtcgccaccccagctgacggtagtggtcggcagacccacaccaaggaagctcaaggttgcttccaacacgatgtatgtagccagagacgttgtgcccaccacaatgatcggtgccaaggaattcggcagaatgtggcggaacaggttacgccacggcgtggagccaagtgcggtggaagccgtattgaactccagattcttagcttccataacagcgcctcgcgcaattcgcgcaacggatgtccagccgaataacgtcatgaccagaataatcttccaaatggaatcgttggtcttgaacatctgcagcaccacgatggcaccaagcaaaatcggcaaagccaggaaaatatcggtcaaacggctgagaatggtgtcgacccagcctccgaagaaaccactcaacgcaccgatcagcgtacccaacagcaccaccagcaccgtagcgaacacgccgacgctcagcgaggtacgagtaccatgcaccacgcgggagtacacatcgcagccttgcagatcgaatccgaaaggatgtcccttcgaagccggttccaaggagttctcaagcgtgcagtagttcggattctgcttggtcatcactcctgggaacagcgccacgaagataatgaacacaataagcacagcggaaatgatgaacatcgggttcttgcgcagggtacgccatgcgtcagcccaaaggcttgaagccggtgcggactcatctaccgagtcaacgtccttaagcggcgtctcctcgagaggagcaacatatcgttcctgtcccggaagcgtgtgagaaagattcgtctcgttcatatcagtcattgttcaatcctcccaactcacgcgtagcggattcgcggatcaagcgccgcatagagcatatcgaccagcaggttgcacactgcgaagatcagcataagcagagtcacaatggacaccaccagattgccttcacccttgagaatgctttgataagtcaggtaaccaatgccatgcacgttgaagatggtttcggaaatcatggcaccgcccatcagtgcgccaagatcctgaccaaggtaagtgacgacaggaatcatggagttacgcaaaacgtgacgattcatgaccgacctgttgtccatgcctttggcacgtgcggtgcgcacatagtcaagcgcgatattggaagaaatctccgaacgactcaatcggatgatatatgccatagacacagatccaagcaccattgctggcatcagcaggtcgatgaatcctggattggcaccggccgtaactggaagcagacgcaacttcacgcctaagaaatactgggcaaggaagcccgtgacgaaggtcggtacggagatgagcaacagagagataatcaggatcacggtatcgcaccacttgcccttgttcaggccggaaatcgcgccgaagatcacgccgaacacggcttcgaacacgaaagccatcagcgcaagcttgatggtgaccgggaatgcacgtccgatctggtcgatgaccagctgaccggagaaagtcttgccgaagtcaagagtcagcgcatttttcaggaacagcaaatactgcacgatgaacggtttatccagattgtattcggcacgaatctgtgcggcgacggcctcattgaccggcttatcgccaaacatcgccttaaccgggtcgcccggcaacgcgaacaccagggcgtacaccaaaagcgtcgtgccgagaaccacagggatcatctgcagaatgcgtcgcagaagatatctgcccattggtttctccttttttgcttattcattgtcaacctttttcagattattactcataatcatcggggaaggttaacgatttaccccgcaagttttgtggcaacacacaacaaactgctttatattgcagtttcatgggaatcagctgggaaaaatgcttggctaccggcatctaccccctgacgcctcttggccacactgatgtcaccctgaaacggtgcgtattacatggaaaggaaggaacggatatgatccgccccttcctgcaattggctcagcgagattcactcacgaagatcggctcacttgccggacttggtcatgttctcgtagaccggcaggttctgccagttcatttcgaaaccggaaacgccggtagcagccacaccgtaggcgttggcgtagtacagcggaacggccgggagatcgttgagcagcacttcctgagcctgctggtacagcttattggcctcatcggtggtctgcgcggcagcagccttggagcacaggtcatcgaactccgaattcttgtaatcgccatcgttggaaccattgccatcagcagcggcggaagcgtaattggccaccaggtagttttcggcggacggataatccggctgccagccgctacggaatgcaccctgaaccttgcgatcggacacggcggtacggtaatcgttgaaagtcgggtacgggttggtggcagccacttcggaaccaagcgtgttgttgatggagttcaccacagcggtgtaggtggtctcgtggccaccgtcagcgttgtaagcgaaggtgagcttgtcatcggaagtccacgggctgatagcattggccttctcccagagttccttggccttcttctcgttgtacttcaggttgccgacgcccttgagggaatcagagtagcccggggtcagcggagaggtaaagtcaacggccggagtgccggtgccgttgagcaccttgtcgcagatgttctcacggttgatggccatggagatggcttgacgacgcagggtgccttcttcggtaccagcttcgaagtgcttcaggctggacggaatggtgaactgctggatgacggaaccggccttgttgtaggcctgcacggtctcatcggtttcgaaggtcttggtggcggaggccggcacggattccatcacatcgagggcgccggactggatgtcggcgtaggctgcgtcatccttggtgtagaccttgaaggtcacaccgtcgttcttcggggttcggttgcccttgtagtcagggttcttcacgagcacgatctcgttgtcgtgatcccaggactggaacttgtacggaccgttgccgactggagcctcaccgaaggcatccgtgtcatcgtagaaggattccggcagcggagcgaatgcggaatagcccaccttgatggcgaacacggaatcagacttgttcaggtcgacggtgaactcgtgatcgttgacgatcttcagaccttcaagctgctcgtcacccttgaggttgtcggtgtcctgcagcgcgtcatagcccttgatggtggagaagaaggatgagccgaccataccgttcttggcgttggccacgtagctccaagccttggtgaaggactcggcggtcacatcggtgccatcggtgaacttccagccatccttgagcttgatgtcgtactgggtggcgtcatcgttggcggtaatggactcagccacttcgttggaagcattgcctttggcgtcgaaggaaatcagacgggagaacagcagatcaaccggcttgccaccaccggtctcgttggtgttgcccgggatgagcgggtgctgcggttcggaattgtatgcggtgatgatgttggcaccttcagcggcggtgtcgctgccgttggaagagccacagccgctcagcagcatgccaaaagcgcacgcggcggcagcgaaagccagtgctttcttcttcatataatcattctcctattcgatatcacatcgggattatcatcccacaaacggaaacgagccgacctactcaccgacgcatctctgtttggcgatagtgcactattcttgctcaattgacggacaacctttccatgcaacccaaaaaacgcacaccttccttgacgacatgacggcggaaaacatacgttttccgccgtcatgtcgaacaatgtatccgaagaataagtcagctcttcaaaatctcgttatacaccggaacgttctgccagttcatgacgaagttcttcactccggatgcggcaacgccattggcattggagtaatacagcgggatggcaggcagatcgttcaacagaatctcctgagcctgctggtacagcttattggcctcgtcggtggtctgtgcggcagcagccttggagcacaggtcatcgaactccgaattcttgtaatcgccatcgttggaaccattgccatcagcagcgtcagaggaatacagctggtacaggtagttttcaggagacggataatccggctgccaaccggtacggaacgcgccggtcatcttgcggccggtaacgtcgtttcggaattcctggaaggtcggcaccgggttagtggtcacgtcgatatcgagcgtgttcttcacggagttcaccacggcttcaaagatcggcttggctccgccgtctgcattataggagaacgtaagcttgtcgtcggaagtccacgggctgatggcgttggccttctcccagagttccttggccttctttttgttgtacttcagattctcgttgcccttgagcgaatcggagtagcccggagtcttcggagacgtgaattcgaccgctggagttcccaaaccattcagtaccttgtcgcagatggcctgacggtcgatggccatggacaacgcctgtcggcgcaactgtccttcttcggtggatgtcttccaatgttcaaggtccgacggaatggtgaacgtctgaatcacggaaccgaccttgttgtatggcaccacggaggaatcgaattcgaaggtcttgctgtcggcggacggcaccgtatccatcacatcaaggttgccggcctgaacatcggcataggccgcgttggcatccgtgtagatcttgaacgtcacaccgtcgttattcaccttgcgattgcctttgtaatcgggattcttgaccagcttgatttccttgtcatggtcccaggaatcgaacttgtacggaccatcggaaaccggcgactctccgaaggccttcggatccttgtagaaggattccggcatcggatagaatcccgaataacccagcttggtggcgaacgcggaatccgactggctcaggtcgacggtgaactcgtgatcgttgacgatcttcagaccttcaagctgctcgtcacccttgaggttgtcggtgtcctgcagcgcgtcatagcccttgatggtggagaagaaggaagagcacagctgcgcgttcttcgcattagccgtatagctccaagccttggtgaaggactcggcggtcacatcggtgccatcggtgaacttccaaccatccttgagcttgatgtcgtactgggtggcgtcatcattggcggtaatggactcagccacttcattctgggccttgccatccttatcgaaagacaccaacccagcgaacagcagatcgataggacggccaccgccggtttcattggtgttgcccggaatcaagccattctgcggttcggagtcaaatgccgtaatgacattcgatccttcagtcgcgttcccagacgtggaagacccacagccgcccagcatcatgccaagcacacaggccgccgccgcaacggcaaacaccttgctttccttatattcattatgttttccctcattattcggattaccggtcggtattgtttccccgtaccagcttcatctaggtaatacaccctaaatcaagaagaaacaccaatttctgttacaggaatgtaacgaaatatccatggaccgcgactacgcacgaggaaatgcctgaccgtatcgggctttcaattgttcgatggagacatgcgtgtaccgttgcgtggtcttcagcgaggaatgtcccaagagctcctgcacctcacgcaaatccgctcccccgtcaagcatatgcgtggcggcactgtgccgcagagcatgagggctaatgtcgggaacgccggcatcacgcgcgcattcgtgcaccacacgacgtaccatccgctgatcaatgcgtttgccttgtctcccaagaaacagcgcagccgcggactgctcccccaccaacaggggacgcccatcatccagccaccgacgtatcgctttttgcgccggagcgccaaatggcatgactcgttgtttgttgcctttgccggtcactttgaccgttcgattggaaaagaccacatccggcacatcaagtcccaccagttcagccacacgcatgcccgttgcatacaacagttccagcattgcggcgtcacgcagctcaatggcctgctgcttcatggtccgttccttcggctgagacgtttcaccgtcctcatccacgcgttccatcagctgttcagcctgtgattcgctgagcacatccggcaacgtatcaggtattttcggggtcatgagcgcacaagccggatccgtcgtcgtcacgccatgctcatgcgtccacgcgaaaaaaccacgtacagccacagtttttcgggccatgctgcttttcgcatggtttttcgatgattccgccatccacatgcgaagatcttcgatggtcacctcgttaagatccctgcatctaagccgctccaaggcaagcagacattcttcgacatcgcctcggtatgccttccgtgtgttttcactcaatccacggttggctttcagatatgtatcgaatgcctctacgctcttatcgaacagcatgccgatcagcctttcccgagctcaacagcaagcccgaatccatgaatttctttccattatgtgtccattctccgatagaaaccgaaataccggcacaacttgaaaggagaccaactatgctgtccagtagcgttcgctcagcgaatccgtcgatgatcgtctattcgaaggggagattatgccgattccaaacgaaattccagcaggtgcacgcattgtggtgcgcacctgcgaaggtgtcgatccaaaggaccagcgcatgaaattccgcgattatgtcggtcacgtacgttcttgggacgggcagacattggaaatgacgcgcgatgcggcagccaacggttcacgcccagagcaacgtgtcagcattcccgccgacaccatcgtcactgtcaaaccggttccggaacgttccatgacacggccgcgcccatagcgcgtcacactgcggaacgcacctgtgccatagcttgacggtaaccgtcgaatcgcacgatatgctctcccctacgcgccgactccagaagcatctgctgccatccggtttcgggaattgccagttcgaccgtttcgcaacgttcttcgaagtcaggttctttggcgagaaccttgtattcacggaatggctgcccttgtatgaagaaacgcgccatctccttgtcgtcaccggcagtgggcgagccctgttgcgtggtcatgccgtgcagcacgttggccataagcgtcaaccgattggccatattacgcagcaacgcttcgacattggcggcgtcctcttccaccattgcacgggtacggtttggatcggttagcgcaacacgagtcatgtcccgccatgaaccagcggcgagcgcggctgcgatgttccggttgggattggccaccagctcgttgatcatagctgtggaaatgacgtgtggcatgtgggaaatcagtgccgcgcaacgatcgtgggtcgcatcgtcaagaacgatgagtcggttggaacaatgatccacaatcattgtcgcaacggcgcggaaccgctgatactcggtgttttcatctacggtgatggcccagagcgcgccatcgtaaagcgtcggatccgacgattcccatccggacagctcattgcctgccatgggatgcgcgcccacatagcaatgttccaatccaacggctttaacctgttcccgaaccattgctttgacactgccgacatcggtgagcgtggtgatgtccgtatcgatcagtggcttcaacgcacccaggatttgcggcatggccttgagcggattgcataacacaagcacgtcaggttttgtgtcggcgagcgcggccagtgtggacacacatcgtatgccgtccgctttcgcagtttcatatggacgatcgttatggttccatgcgatgacttcacagccagcattaacgagtctgcgagccagtgaccctccgataagaccaaggcctacgattgcgatacgctgcttcaccacatcagctcctttccgaccgtttcgctgttctgccaatcatctggcagatgctgttcgtcaagccgtacgcctccctgcggcagcatccatgaggtgactggaggattggggcgttctcttcgtgggtatacggccagagttttggcccagtcaccgtgttcggcgatttcgaccagcgcgccatggaagcgttgctcccatggcgccgcatcgagcgtcgcgataaaactgtatgtgcctgtgcgtcctttgattggccgcgagatgaaacttgtcatattgaggcctgcatcgcggaatacgtccagcaggttcgcgagtacgccaggacctgtgacaagcggaataagcgtcagcacggattcgtattccatatcagcttgcgaacgaggctgttccaacagttttccggcttccttgcgtggtgcgagcacaagaaaatcagtctgtgcgccttgataatcctgcacggcggtaccgatgcgcgtcacattgtagagttcaccgcaaatacttggcccgaaagctatttcgtttgctttgatatcgcgacatgcggcagcattggatggcgctggagtcggttccaaatggtgttccgcgatgaaacgtttgcattgcgcgagaccatgcgcgtgtgcggtagccacggtggcgtcttccggattggatcccgcacgcacatatgcgtcgaaagttacgtcgacgcccactcgcgcaaatccgactagatctttggcgtcgatgagcgcgtccagattcggcaccacgtaaccttcgacgttgttttcccatgccacgacgccccatccttcgccccgctgcgcggcatcaaggatttgcggtacgtcatccgcagccaccaattcgaatccttccggctcaagatgggccagtgcctgcgatgcattgactgcggcctgatgggtgaaggtgccttgcggacctagatagaacagctttcgtgcgctcattcaaccccattccttattcttggtgttcccctgaaccttacctcattgccgtggaatcgactgccgattattccaccggttgggcgttatcagatgttttaccctcgttcgtctgcgtatcagcagcaaacgcaccatcacgcgtctccttacgcggaggtgtgacgaaccaacgtttcggcagcaccagcatcacaaccggaataagcacgacaccgtacagccacatgtatcctgcctgttcactgaagaacggcatgggatcatctccaccgaatcccacaggaatcatggcgtctcctcccggaccataccccgacatcaccgtccagaccaccagagaggagccgatcaggtgcaatgcgaggcctgagacaccgtcgcgtgatcgagctgaccatgtcgaaatgatcaccatgagataggcgatcgccaatccgtagggaatattcatggatgcgcccatgcgatgggccatggttcccactactccgactatgattccggaaaccagatcgacgaggaaccgtccccaaatcggcagacggtatgaccatggcatcagttgcgcatcgggcgccgcgtcttgattcgacccatacgtatcatgcgattgcttcatctgttgcatcatatcccctactatcgctcaccaacctgaaaagaaaaagagatacgcgaggacacgtatctcttttcatggaagcaataacagaatcacttgttcttctgagcgttattctgctgagccgtcaaacggagagcccagcgggctcaccgtaggcgaagtgagcaagcactaccgtgcttgcgaagccgacagaacaacgtgaagaatcacttgttattctgagcgttgttctgtcgacgctgcttggcgcgccacttgtaccaatcctcacggctgagaataatcttgcgcacacggatggattccggagtgacttccacgcactcgtcctcgttggcgaagtccaaggactcttcgaggctcatcttgatcggcggagtcagggtttcgagcacatctgcggtggaggaacgcatgttggtcatatgcttggccagcgtgatgttcacatccagctcgtcaggcttgttgttcacgccgacgacctggccttcgtacaccggagactgcggttcgacgaagaagttgccacgtgcctgcagacgctgcatggcgtacggagtggcgatacccttgcgatcgcagaccatggaaccgttctggcgggtcacgatctggccagcccacggagcgtagccggcggagatggaggatgcgataccggtgccacgggtggcggaaagcagtgcggtgcggaagccgatcagaccacgggacggcacggtgaactgcagacgaacccagccagtgccatggttggtcatgttctccatacggcccttacggtcggcgagcagctgggtgaccgtgcccatgtactcttccggaacgtcgatggtggtgttttccatcggttcgttgatcacgccgtcgatggtcttggtgaccacctgcgggcggccgacggtcagctcatagccttcacgacgcatctgttcggcaagcacggccaaggcgagctcgccacgaccctggacttcccatgcatccgggcgttcggtcggcagcaccttgatggacacgttgccgatgagttcgcggtcaaggcgatccttgatcatgcgggcggtaagcttgtggtccttgccttcggttccggcaagcggggaatcgttgatgccgaaagtcatggagatggccggatcatcaacgtggatcagcggcagcggacgcggatcggacggatcaacgatggtttcgccgatcatgatgtcattcacgccggcgactgcgacgatgtcgccagggcccgcggaatcgaccggggtgcgctcaagaccctgcgtacgcagcagttcggagacgcggaagttttcgacggagccgtccacacgggacagaccgtaggtcttgcccttttcgagagtgccgttgtagatacgcaccaagccgagtcgacccaggaaatcagaggaatcgatgttggcgacgtgtgcctgcaaaggcgcgccttcctcgtattccggagccggaatgttcttgatgatggcttcgaacagcggttcgagatcttcgttatccggcagaccgccattctccggctggttttcggaagcgtagccggccttggccgcgcagtagatgaccggcaggtcgaacagcgcatcctcatcgagatcgataccctcttcgataacgtcctgagccaggccgagcagcagatcggaggattctccaacgacctcttcgatacgtgcgtccggacgatcggtcttgttcacgcacaggataaccggcagcttggcttccaaagccttgcgcagcacgaagcgggtctgcggcagcgggccttcggatgcgtcgacgagcagcacgacgccatcaaccatggagatgccacgctcgacctcgccgccgaaatcggcgtgaccaggagtatcgatgatgttgagggtgatgccttccggatggccgtacttggcggccagcggaccggtgtactgcacagcggtgttcttggcgaggatggtgatgcccttctcacgttccagatcattggaatccatcacacgatccggaacttcctcacgttcgttgaacacgtgggactgtgccagcatggcattgaccaacgtggtcttgccgtgatcgacgtgtgccacaatcgctacatttcgaatatcgccgcgaaccgccatcgaaacctctcttagtattgctgttctcttgcgttaccgttcggtacatactggttatcggtacttacaaatccgtactccacacaaaccgagccaatcctagcgaaccattacgacagttccggtcccagcgctttcgcccacatacaaagtttgcggttgtcgaatctcaacaaccgcaaacgtatgatctcttgggaccactcaaaataattcgttaatcctcaagttccttaccagtgcgttccggcaagcacaacgccgcaacgcaggccagaatgaaggcgaccgcgaaaacgatgaatgccaccgccttgttgccaccggacagcgtcaggaaccacggcatgagcagcggagctatgatggcagccactcggccacatgccgcagcagcaccggacgcagcagcgcgcaggcgggtcggatagatttccggagtcaccgcatacagcacgccccacgcgccaagattggatgcggacaacaacatgccaaagcccaacaccgcagctacggaacccgcttgcgagaaagcaaacgcggccacggccgacacggcaaggaacacgctcagcgtcttcctgcggccccagatctccaccagccatgcggccaggaagtatcccggcaactgcgcgacggcgatggccagcgtatagccgaacgacttggtcagcgagccaaactggtcggccagcagcgacggcatccatgtgaacgctccatagtaggagaagttcacgaagaaccacgtggcccaaatggctgcggtgcgcgcgatgcactttttgccgaacagttcgcgggtgttgatcttcggcagtggtttgcccttcggggaagccactggctcgatgccacctgcctgttcgaaatagcgtacggcctgttcggcttcgtcctcacgccccttggattccaggaatcgcacggattccggaatatgaacacgcgtcacaatggcatacagcagcggcaacgcgccaatgagcaaagcccagcgccaaccccaatcgccggtattcggaatcacaaagtagccaatgaaggcggcgacaatccagccgacagcccagaaggattccaacagcaccgtcatacgaccgcgttgtttggtcggagagaattcagaaaccagagtggaagccactggcagttcggcgcccaaaccaagaccgatgatcagacgagcgatcaaaagcgcggtcaacgaccatgacagtgccatgccgccattcgccaaaccgaaaatcaccagcgtcgcggaaaagaccgttttgcggccaacacgatcggctacaaaaccacccagcgcagcaccgatcgccatgccgacgaagccgatggacagcacccagcttttctcggttggtgtcagattgaaatgcgggtcagccgcgatggccgccacaacgaaggacaccaagccgacgtccatggcgtcgaaagcccagccgataccggacgccaccagaagtttcctatgcgctttgttaaacggcaggcgatcaagacgctcattacgtgtcaacgaacccgacgaagcaaccgatgcggattgcacggatgtcatacttcttcctctcatacgaaacgaccatgcctacaaggcatgccgaaaaccagacagaatcgtctgaaaaggaaacaatccggaaagacgtcagatcgtcgtcaacgcggaaagcacatcatcctgcgtttcccgcacatcgaaatcatggcgatcccgagcatcgctccatgtcgactgtcggagcacatccatggtgtagcgatacaccgttgccggacgattgcgtccgacacgcaatttgtcaccggtgtcctccagctgcccggatgcgagcatcttacggcggaaattcgccagatcgatgctctgaccggcaacggcctcgtacacgtcatgcagctggctcagcgtaaacctctcgcctaccaatctggtgacgatctgcggatattcgattttgccgcgaagtctgctgagggcgtagtccacgatgtcgccatggtcaaatgccaactcaggcagatcatccacaggaaaccatttgacattgtcgtcgatactctgcccgagttgcccgttaagatcgtcgaccaacgcccaatagacgatggataccatcggcagcccgccgtgtgagcgcgctggatcgccgaatgtatacagctgttcaagataccgtggatgcaacgatgtcgtggattccagcgcaacgtaggcagattgctccagcgagtggtcagccctcaaaccaccaccgggcaacgcccactggccaagaaaaggctggcgcacgcgccggaccagcggtatccacaaggtggatcccgcactggttcgagcatgttcctgcgttccgtgggaagctggccccaaagcgagaatgaccacggaaacgcccacctgcggcggctgtttgcgccgttctgagacattgcccatgatcatcgcgacctcacctctccgatcttttgtcgatttgaattgttccggaatcacagtgtagcacttatagtcaacatgactataagtgcagtgtttcaccacaccgcttgaatttcaacccacgtatgcccttcaacgaaaaaggccccacgaaggagccctatgcgtcttatgcgacgatgccctgagcaatcagctctcgggcaacctcacgatattccttcgcggtcttatggttcggcgcataaatggtgataggcgcggccgcaaccgtggaatccggaagtttgatggaacgtgagatgactgaatggaagaccttgccttggaatgcctcataaatacgctgcaacacttcatcacaatgcaaggtatgcgtgaacatggtgacgagcactccgtacacttccagactcggattgatgcgggattgtactttttcgatggactgcatcaacaaggccacgcctcgcagtgcgaagaactcagcagccacgggaatgatcacgccatcggcagcggtcagcgcattcaccgtaagcaaacccagagaaggctggcaatcgacgatgatcacatcgtattcatccttgacctgacgcaacacgccagccagcacctgctcgcgcccaacttcggtgaccaactgcacttcagcggcggacagatcaatgttggccggcatgatatcgagattctcgaaatcggtatgtcgaatcacatcatgcacatccatgcgaggattgaacagtgcggtgtacaccgtatcttccacggtattggcgttgatgcccaaccccaccgtggccgcaccctgcgggtcgaaatcgacgataagcacgcgacgcccatactggctcaatgcaccagcgatattgatggaactggtggtcttgccgacgccacctttctggttgcacatggcgatgatcctcgccggaccgtgcgtctgcagcggctccggagcgggaaacgtctcataatcacgtccaagcaaatccgtaggcataccgtttaccttaccaacatccttgtgtcaattttcactgtaatccatgctagtccattgtcaccgttcaaaacggcagcaacaccatcatctggcgcgcggatgagacatcagatatgtctcaatcaggttttcaggactgatatgcgtgtaaatctgtgtggtggtaacgcttgcatgaccaagcagctcctgcacggtacgcacatcggcaccgccctgaataaggtgcgtggcgaaagagtgccgcaaggtgtgaggatgcagcggcttatcgatgtgcgcacgctcccccgctcccctgatgatttcccaaaccgactgtcgcgacaatctttttcctcgtttattcagaaatagggcacgccgttccacgggacctttcgatttggattccagcttaggacgccccgcatgcaaataccggatgatcgcttcgcacgcatagctgccgacgggaaccagccgctgcttagagcctttgcccataagtcttgcgattctgccgtctacatcgacatcatcgagattcgcaccgcacgcctccgacacgcgggcaccgatcgcatacatgaattcaagcaatgccttgtcacgcaacatcaccggatcatcgggaaactccgacacgacaccatcatgctctctgttttgagaaacggggatagagtccagcagtctagccacctcatcaacggtcagcacatcgggaagcgtgctcacgcccttaggggcctttacctgcgcggacacatcatcgacaacaatatgttcgttcactgcgaaacgatgaagcgcatgaatgctggccaaccggcgtgccttgcttcgagatgactctcccgactcgtcaaggaagacgatataacgttccacatcctgtgtcgtcacggccgcgataccgccaacgccttggtcggcaagccactgacgatacttcttcaaatcggcgccatacgccgacaccgtcgccttcgacagtcctcgttcaacgtcgatatgagcgaggaattgccgaattgtccgttcgaaatcgtccatcaccctccttccagcagatcccatccggctcatcgtataccactgagcggtcccttaccataggtcaaacgagccctgccatgcaacgcaggaacccccgcccattgctggagcgagggttcctgtcaatcacgctgaatcagcgaagaagctcaggcttccttcggagcattcacatcagccggaagagcggccttggcctgctcgacgatggccttgaaggtctccggatcagagatggccagctcggcgagagcgcgacgatccagttcgatgccagcgaggtgcaggccctggatgaagcggttgtaggtgatgccctcagcgcggacagcagcattgatgcgctggatccacagcttgcggaagtcgcccttgcgagccttacgatcgcggaagttgtaagtaaaggagtgaagcagctgctccttggccttacggtacagacgggagcgctggccgcggtagccggaagccctctcgagaacgacgcgacgcttcttgtgggcgtttactgcgcgcttgacacgtgccatgtttgattcctcagctttctattaagtcttcttattcgctctcgctatactcagcgaccgagcagcttcttcatgttcttgctctgggaagtagccagaacgccatcggccttcagtgcgcgacgcttacgagcggacttgtgctcgaggttgtggcgcatcgcggagccagcgtgcatcagcttgccggaaccggtcacgcggacgcgcttggaagcggcggaattagttttcatcttcggcattgctgccctccttgtttgttacttcgtttcggaagtcttcggtttgtcggacgtcactgcggccttggcttcggctgctgcctgagcctgagcttcctgcttggccgccaagcgtgcggcctgacgagcctgacgttcggcacgggactgatcaccacgacgacgctgctcggactgggtgtggaccttcttgcccttcggtgcgagcgtcatgataatgttgcggccctcctgcttcggagcgaattcgacagtgccgtattcctccacttcgctagcaagacgctgcagcagctcgacgccaccaattggacgggactgctcgcgaccgcgcagcatgatggtgaccttgaccttgtctccgccattcaggaagcgcacaacatggcccttcttgacttcgaagtcgtggtcgtcgatcttcagacggaagcgaatttccttgatttccgcagtgctctggttacgacgtgcctcgcgagccttgatcttctcgttgtacttgtacttgccgtaatcgatgagcttggcaaccggaggcttcgcgttgggcgccacctcgacgagatcgaggttcgcttcctttgccaggttcagtgcgacggaagtcgcgatgactcccacctgttcgccgttcgggccgatcagacgcacctgggagacgcgaatctcgtcgttaatgcgtggttcgtcgctgatgatgactccaatcctcatgttccattcaacggaatgctcccagattggcagttcttcaacgtctcaaaagttcatggcacgccagacgcacccataagggcacgctgaagaacgttccgatacgatcttcacttcactgtttcaacacagtggcaaggcattaagcctgaacccgaggccctgaaaggcttccaggtgggtatatcccgctttcttgatttctcaagccttgtagataataccacacaccacgaccaccgcgtgtcgtatttacaagcccagctaaaacgcaccttacagctacgccgatccgcatactacactgaccttgtatgacaaataattccaatacttgcgtgattttcgcggcaggtgaatattacggagaaacaccaatggttccggcggactcgttcgtcatcgccgcggacggcgggctcgatcatgcccgcgcccttgacgtaacgcccgacgtggtagtaggtgatttcgattcgatcacgggcaaacgccccacaccagacgagcgcaccgtcgagctgccaccggaaaaagacgatccggatctgctatccgccctcaaaatcggatggtttcacggtgcaaggcttttccatatctacggtgcgctcggaggacgaatcgaccatacgatatccaacatccaattgatggcattgctcgccaatcatggcgccatcggttttctgcatggcaatgattccattgtgacggcgatatgcgatggagatctcgacttcgcagcaaacgatgtcaaaccgggtcgcatgatctccgtcttctcgcattccgacacttccatcggcgtttgcgaaaaaggattgaaatacaagttaagcgacgtactcatgaccagcaccaaggtcaacggagtcagtaacgagttccggcatggcctgcccgcgcatgtcggagttacccagggcacgctcatcgtgacattcccagccgaggctcctctgccgcaggtctcctggcatcatgcgttcaagggcgatctcggcccattggacacccaaatctcgtctgcgcttgtcgaatgcggcctgaaaccacatgcagcgtgagcgctcacagaaaatacgacgttttctgaaacacacgcgcgaatgcgttgccttaagtacaggtgacgcactaaagtgggtgacgttggtaaacaatggcttctgtgtgcccagcacacgtgtggcctaccctaaagggagaattacatgacagttaagattggtatcaacggctttggtcgtatcggtcgtctggctttccgccgcatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggttgaggtcacctccaccgaagactccatcgtggttgatggcaaggaatacaaggtttacgccgagaaggatgccaacaacatcccgtgggtcaagaacgatggcgttgagttcgtgctcgagtgcaccggcttctacacctccgctgagaagtcccaggctcacatcaacgctggcgccaagaaggtcctgatctccgctccggcaaaggacgagaccaccccgaccgtcgtcttcggtgtgaaccacaacatcctgaaggcttccgacgtgatcgtgtccgccggctcctgcaccaccaactccatggccgctatggtcaagctgctggacgagaactggggcatcaaggctggcttcatgaccaccatccacgcctacaccggcacccagatgattctcgacggcccgcgcttcccgaaggctcgcaacaaccgcgccgccgcgatcaacaccattcctcactccaccggcgctgccaaggccatcggcaaggtcgttccgtccgtgaacggcaagctgcagggccacgcccagcgtatccaggttccggatggctccgtcaccgagctgaccaccgttctgaacaaggaagtcaccgctgacgagatcaacgccgcattcaaggccgcattctcctccaccgagttctacggctacaacgaggatggcatcgtgtcttccgacatcatcggcgacacccacggtggcgtgttcgatccgacccagaccgacgtcaacaccgttgacggcgtgaccatggctcgtaccgtttcttggtacgacaacgagtatggcttcacctgcaacatggtgcgcaccctgctgtacttcgctgagatctccgagtgaatcaatagcggaacaatccgcacgattctcagtagaacttagtgcaagggctttcgcttcacggcggaagcccttttgttaaccgacgcaaatacgtaccgatacaaatacgttttagagtagaagcaacatgggcaagaaaaagcatgagaagggagccggttcaacaccggcaacagtgcaactggaacaagcgggaatcccattcaagacttacgaatacgcacattcaaacgaccatatggatgacggctatggggtcgaggccgccaccaaactgggttttgacgagcatcaggtattcaaaacgcttatggccgataccggctccgaacgcgtggtaggcgtggttcctgtaagcggacacatggatctgaaggcgctggccgcagcggtcggagccaaaaaagcctccatggccgatccaaaggtcgccatgcgcgaatccgggtatgtggttggaggcatctcaccgctcggtcaacgcacacatcacaaaaccgtactcgacgaaagcgctttgcaatatagcgagatactgctgtcgggaggcaaacgcggcttctcaatcggcatcaatcccaacgatctgctcaaagtgcttgacggcgtagccgcgcctatcggcactcggtaaagtactcgatgctcgcaaagcctaatcagcggaccggtttcttacgaagttcactgggaagcacgaaatgcatgttttccttgatggtttcaatggtggtcacatcattgaaaccttggctttgcagcgattcgataacacctgacaccaattcgtcaggtacggatgcgcccgacgatattcccacggattcaacaccctcgaaccatgtgggatcaagctcggacgcatcatccacacggtgggcctttccgcaagcaccatccagtacaccgccaaaacgcgtgttcagcccctcctgcgcaacttccgtcaagcgtacggaatttgacgaattcgccgaaccgacaatcaccacgcaatccgactgctcggcaacgagtttgaccgcagcctgacgattcgacgtggcatagcagatgtcggaattcggaggcatctcaagccatgggaaacgctccttcaacgcggcgatagtgcctgccgtctcatccacgctcagcgtggtctgcgaaagtagcaccaacttcgtatccgaagaaaaatccagcgaatcgacatccgactcatgctcaatcagatgcacatgttccggagattcgccgaccacgccaacggcctcatcatgacccttatgcccgatgtagatgatttcgtagccttctttgacgaaacgcaacacctcacgatgcaccttgctcaccaaagggcatgtggcgtcaacaacatgcatgccccgagccgcagcctcagccttcaccgcaggagacacgccgtgcgcagagaagacaatcggaattcctgcggaagctgcggaatcgggaatctcagccaattcctgcacgaatactgcaccctgagccgacagttcttcgacaacatgcttgttgtgcacaatctgacgacgcacatacaccggcggcagatcgtcagtccgaggtggattggcagccttgagaatcgtctgcacagtcagaatcgccctgtcgacgcccgcgcaaaagccacggggatccgccagtacgatgcgcttggtcatgatggccgcctttcgttgctttgtgaaaacctcatcaatactaagacatgggcggcacgccgaagaaacagcatcgtcatacggcataaaacaggtaaactgtggtgttagccggtaacgctaccgttaccggaacctatccaacggcactatggagtgactatgacctgcattaacctgcctgcccgtaccggacagcaattctccatctcccacggcgactatgaagccgtcatcaccgaacttggcgccactatgcgcaaactgacctataagggcgaagatctgaccgtcgcccttggccctgatgatctggtgacctgttgccacggccagatcctcattccgttcccgaaccgtatcgaaggcggcgagtacacgttcgaaggcaagacctattcgctgccaatcgacgaacatgaccgtaacaccgccatccacggctacggttaccgctcgttctggaagctgatctctcttgccgaagacgcagtgaccctcgcctggcgctcccccaacatggtcggttacccgtttgacctgtatgtcaccgccacctacagcctcgccgatgacggcatgcacttgaccgtcagcgcctacaacaatggcaacgcaaacgcgccgtgggctttggccattcacccgtggctcgccaacagccttaacggctatggcgacgagatcgacgagcacaacgccaaatgcagcctcacgctgccggctcgcacgcacgtcaccgtagacgagaacctcattccgaccggcaccgagccggttgacggtaccaaatacgatctgcgcgaagacactctgcttaccgagcagccgttcgatgacgcatggaccgatctggagcacgccgaagacggttccgtcacggcagtattcacccgcgccgatggcaagaaggtccgcgtcggcggcgacgaaaccatcacctcgttccaggtatgcacaggcaccaagttccccgcatcccagcatcccgccggcgttgccgtggagccgcagaccgcctatgccaacgcattcaacacgggcaacgagctgattgtgatcaagccgggtgaaaccaccagcacctcgctattcctcggtatggccgagtgaacatgcgagtgaacgtgatcaagtaatccaatcggttacaccgactgattctggtcatataaaaaccgaaggataagcctaagcggccacctatcgaacaccggatttggcaaacgtctcgttcgtgtgcgataatcccgaaggcttattaatcgtaagtaaaggagtccaatcatgggcatgcgcggacgtaagcgcaaggatcgtcgtaagaaggccgccaatcacggcaagcgcccaaacgcctgatccctgccagcgtgaataacgctacagagcattgaagaccccgcgaatcatcattgactcgcggggtcttctcatacttcttcagcctgcaataggcctgtcacaagcctattgcagggaacatgcacggacttattctccgcagcaatggtcaagcgtagcttcaagacggtcaatcagactctgcggggcatgctgcgggcgcagatacgcgcgcatggccgcgatcaatgcccgttcacgctcgtcgcagcaacgttcggggtcgaaacaatcaccggaggcgctaacgcgcacactggtatgcgtcacccgggtcacagtgccgtcctcgctggtggtgacagtggtggtatgccgttcgatcgattcactcatgcgctgtccttccctgccgtggcatagccacgttccttcgcatagttggcaagttctcgtttcaactgcgtacgcgcacgattgagacgactcatcaccgtgccgatcttcacaccctgttcgtcagccacctgctggtatgacttgccatcaatcgcagcatcgatgaacacctgacggcgttccggcgaaagcttggcgagcgccgccatgatttcctcgggcgcataggcatccaaatattcctgttccgcggatttaagttcttccgaggaatgccccgaagccgaataaatgtcccaatcgtcatattcaccggtggaatcgttagcccgctgcggtctgcgtttggctttggcatactggttgaaataggcattccgctcgatggtcgtcatccacgcggcgaaattcgttccctcctgaaaggagtcgaacgccttgaatccccgttcgaaagtatcctgcaccaaatcttgggcatcatcgggattgttggtaagcttcatcgcctgccggtacaacgcatcgaccacaggcatggcgagtttttcaaaacgcgcccttttacctaccgtagtttccgttcgtacttcagtcacagctttattgtaaccacccagacttccacatgccatgcacatagctgacggtagaatggctgttcggtatccgaagaacagggagaacacgaaatatggctttgactttggcatcagcagcacgcttgctcagcgagcatggattgttgcgcgaaatcatccaaggagacgcctggacgcttgacgcgcaaaccatcaacggattcgacaagccattcggttcaatcacctatgacaccaggcaggtcgtatctggcgcgctcctgtgctgcaaaggccgtttcaaagcggaatatctcgatggcatcgatgatcgtggacttgccgcatacgttgcggaaaacgacttctccgcggcgacgaaagctccgggactcatcgtgaatgacgcgcgcaaagccatgagtctgctgtccgcggcattttatgggtacccgcagaaccaactgaaaatcatcggcattaccggaaccaagggaaaaaccactaccgcctacctcacccaagccatgctcaacggctgctcctgcggcaaatgcgctttgttctcttccgcagacaattgccttgacggacatacctatgtcgagtccgatttgaccacaccggagtccatggatgcgttccgtatgatgcgcgaagccgctgataacggcatgaaatacctggttatggaggtttcgtcgcaggcgtacaaagtcgatcgcgttttcggacttacttttgacgtcgccgcattccttaatatcagcccggaccatatcagccccatcgagcatccgacattcgaggattactttcactgcaaacggcagatcgtaaagaattgccgttccttggttctcggcacggcatgcgcacatgccgatcttattcgtcaggatgctgcaatcgccgatattcccgtcaccacgttcgctcttggcgaagcatcggccgcggatgtgaccgcatggccggaatccgccgaccatagccgtttcgccattgcggtggaaggtgaacagatcggctcgctcagcctgcaattggatggcgatttcaattatgcgaacgccgccgcggccattgccattgcgcatgccgttggattcgatttccacgaaaccgccgcgaaggaagcactgcgcaatatggaaccggtacgtatcgccggtcgtatggagcatttccacgatacgaagtcgaacaccatcgccatcgttgattatgcgcacaattatgcttccgtaacggcgttgctcgactatgtctaccaacgctacggcaaggacgatcctgaagtcacgctggtcactggatccgcaggcaataaagcgtatgatcgcagatcggaaatcgtccgggctgcacagaatcgcgtcaaccatctgattctcaccttcgaagacacggatgacgagcctgtggaacacgtctgccaagacatgctcgacagtgtcaccaatcctgatctggatgcgaggatcattctcgaccgtacggaagcagtggagtcgaccgtagcaatcgaccgcaagaatcccaaccgcctccatatcatccttatcatcggcaaaggcaacgagcgctggttcaaggaccacggcaagcatattcccttcgaaggcgacgaccacattgtggaacgtatttttgggcttgcctgacctgcggcaacagccaaccatcatcgagtaatcaccaaccataaggaacaatccagcaatcatgatcactcttgaattcaccgacgcagccaccatggaacagcaggctgtgcaggcgggtcttaccctgcccatcgaacagaccgcggtatgggccaaatatcagaacaccattgacggacgtacgccgtggggtgcgtacgtggtgaagcaggacggcgctccaatcgcattcatcgcgctcatcgattacgaaacccatggataccactatttgaggtccgttcatggtccggcttggcttaacaagccttccgcgcagctggaagcgcaggttcgcgacctgcttgtcgaggatgtacgcaaacgcgataaaaacgttgtgttcctgcgtatcgacttgtgggatttcgaaggctcgttcccggtgctttccaccgttccttacaacgagaccgtgcacgtggacatcaccggtggcgatgaggcggttcttacccgcatgaagaagcgtggccgccgcgacgtgcgtaaggcgttgagggagagccccgccgcttgcgccgatgagaccgcgcaggcgatggctgatttttccgaatactacgaggtcatggttgataccgcccaccgtgatggtttctcccccgctccgatgagcgactatgtcgatatgatcagcaatcttggccctgatcatgcgcgcgtgttcgcggcacgtatcgacggcaaggttgtggcatggtccatcatcaccatcaatggcgatcacgcggtctattactatgcgtgcatgcgtacggaaatcatgcgccagcatgttcctgacaaactgatttacgttgtatgttgcgcacttggagagcggggctgcactgttctcgatttgatgggcatcggcaacgatttcgcgccttcattgaagagtttgaacggattcaagacgaaattctccgagaatatcgtacaggtttcggcaggtcgtgacattccggtcaagaaggcgttctaccgttcgctcacgctgctgcagtcgctacgtcgcaaactacgcaagtaataatcgcgcctcacgacggatagcgcaaaatatcgtgcaaaggagtatgcagcgaatcgatatcgctacatactcctttgtattgcattacaagttgttgtatcgatggattgtcgacaacaaccgacaatccatcatcgccatgcattatgcgattactgcacatcttcagaagatgcatcatccgcatgttcagtattggcagcatcttcggaaccatcagtatcttcatcttcagcaagatccggaccgacactgccgaaatcgttgatatcgaaatcaggattggcgtcagattcgaaatcgagatccgcctcgtcctgatccttacgcggttccggctcaacagccgcctggaagacacgttccgacttcggcttcttcaaatcgggattgactttctcttccagcatgagacgtgcatcgccagccgtggtgaagctaccgcaaatcagcacgccgtgaccatagccaacaccaagctcatcatcggcgtcaaccatattaacagcctcctgaatggcatccggcagttcaggaacacacgtaaccctttccgcaccaaacacgcgttcagcaaccgttttcaggtcttccgcgggcatcacacgatcacgccacgagttttcagtgacaatcacatggctcagtaatggttcgagcacgcccaaatactcttcgacctgcttgtctcccatcatggcgatcacgccgacgagctgctggaaatcgtaattttcctcaatcgcggcacgcaacgattctgccgcattcacattatgcccgccatccagaatgatcgttggcgatgtacgaatctgctcgatgcggcctggaatcctcaccgtgctcaacgcctcagccacaagatcaccgtcaagcgcaccgttgacgggaatcaccacttccgccgcgcacagggccgcgagcgcattatgcgcctgatgttcgccgaatttggcgaccggcacttctgcgtacgtgccattcggcgtacgcagggtcacaacctgaccgccgactgccggaatgcgggtcacgacttccgcttcgatgccgtctcgcaccagattggcatggttttccgccgccgcttcctcgataatcggcatgacggcctcttcatgcggttgacgcccaataaccgcggtgcagcccggcttgataatgccgactttttcggacgcgatctgttccacggtattgccaagccatgccatatggtccatgtcgatcggtccgataatggccgcatcggcatcgagcacgttggtggcgtcccagcggccgcccataccgacttcaacgatggccacatcgaccggagcgtcggcgaacttccagatggccatggcggtaagcacttcgaagaagctcatttttggcttgtcgagttctcccatcttcatgtcgaccatggctacaaggtctttgatttgatcccaggtatcaacgaaatcatcgtcggaaagctgctgtccgtcgatggcgatgcgctcgttgacatgttcaagatgcggtgacgtgtacaaaccggttcgcatgccgtaggcgcggcaaatcgcctcggtcatgcgcgcggtagaccctttgccgttggttccggtgatgtgaatcacacggaacgactgctcgggatgtcccatgatgtcgaggatcatcttcatgcgttgcaggtcaagattggtggtattgcgctctgatgggcggctcatgatgtcgcgttcgacgtcgatcatgctttcattgttgcgattcggatgttcgaatgacatattctttcggattcctcccctaccttgggattgctcactcaatctcccctattctatgtgcttgcatgaacgttgcgcggcgcaaaaagttataggatggtttgcggtaattacgtaagcatggataaccatattcaggagatgtgatgaacgaagtcattaccgataaagacaaggagtatgaagccatggagcaggccagcgcccccggccccgatcaggcgatgagcgaccgtgtgaacaatcgttcgctgcgcccgcgttccgaggcgttcaaagagttcatgaccaccggttgggatgataatgagccggctattgaaccgttggagtcttcccattacattcaggctcgtcttgacacgctgggtaaggcctttcccggagagcgtattgtgattccagccggtcagccgaaagtgcgcaacaatgactgcgactatgcgttccgtccggatacgacgttttcgtattacaccggtttgggtgaagactacgaggccggtgcagtgctggtgttgaatccggttgatcctgattctccggaggctgcggccggcaagacgcatgtgccggaattgtttgtggctccgcgtgcgaaccactacacacaggactttttcatgaatgcccattatggagaatattgggttggacctcgtgccggcttgcaggagatgactgcaatgaccggtattgagaccaatgacattgcacagctgtctgacgcattgagcaaggatgtcggctctgaggctggtgccgtgcgtgtgcgtgtgatccgcgaggctgatccgcagatcaccgaaatggtggaggatattcgcgaggcgaacggtttcgccgatccggatggcaataccgatgccgatgacaagcttcatgagtttgccgccgaggctcgcatgtgcaaggacgaatatgagattcgtgaaatgcgcaaggccgttgccgcaaccaagcatggtttcgacaatattctgcgcaagctgccgtcgtcgctcgacaagcctcgttcggaacgtatgttggaaggcgcgttcaatgccatttcccgtgaggaaggcaatgaggtcggctacgatacgatcatcgcttccggcgctcatgcgccgattctgcattggatgcgtaacaccggtaccgtggagtccggcgatctgctgctaattgatgccggtgtggaagtcaatagcttgtatacggccgatatcacgcgcacgttcccgaccaacggcaagttcactgatttccaaaaaaagttgtatcaggcggttttggactcccagcaggctggttttgaggccgccaagccgggtgccacgtattccgacattcatcatgcgtgcatgcgtgtgatcgctgaacgcctgcacgaatggggtattcttccggtcgatgtcgaggagtcgctttctccggaaggacaacagcatcgacgttggctcgcctgtggtgtggcccatcatcttggtttggatgtgcatgattgcgctcaggcacgttatgagtcgtatcagggtgctgcgattcgccctggcatgattttcacgattgaaccgggtctgtatttccgtgaggatgatctgttgattccgccggagtatcgcggcatcggcattcgcgttgaagatgatgtattgatgactgaggatggtccggaatggatttccgccggcattccaaagcagatcgatgaggtcgaagagtggatggccagcatggctgccgaaggtgcaaaagtctgatatgccaacgcctgaattcattctcgagttacgcaagaaagtcggccacgacctcctgtggctgatgggcgtctccggctatgtcgaagacgagcagggtcgtgtacttcttggcaagcgttccgataccggcgaatgggccatggtgtatggcattaatgagcccggcgaagagcctgccgacacggtggcacgtgaagtcaaagaagagactggcgtggatgtcatcgtcaccgatttggtgtcggtgaagtcctcccatagggtgcttacgtatgcgaatggcgacaacaccatgtatatggatcacctgtttatatgcaggccggatccaaatggcaataccgaaccattcgtaggtgacgaggagagcctcaacgtaggctggttctcccccgacgacctgcctcagcccctggccgacaccacagtggaacgcatgggctacgtgcgtgagtacatcaagaacaaggcgaacggcgacgcacacgcgcaattctccttcaacggtacgattcgctgaacacagtcacaattgaatatatacacaagagctggtgtgacggttcatgatcgtcgcaccagctcttatgtatgtcaggaagccgcgaaactcactccggcatcaaattcctttggcgagcaactcgtgcagctgagcgcaatgttctcgctgttcacgcggatcaggcaccggcagcgatgccaacaacttctgcgtgtagggattctgcgggttattcataacctgatcggcatcaccatgttccacaatctcacccttatgcatcaccataatgcaatcggccagcatatcgaccacggcaagatcatgggtgatgaacaggcatgcgaaacctatttccgcctgcagtttcttaaacagctccaacaccttcgcctgtaccgacacatccaatgcagaagtcggctcgtcggcgatcagcaggctcggcttaagcgccagcgctcgtgccaaggaggcacgctgacgctgaccgccggaaagctcatgcgggaaccggttcatatatgcacgcggcaactgcaccatttcgagcagatctcccacatagtcgctcgcttccgacacagacgagtactttttatgcacgatcagcggttctgccacattctccgcgatggtcatcagcggattgaatgaactacccggatcttggaacacaaaaccaatatcagcacgcttgggtttgaattgacgttccttgacaccgttcatttccacacccaacacgttcagggagccgccggacactttctgcaaacccgcgatggcacgaccggtagtggatttgccggaaccggattcgccgaccaatcccagcacttcggaacggtgaatagtgaaatcaataccattgaccgccttgaaatcaggctgcgtcaaatgcccaggataggtgatagtcagtcccttggcctcgacggcaatgggttggtcatgccaatccttgctgcgttcaatcaccttgccctgctcatcacgaacgaccagtttctgcccgatacgcggcacggccgcgagcaaccgcttggtgtaatcgtctttcggcgagtagaagatctgttcgacgcttccctgctcgaccacatgacctcgatacatgaccaccacttcatcggcgatatcggcgatcacacccatattatgggtgataatcagcacggaggcgccgaattcgtcgcgggcaagacgcaacaagtcaagaatttctgcctgcacggtcacgtcgagcgcggtagtcggttcgtcagccagaatcagacctggattgagcaccaacgccatggcgatgacgatacgttgtttttggccgcccgagaactgatgcggatagtagtcaattcgagtttcggcatcaggaatgcctacttttttgaggatatccacggacttggcacgaagctccttcttgtctttcatgccgtgcgcgcgaagtccctcttcgatttgccatccgatggtgtacaccggattaagtaccgaattaggttcctggaacaccatggccgcttctgatccgcgcatacggcgcagatcttctccggaaagagacagtacgtcaagctgctcattgccttcacggttcgacagataaatcgcgccggaagtggttgccgtctccggcaacagcttgataatcgaacgtgcggtcacggattttccggaacctgattcgccaaccacacccaccacggttttgcgtgggatggtgaagctaatcttgtcgatggctttgatggatcctgcgtcggtcatgaaggaaacgctcagatccttgacttgcgcaagattggtttgttcgtcactcattgcgtcactcttcttccttggagccccattcggaggcggtaaatgacgggtcgcgatccgtaacggtcactggctgatcgctggctcccattggattcttggcggccgcgagctcggctatcacctcgttgcgaacgcccggcttctggctgggatcaaccgaagtatcttcgatggatccaaccacctcaccagcggatttgcgtgcacgcagacgcgggtcggcaaggtcattgagggattcgcccaccaaggtgatacccagaacaatcaatacgatggcgatacctgggaacactgcggtccaccaaatgcccgcggttacatccgacacggaacgattcagatcgtaaccccattcagcggctgcggtaggttcgatgccgaatccgaggaagcccaatcccgcaagagtcagaatcgcttcggacgagttcaacgtcagaataaccggtaacgttctggtggagttcttaagaaggtgcttggtcatgatgcgccatgtcgacgcgcccaccacgcgagcggaatcaacgtaagcggattccttgattcgaatgacctcggatcgaatggtacggaaatactgcggaatatagaccacggtgatggagatacccgaagcgagaatgccactccacagaccagactgaccgccggaaatcataatggccatcagaatcgcaagcagcagcgaggggaaagagtagatggcgtcggcgatcatgacaagcacacgatccacccaaccaccgaaatatccggaaaccaaaccgagcaatacacccgcgaaaatagaaagcagcacagcgatcacaatcgcaatgaccgcggtacgagagccccaaatcacacggctgaacacgtcataaccacctgcggtggtaccccaaatatgctcggatgagggtgctgcctgggctgggaatgaaactccattggcatctttgagctgcgcatagccgtacggtgcaattacgggcgcgaacaaggccacgagcaggaagaacgccgtgagcaacaggccggtaatcagcatgcctttctgccagccgaccgctacgcgaagctccttgatgatcggaatcttggcccagaacggagctttcctgttgactttgagatcgttcagacgagtgtcacccgggacggtgacgttatttgctgatgcagtcatgtcagtacctcactctcggatccaccaacgcggcgataacgtcaacgatgaagttgacgacggccacgatgatggcgatcagaatcacaatgccctgcacagctacgaagtcacgcgctttcagatattgggacaacatgaatccgagtcccttccattcgaaggtggtttcggtaagcaccgcgccggcgagcatcaatgcgatctgcatgcccataacggtgatgattggaataagcgccggcctccatgcgtgcttgctgagcagacgtttttcggcgacgccacgcgaacgcgcagcctcgacatagccggaattgtaggtggaaatcacattggtgcgcaccaaacgaataaacacgcctgcggtgagcaatcccaacgccagcgcaggaagcacggcgtgacgcaacacgtcggccagcacgctcatatcacccagctgcagtgcatcgataatgtagaagccggtcggagagacgagtcgggtgaactgcatttccgaagacaacgagcatcgaccggatgccggcaacacgttcagccagatggcgaaaatgagtttcaggaccaatcccaagaagaacacgggggtggcgtagcacagaatggcaaaggttcgaatgcctgcatcggcagcgtgatcgcgtctgcacgcagctacacgacctaagccgatacctacgatcaaagcaacaatgagcgataggagcgccaactcgaaagtcgctgatccgtaatgaacaagaatgctgataaccggctgattatcagtcaacgtagtgccgagatccccatggagcaaacccccaaggtaatcgatatattgcacaataagaggacggtcgtagccggccgcatgaacacgcttttgcaactcgtcaggggtaagacgaccacccaatgccgcagaaataggatcgcctgtagctcgcatcacaaaaaacacgacggtgacgagaatgaaaacggttggaataatgagcaggaatcgagtcaggacgaaacggaaaaatccgcctgacaaatgattctttttggcttgtttcggcttcgcctcctgagagacggccggagctgctgtgtctgacacgcgatgctccttgataagaagcctgtacggctttgatttacaacaatatcgaatcactgcgccgtttcaggcagataattcgggaaatggggacctccggccatagaccggggatccccagtggttttctatgcaggctgcggcaggtcatgccgcacatccgcacacatcacgccttggtgacagatgcgaaacggaaacggaaggaagcgtcgagcacaacacccttcacgttggcgccggtaactgcaacctgcgcaccctgcagcagcgggatggtggacaggtcttcggtttcaagggtctgaatcttcttgagcagatcctcacgggcgctttcgtcggtttcaccagcctgctccataatcaaatcgttgatttcggagttggagtaagcgttgttcacgaagttgccgtcacggaagaacggagacagatagttatccgggtcggagtaatccgggaaccagccgagctggtagaccgggtaggatccatcagagtcctcggtaacaacacggtctttgttgtactgggtccattcggtggactgcaggtcgaccttgaacagaccaccctcctcgagctgagccttgagagccgcatactcgtcggcggaagaggatccatagtggtccggattgtactgcagcttgagctcaaccggagtggaaacgcctgcgtcctcaagaaccttcttggccttgtcggcgctcggcttgccgttgccgtcaccatacgcggtcttgaaggtgtcttcgtgaccaactaaaccgtccggaatgtaggagtacatcggggtgtacgtgtccttatagaccttggtcgccaactcctcgcggtcgatgaggttagcaacggcctgacgcacagccttggccttgtcggcattcggttcgtcggacttggtgccgtacggctggatgttgaagttgaagaccaggaagcgttcctcaccgcccggacccttgacgaccttgaccttggaatccttggacagatcatcgatgtcggtcggagtcagagaacggtaggccacgtcgacctgtccctgctgcacggccatcttcaggttggaagaatcggcaaagtacttgacctgaacagtgctgttcttggccggggtcagaccctgataagagtcgttcttggagtagcctgcaacctcattggccttgtaggaggtcagaatgtacggaccggcgaaagccttctccttgatgatggtgtcagcatcagtgagcttgtcggcggagaagacctcttcgtcgacaatcggaccagccgggctggaaagcacctgcttgagggtcacatcgttcttgactttggaatggaacaccacagtggtgtcatctggcgtatcgatggattcgatgttggccagcaacgaactcggaccattctcatcgttgatcgtgttgacacggtcgaaggagaacttgacatcggacgaagtcaggtcgtgaccattggcgaacttcaggccagacttgatcttaacggtgaactcagtgccgtcgtcactccaggtaccgtcatccgcagcgatgtccggagacagttcagaggtgttgtagtcctgcgcatacaggaacgggaacacgttgatttgaacggcataggaaccgttgtcataggagccggcagggtcaacgctagtaaccttgtccgtggtgccgacggtaatgacatccgcatcccccgatgcggaaccgctatcctttacgccgccgcatgccgcgagcgaggccagtgcggcaatcgaaacagccgcagccataatcttcttgtgattcactatggaatcctttctcttcctgctgtcgtaattggtactccaaaacgacgtgccataagggtagggcacactttgttagcgaaacatttcacggaagctcattttgcgacatcaccctttctcgatccaacgaaaactcagcaatcacaacggttttgcagttaatttttttccgaaaagagtgtgtcaaataatgagacagcgaatcccatattgagaatcgacggtcctcgtgacacgccgaaagacggaacttgcatcaactaattaacggcgttaatatatcaactagttcaacgaagggtccgtgcactggcgcaaggaggtgtcatgagtagttacagcgctcagcaatcatcgatttcagaaaacaatcgttccagaattctgcaatacctctaccacaacggcatcagctcacgtgcgcaaatcgccaaagccatcgaactcacacccgcggccattacgaaaattaccgcaaaactactgttccgagacgttatcgaagaaaccggagacatggaaggcgataagaatcgtcgttccatcggcctgaatctcaattgcgcgaaataccatgtcgtcggcgtgaaattcgcacgaagtctggtgcagatcgcagtgttcgacctgaaatgcaatcgtatttccctcaccgacctgcccaccgttgacgaggagcatattcccgaaacggtagaacagatccgggccaccgtacgacagctcattgcggacgattcgagcatcgtagccgtcggcatggccgttcccggtccgtatctggtggaggaaggtcgcaccgcgctcgtctcatccatgcagggttggcggcaggtcaacttcatcaaggagttcagcgaagcgttcaacgtacccgtattcgttgaacaggacgcacgcgcaggcgccttggcgcagttcctgttcaacccggaactgtccgagggatcgctcgcctactatctgcttggcgagggcatcggcctcggcatcatcgacaatggttcgatctattacggcgcgcacggcacggccaccgaaatcggacacatctccgtcgacgtcaacggcaaaccctgcgattgcggcaatgtcgggtgcttggaacgctactgctcggccaatgcgatccacgagcgactcaacgagcagccaagcattgtcccaggatgcgaaaccatgacccacgcacaggcatgcaccgcactgttcgccaaggtttccgcgggagacaaggcagccacggaactgacttccgaagtcgcacgatatatcggttatggcgcggtcaacatcatcaacgccttcaatccgacgcatatcgtgttgggagacatcatttcccaagcaggccaacccctgctcgacgaagtcaagaaagtcgttcgtgagcgcaccattcccgaagtcgggaacgataccgaaatcactctgtccagccttccaacggacgccaccgtcaccggcgccgcagccgtggccatcaccagttttctagaacatccttcgatgttctttgacgtcgcatagcacgccacaaccaaagaaaggaacaccatgtccaagccaatcgtcatctctctcggcgaaatcctatgggatatgctccccaccggcaagcgcgccggcggcgcgcccgtcaatttcgcatatcatgcgtcccagaatggcgcggaaagcttcgccatcagcgcggtcggcaacgacgagctgggcaatgagctgcttgcagacgcccacaaggccggcatcaacacgctggtgcaggtcaacgaatacccgaccggcacggttgatgtggctctgaccaacggcattccggaatacaccatcgtcgaaaacgtggcctgggatcacatcaagctcaccgacgagctcgtcgaagccgtgtccaaggccgacgccgtctgcttcggcaccctcggcctgcgctcccccgaatcccacgacaccatcgtcgaactgctcaagcacaccaaggaaagcgcactgaagttcttcgacatcaacctgcgcgccaacttctactccaatgagctcatcgaagagctgctcgactacgcgaacatcttcaagatcaacgacgaagagctgatcatgatgcgcgacatgttctccattcctaagtgcaatgacgaagaggcatgtaagtggttcatcgaccgcttcaacctcgagtacatcattctgaccggcggcgccacgttcagcaccatcactgccaagaatggcgaagtctccaccctgctgaccccgcatgtcgaggttgcagataccgtcggtgccggcgattccttctccggatccttcaccggcaagctgctgaccggcgctccgctcaaggaagcccatcgtgccgccgtgaacaccgcggcctacgtgtgcaccaaggaaggcggctggccgacctacccggcggaaggcgttcctgattatctcgccgaagccggtaaataatcctagttttccctttcatcatcaccaacgaggccatgtctgttatcatggcctcgtttttcatcctcatattcaatccgcaatttgcgcaatcccgattgccacggcatacgcacctcaacgaagaagatgctctgaacgaaccctacaccaccatgaatgccgtttcgcaatccgatattccacagtcatcctccgatttcatgcagcgcatcaccgacctgtatggattatttcgatattcaggtcaggcagtaagcccatgtttagacttcgctcgcagcgtaagaaaagcggcatataatttgcgattattgacattccgtgatatcttgaaaagtccggtcttgcatcgggtgcttgataattcaagattggggatgatcggtttcgacggtgacctgttcgtcgcagggaagcgtgccgagaacgtagggtccactcgtggatgccccctacaaaagaataagtgctaaatctaaccgcactgagttcgctctcgctgcctgagcttcgcgccaggattaaccagtgagcagccgctccgttcactccttctcgtctttgggaggatgttgagcgtcgttaagaagacttgctttgtcggctgagccacagggccggcaagggacttttactgtagatatgctcgccatcagttgtctgcgatatcgatgggggcagaaaaaccgccgcacggccagcagactacgcacgtagaagactgagggttcggttatcggaccggggttcaattccccgcatctccacgtattgaaagccgccagaaatggcggcttttcttttatttccaacggttttcaaagatccttgagtttactgtaaaccacccccaccataccggatattcaaaaaatattgacgcaatattgtcgaaagcccccttcttgtcttgcttgatctcacatacccagccccattacaaatcgcatataatcccagcttcaaattccgcgtgtcgacttgcattaaccgcttaagtgattaacatagttaatacttcaacgtagttatcacgtcacagcagacgatgtcaaggaaggacttgatcgatgacctgcacttaccctcccgaagcctacgtattcagctccgaagaaaaccatagcctgctcaatgcggaaaccaacgagctcctgcacttcggccacaacttccccgccccgcagggtggctcctattggctggacgacaccggcaatccagatctgacccaaagcatccacacgtggatcacctgccgtatggcacatgtgtattccttgggattcctgtatggcgaaccaggtgcagccgaactggtcgacaaggccatcgccggtctgcgtggtccgctgcatgacgatgagaacggcggatggtatccgtccatttccgcagacggctccacacatgaagcaggcaaggtctgttacgctcacgctttcgtgattcttgccgccacttccgccaagctcatcggccgtccgggcgctgacgagctgctcgaagaggctctggcaacttacgacaagcatttctgggatgatgagatcggcttagccgtcgatacttggaacacggaattcaccgagcttgactcctaccgtggcatcaacgccaacatgcacaccaccgaagcgttcctcgccgtcgccgatgttaccgacaacgaggaataccgcgagcgtgcgggccgtatcatcgaccatgtggtcggctgggcgtccaacaacagctggcgcattccagagcatttcaccgccgactggcagccggacctcgaatgcaaccacgacaagccggatgaccagttcaagccgtacggagcaaccccaggccatggcattgaatgggctcgtctcatcacccagtatgcgctgagctccaagcagcgttccgaaaaaggcaagcaacagcttatcgaggcagccgaaaacctgttcgcccaagcactttccgacgcatggaacgccgaaggtaccattggcttggcctacaccaccgattggaacggcaagcccgtcgtcaccgagcgtatgcattggaccctcgccgaatccgtgaacacctccgccacgctggccaccgtcaccggcaagcaggtgtacaaggactggtatgcgaccttctggaagtacatcgacgaatacctgatcgaccacgagaatggttcctggttccaccagctgaacaaggacaacgaggtcatcggcaccgtctggccaggcaagtccgacctataccacgccacgcagtgcacgctaatcccacgtctcgatccggcggtttccgtcgctccggcgctgaaagccaatccgaacgcctgacggcacgcaataatagagctcccttttttctctcttcttttctctcctcctatttgcgaagagccccggtcacggcaaagcgaccggggttcttcgcataccaaaccagactgctcaacgtatgcaattcccctaatttcccatgtcttcaccactatttgatgatcgggcgtagaggcgcggacacgtcgacgttgtgtttgtctccgatcacatttggatcgttgatgatcttgtcgacaacggctttcttcaacttaagatcggaagagtcaccccatacaatcacacggtctcccccattgatttccgtggtgatggaatcctgggtttcagccgtcaccttggtaatggagttacgcatagattcaggaagcgagctcaaaatcttcagtgcctctttaatggagcggttgctcagactcgtctcgacatccttcacttcgatgacgggaattccatccacggaggcgccgctgacggaattcaatatacggcccttgctatcgaccgcggtcatgctgtcttcacctgttttaagcatcgcagccggcttctgcgctttgatggtcacttcaagggaattaggaagttgcttcttggattgcgcggtggtgactcccggtatttccttgattttcttctccacatcattgttcgataccagcagaatcgatttgccggcctgctgaccggcaatatccaatacttgcgactcgctcacccattcgttggctccgacaacggaaatattgccagcttcaagacgaaacaccgatgagaagaaaaacaaccatatcagcgccaccacgacggccgcaaccgcggccgacacgaaagctcgcatcgctacaacacgtgcattcgccttacgtcgttctttcaaccgcgctttgaaatcaaccactttcggacgggtgaccacccccaaagtgccagtggtttcctccagcgtcttcgcaacgaaatcctcacccgcaagattgcgcgcatccacgaagtcacctgaccgggagcgacttgccttgttcttgcctccgtgcgccattttggcttccgcctgcgcatggctcactgaagaagacgaacgtcccactcctccagcaatggaacgaccattcggctgagactgagccggggagtcgaaatgtttccggctttgaatgctcctgccgcgcaacgcatgcttttcagacgtcgtttcagaaccatccgaccccgtaccggagctgacgacccttcgcgccatcagccctcacaatcccagcgatgagcctgcagcgcgtgcaatatcacctcgtccatctgcgtgatatcacccgcgccaacggtgaagataacatcaccatgatgggcgcgcatcaccatcatctgcgccgcggtatgcatgtcttccacaccacggatccaatcctcggcaggcgtatggtcgagcttaagagcctcatccacaatggtggccgggccgaccgtcggataatcctcctgcttttcacgtgcagggaaaatgccagtgacgatcacatcatccgccttggccagcgcctccgcgaatgcttccgcgaagaacttggtgcgggagaacaagtgcggctggaaaatcacacgaatcgccgattgcggatatttacggcgggcagcatccagcaaagccgaaatctcagtgggatgatgcgcgtaatcgtcaacgacggtcacctggctgacggtgccgcgtacttggaagcgacgggctgcgccgaggaacgacgtggccgcttcagcggccttctcaatgtcgactcccagcaatgctgccgcgataatcgccgcagaagcattgcgcgcattgtgaatgcctggaacggcgagcgtcacgggaaccatacgttcctgttcgcccagcagtcccgcaggcacatgcaaggtgaaatgttcggcgccgctttgcgcgctttcactttccgattcgatatgtacgaatgccgcaccgttcagatcacccaacgaagccgcatcctgcgtcgcatacacgaccgtatgtgctgccgcagacgcgtcaagagcgcgcaacacagccagattcccttcgtcgtcaccgcacatcaccaccgatttgatggcgtgctgaacatggttcacgaaagccgcccgatagttttcctgcgttccataatggtcaagatggtcagcttcggaattggtgacaatcgcgatttccggatgatatttggcaaagcttccatcggattcgtcggcttccgccacaagcacatcgccttggcctgcatggcctccgtcaagtatcacgccatccttgccttggatggatccgccaatggcataacttggatcagccagatttccctcaccggcatgggtgagaatatgggcgagcatggaactggttgtggttttgccatgggctcccgcaaccgttaccgcacgtttcgtattcatcagcaacgaaagaatgtcgctgcggtgcacgatgcgttcgcccgccgcatgcgctgcgacgatttccggattgtcaggcttgatggcactggaaaaaacaatagtttgtttgccttcgacgttttcctcgcgctgcccgaattcgacggcaatgccaagcccctgcaaacgatcggttttggcgctgggctcgcgatccgagccatccacctccacaccctgctcgtgcagcatctcggcaagtacgctcatgcccgctcctccgatgccgatgaaatgggtgacccccaaatcgttcacgccttcctgctggctgaatgacacatgggttggatcaagaataatggtaccggcctcacgctggttgtcagtcacgactgctcctcttgcatattatgtttagcttgttccattatggtctcacccatggtctcgtacttggtcgatcatgggtgagattcggaacgcgacttcaaatgcgacggacacacctgccgccgctacggcttacctttcgtcaatcatggaaagtacacgcttggccatgacttcggcggcatctcgaataccatatttccaagcgttatcgccatacctggcaagcgcatccgaatcggctagcagattcggcacatgacgtttgacccattcggcagtgaagtcagcgtccgccaccatcaggccaccttccgcatcgacgaccggctgagcgttgaaacgctgctcgccgttgccgatcggtaatggaacataaatcgcaggaagtcccaaagcagtcaattccgaaacggtgcccgctccggaacggcagataatcagatcggcacaagcgaacgcaaggtcgatacgttccaagtaaggcgcgactcgataatcaccgtcgttggcatgctctggtccaagctcaccaagcacctgctctccggcactcaccgacaccaacgaacgcacctcatcgtctttgccttttcccgtcaggtgaatcacctgcgcatgttccagcaattccttggcggaagccgccaccgcacgattcacgttcacagcacccaacgatcctccggtcaccaccaccagaggacggttcggatcgactcccagctgcgctgcagccgtttgccttgtggctgcacggtcatgttccataccttcggctattgccgcaatttcagcacgcaacggcaatcccacacgttcggcttcaacacccttgcgtggtttcaaaccggtttgcgcgtacgcggtgccgatcatggacgcccagcgtgcacccagcttgttggccatgccggcacgggcgttctgctcatgcatcgcaatcggaatgcccatcttgtgcgcagccgcatacacgggagccgacgtgtatccaccgaatccgacgaccacctgcgcctcgtggcgggtgagaatatcacgtaccttggccgtttcagccttccactgcgcaggaaacttcaatgccgccatattgggtctacgggggaagggcaccttttcaatggtttccagctcgaagcccgcttgcggaaccaactcgtgttccagaccgactgcagtgcccaccaccgcaatatcggcatccggctcaagctcgcgaatcacatgtgccacggcgagcagaggattgacatgacctgccgtgccaccgccggctagaacgatatgcttctgattgctcataatgtacgagcttagccccacggtatcccggcacaccatgcgccataccgatgcttacaaggatactcacatttcatctacgtttgattgccaccgcatgcgacagcaccccgcaggcaacagtggcttttcagactctctgaatctccgcttggatctgcggctgctgtttcatcatgctgatggtcacgcccgcagcgcccaaacacagaatcaacgacgaaccaccggccgacacgaaaggcaaaggcacacccataacagggaacagccccaccacgacaccaatgttcacaaacgcctggccgacgatccacacggtaatattggccagcaccaaagtgatatatctgtcatgcgcttggatagccaccaccagcatgcaccatccaagcacaaggaacagcagaatcaccaacgaagcgccgacgaaacccgtttcctcaccaatgatggcgaaaatgaaatcgttgtgcgcttccggaagatatccccatttttctccggaattgccgatcccaacgcccagcaagcctccggaagccatggcgtatttgccatgcaccacctgatagcagacaccctccatatcagctgcggaacaagtctgatatgtagccatgacgcggttaagtcggttcggactgctgataacaagaccgccgaccaaagccagaccgccacatgccacaatagccagccatttgccaggaaaatttcccagcaacaacgcggttcccgcaatcgcaaagagaatcatggccgtaccaagatccttgccgcccataaccaacagcaatgcaagaccaagccacgtaatcaacctgcgatatgcattgaccggccccaccttacttacccgcttctgcgcgctaatcagctcccgaggcagccatacgcatagcgcaagcttgacgacctcagccggctggaaggtaaatccaaaaagaccaatccaacctttattaccctgagcatcaacacctaacggcgtaaatgtcaacgattgcaagaacaaggcgacgagcagaaaagcgaaactgacccttctgataagctccgccggaaccatcatgcaggccacgcccacaataagtccgagaacgcagaatgcgccctgcttaatcgcttgtgaccatggagattggtcattggcaatcatatacaccgaagagctggaaaacaccatgatcacaccgaaaatggtgaggataaccacagagaccctaaacccgtgaaaacaccaaatcggattaagcatgcttcgcagaccgacataaccacgaaaatcgtcgacccgttcttcagcagcagcctgcctcttctgacgggtaccgtcactctgcttggttttaggcttctccatgctcattcacccaacgctgagcctgctgtgcgaactggtttccacgatcggcatacgacttgaactgatccatggacgcacaggcaggcgccatcagcaccacatcgccggattgggcatattcacccgcagcatcgacggcccgttccataatgacgtcattattcgccggatcgatgatggtcaacggaatgtcgggagcacttgctgcgaacgcgtccaagatgggctgctgatctttgccaatgacgaccgcggctttgatggtgtgcgactgttctgccaccaactgttcgaaacggctgcccttggccaatccgccagcgatccacaccacggatttgtctgcaaaactattgagcgatgccttggctgcatgtgcattggtcgccttggaatcatccacgaaacgaatgctgcccccatctggcgtggtggcggtggcgacagtctgaatgcgatgcccgcctggcgtgaattgttccagagatgcgatggctttctctttgtctgcgccaagccccagcaccagcgccaatgcggtcaacgcatcagcaagcaaatgcgggtacaccgtgccatcaggctcagtcagatgcgtaaactcagacaccttggcgacctgctctggcattccaagctcgccacctgcgatgccagacatatcgacgatccaaccgtccttcacgccgatctgaccatcttgcggctcagacagagtgaatccgaccttgcggcagccttccgccgtctcggctgcgaacgccagcctggtcacacgctcgtcatcggcgttatataccaaagccttcttgacgcggtggaagaccttcgccttatctgccgcataattttcaatgccgccatgccagtcaagatgatcatccgcgatattggtaatcgcagcgcaatccaaagccagcgaatcggtgaaatgcaactggaaggaactcagctcaacgcatagcacatcatttgccggatcgaccacggcatgggataccgccttgccgatgttgccgacagccggtgccgtcaggtcacaagccgtcagcatttccgaagtcatttccgtagtggaggttttgccgttggtgccggtgatgccgatccattgtgctagttcgccggtggaatcgcaattcactcgcagctgccaagcaagctcaacctcgctcatcacaggaatgccacgacgctgcgcctcaagaataaacggagtcctcggattgaacaccggcgaagtcataaccaaatcaacatgatcccagtcgatgcgatcaaaggagtgcaaatcagcatcgggcttcttttcatccacgccaagcactttttcggcgcgggaccccaacacttccatcatgctttggccagaaactccaagacccgccacaatcacggtcttaccgctcatatccatatccatcatccttcgattgtcggcacctcatatgccttgatattccttacagatcacagtcatgttgcagccgttcacatatcagcggaacgcaacagccgtcacagaccggaacgggagacccaatcgccgtagaaaatcaccaacgcaattaacacgaacagcaattcaatcatccagaagcgaattacaaccttgacttccggccaccccttcaattcgaagtgatgatggatcggagccatcttgaacacacgcttgcgagtcatcttgaaatagccgacctgaataacgtcgctcatggtttcaatcacaaacaggccgccaaggataatcgccaggaattccgtatgtgtggcgattgacatggccgcaaacaagccgccaagcgccagagaaccggtatctcccatgaaaatggatgctggattggagttgtaccacaggaatccgaagcacgccatcgccgcgcaggccgcgatgatggtcagatcaagaggatcggacaccgcgtaggcgaagccttcatgtcccaaacccttgaggtggtagaactcccaaaaagtgatcaccgcatatcccatgaatgcgatcatcgaagaaccagcagccaatccgtcaagaccatcggtcaggttgatggcattggtccatgcggtcatcaggaagttcacccagatcacgaacaacacgatggccacggctttgcctgcgaactcgaaactgaaaaacggctcttcaatgaagctcatgccggcctgcgcgctggggaagccggaattcgtcggcagaatcaacgccagcaccgcatagatggtggcgagaacgaactggccgatgaatttgcctttgaccgtcaggccttcgctctgctttttgcgaaccttcgcgaaatcgtcgatgaatcccagcatacccatcgatagcatggcgaacagcaccagcagcgccgaccatgacggcacctctcccctggtgatgaagcgatacagtgccgacgagccccaacccaacacaaccgccagattgatgaccacgccacccaacgtaggcgtgccacgcttgaccagatgggacttcggaccatcttggcgtatgtactgcccgtaattaagcttgtgtaccaaacgaatcagcagcggtgttcccacaatcgttacgaccagcgacaccacaattccgatgatgagcgaaatcacctgatgttctccgtttcagtcagacattcttcagataacgtcgattattcaaatcttgccaaatgcttttgttctattgtgcagccagggcctgccaacgttcggccagagcgctcaagccggaagcgtgggaacctttaagcagcaccacggcacctggatgttcgacggcgagtcgcgtcacaagactatcggcctcatcgatatcgtgaacccaatcgacgtgagaagcgtctcccgccgaggatgcgccgtccgccatggcacctgccagagcgtccagggaagcatcggatgcactgccaaccgtcagcagcgcatcaaccccgccttccaacgcataccggccgatgccaacatgcaaatccttttcatccggaccgagctcaagcatggcgcccaacaccgcaacacggaatggctggctttcggaaccagccttccaacgcagcaatccgtcaagaccggctttcatggaatcaggattggcgttgaatgaatcatcgatcaacgtgaatgacgtttcctgcttgttcacgatggaaacagccatgcgatggggactgatggccgtcacatccgacaatgcggatgcgacatcgccaatcgacatgcccaaacgcatcgccactgaagcggcggcaagcgcattcatgacattatgctgaccgcagatgcccaaggtgacttcggcatgctcgccatcaccattgtccaaaatgaagctcggatggtccaattcgtcgcaatgcacatgttgcgcgctgattgccggcttgccgtcattgttctgcggaagtccgaaccacatcacgtcgcccggagcgatggcgctcatcgcagccacatgctcgtcattcgcgttcagtacggaaagaccacctggaacaagaccacggatgatttccgatttggcttgtgcgatgcgttccggcgagccgaattcccctagatgcgcgacgccgactttcaacacgaccgcaatatccggcggcaccagcgacgtcaaattcgcgatttccccaacatgattggcacccatttccgcaaccagaaagcgagtttccgcatgtactttgagcgaagtcaacggcagtccgatttcattgttgaacgatccgaccggcgcaatcgtcggtcctatgtgcgccagcaacgccttcatgagatccttggtagtggtttttccgacggaaccggtgatgccaatcaccgtaaacggcgtttccaacgcacgccggcgttcgatattgtgcttggccaacgcgcccaaggcaagcaccgtatcttccaccacgatctgaggcactccggcaccgtcgatctcatggtcgactattgcggcaacagcgccctgagcgcctaccttcgacacataatcgtggccatccacgcgttctccggcaatcgccacgaataccgatccttcaacaatctgtcgtgaatcagtgaatgtgctggtggccacaggcgtatcaatcgccgcggtgccggcaatcagccgtccctgaaccgcctgggcgatttcctccaagctcattggcatcatggtcgggctgctcactctgatttctcctctgtgttgatgtactgcatattgttcacgttgtttacgattatcactattcgacgtccgcatccgttccgatcgagactagttcagatctcgagatacacgcaatgcgcttttaatattggctttacgtacgccggccgcaagcaccatggcgatggacaatgacaacgcgctgctgtccgtctgcccgtatgcctccgtcgcttgcgctgcgagcgcatcggattcctgcgtacgacctgcgatgtgggtctgcttgccgacagtgcatccaaaccgtgcgaccgacttgacgatctcagcctcgctgagacccttgtcgtcgcagccaagcacatcaacattcaccgactgcaacgcatcgtcattcaacgtttcctcgctgagcgcaaggatcacagcggcggcgccgtcttcggcgcacacagccatcgtacgctgcacgtcaagaatcgacaatggatagttcagatcaaggaatcgttccaacgattgcgaattgccggcactaatcacgccgaccggattgccgagcatgtgcaggaaatccgcgagatccctcacaccctgttccaccgtttgcgtattgctgccagccacggcgaacaccgccagcgaatcggatgggctgcccgccatctcgctggcaagcttgcccaactgttgcgcagtcggttcggcataaatcaaaggaatctgaacgccatccgtttttcctcgcaacgcatgcggcaccaccgcaccatacgcaccaagcgcttgcacctgccgtaactgttgctcatccacctgcatggacggcatgaacaacgctcccggccgcaccgaatcgatgtcgtcggcaatggacgtgaccgtcacttcggtagcgaacgcgggatcaaggtcaaagccatatctgctggcaagcagacccaacgtcattcgcctattcatggattcgctgaccgcgctcatctttccgcccctccgttcttcatgctcacacactcaccaagtcactggaatagcatcagttcgcggacttgacgccggcacttcgtacttctgcataaggaattcaccaatctccgcagtgaccgggcctgccgtcagaccaccataaccgccttgcggatctttcaacaccaccgtaacgacgaaacgaggattatccgcaggaataatcgcagaataatcgctgataatcgacgacagacgtccgtccgcaccggcaacttccgcggtaccggactttgccgcgacacggtaaccatccactttgacgaactgggaatagtggtcggacacggattccatggcattcatcacctgtgaggccacctgctcgtcaatcacgcgcgtcgcttcgccttcaggcttctgctcttcggaatgcccttcggcatcgctgatcgccttgatgatgcgctgcggctttttgacgcccttgttggcgatcacggcaaccgcgttcgtcaactggagcgcattggtcgtatacgcctggccgaacagcacggtgttctgggttcgcagatcccattgatcggccgaatacagcagaccatccgcttcgccgggaagaccaagcccattgtcttgtccgataccgaatttgctgatgaactcatatcgctgctcgttagacatcttctccgcggcgatgatcatgccgacattcgacgattgctcgagaatgcctgccagcgtccaatgctcatcgccgtgggtcgtcgcatcgctgtaggtctgcccgttcgtcgtaatgtggtccggcaccgtgaatttatccgatgcctggtgcaatccaagctgaatcatgcctgacatggtgaaaaccttgccgatggaaccgggttcaaacgtttcgctgacggccctggaaaccgtcattttcgcctggtcgctgccggcttcgatttcgtcgctatcggcgagcgcgagaatgtcccctgtttgtgtgtcctgcaccacggcgactccccacggtgaactatatttcgtgcagctttccttcagcactttttcgacgtaccactgcacgtcatggtcgatggtcagtgtgacatcggagccgttgaccgcgtcttttgattcggtcatggttccggggatttcgacgccgttgttgccttgttggtagacttggtacccgtcttcgcctgtcaacgtcttgttttccatctgttcgatgcccgctacgcctttgccttcaccgtcgacacctcccagcagtgcgcccatcagggttccgttggaatagatgcgctcgttgctgagttccgcgtagacgataccgcccagattgagtttggagatcttgcgcttaacggccggcgtcacatcttttttgagtaccgcatattggcctgttcccgaaagcatggcacccaattcggtggcgtccatgtccagtaccggagcgaggagtctagctaccgccgcagctccggtagcacctaccggcttgccatcgatctgatggcagttgtctccggtctgtttggtgcaggttgtgggagtgaaggcctgtgcttcctcggggttgccgatgatggtgtagcgctccacgctttgcgcgagaatcgagccgttcgtgtccatgattttgccgcgccgtgccttcaaagtcacggtaatcgtgcggttttgcgccgcggcctgcgccatggttttgccattgatcaactggatgttggccaattgaataaggcaagccgtgcccatcaacgccagaatgacgccgatggccatggttttcgtaagcagtttcttgtggaaacgtgcgtaagtgcggtgaaaaggattcactgagcgtcgtctccgcttggctggtagccgttcagatcaatcgttagagcgcctttttggggcaccatgcccatttcctcggccttgctcggcagcgaggcttcaagttcgtcaagcttggcctggtcatcttccacgtcttgggtcaggcgggtaatgttcgactcaatctggttcgcctcgaaggaatgctgcaccatttgggtacgcagcgttaaggatcccagaagacatccgccgaggaacaccacggcgataaccagatgcaacaatggagtgcttctggtgcgcgtccatgtgatgagatgttcgaatcctcgcttgacgctgttgccttcggcccgcgttcctttgacgacgtgcaattcagggcgagtggtgccagcggtttcggtttggtcccggcgtcctgcgggagccgcgtttgatgcgatcgttcttggtgcggccacgttcagcccctccttccttgtcgtttcatgcttgcgtaatcattgccttggtcgaatcgttttcgccagcgttcaggaattggtctggtcagttccactgcgcgcagtcgcacagaggccgaccttggattcatggcgatttcttcctcggccgctttgatggcgcctcgcgtcagttctttgaagaacggcatcatatccgggggtattaccggcatatctgcgggcacgtcagctttcagaccttgattcataaatgttttgacggtcttgtcttccagcgaatggtacgactccaccaccaaacgtcctcccaccgcaagatggttggcgatctgcggtagcgtccccgccaatttgtcgagctcgccgttgacttcaatacgtaatgcctggaacacacgtttcgcgggatttcccgcaggacggtgcgcttgcggcacaacctcatccaccaatcggttgagctgccccgatgtggtcaatggttcgatctcacgcctacgcacgatttcgcgggctatctgcttggagaagcgttcctcaccatatgtacggaaaatgcgtaccagatcagcgaacgaatattcagcaagtatctgttcggcggtcaatggctgggtcacgtccatacgcatgtccaaaggcgcatcgtgagaataggagaatccccgctccgtctcgtcaatctgcaaactcgacaatcccaaatccatgaacacggcgtttacctggtcgatcccctgatcatcaagcacttgcgcgaaatcgtcgaatgcggcgtgcacgggtatgaagcggtcggcaagaccttccatccgcattcgctgcgtggcgagcgaaagcgcctccgtgtctcgatcgatgccgatcagacgcgcttgcggactcgctttgagaaaagccgtggaatgccccgccaaaccaagcgtgcaatccaccgcaatcgaccctggcctcgccaacgccgggaccaccagatccacgcagtcgcgcagcaacactggctgatgtatggtcgttacatctgtcatcagaattccaccgccggtaatacgtcatcggcaatatcggaatatccctgctcctgttcggcgagatattcctcccatgcctgcttgttccaaatctccgctcgggtccccacgccaatcaccacgatgtcgcttcccaaattcgcgtaatcgcgcaacatctgcggcacgagcacacgtccttgcctgtctggctcctgatcaaccgcgccggaaaggaacacacgcaaataatcacgtgcagccttgtttcccatggatgtgcgctggatctgcaatgcgatccggcgaaattccgattggggcaacagatagacacatcgctcctgaccacgggccatcaccatgcccggtcccagctggctgcgaaattttgcaggcaatgccatacgtcctttggcgtcgatttttggagtgtatgttcccaacagcagcggaggcagtccagccatcacaccgctcgcttgcgtcgaaccatcgtcggagaagggctcggtttcaacgctttgaaccatcgccacacctccttacatgatgcgcgggaacacctagacccaaaactctttccccactttaccccacgcatcaccataaatccccacataaatggaaaaaatcagcaaatgctgaggttgattttccccacattgaacgaatggcatcaaatcaactaccgtaaattcatccttgcttcgctatgtcgcactcgccctcgtcggttttcgtagaagcctcggggtacattggagtgcctaagttttgtgaggaagggattgtagatgtcgagttattccgcccagttgcgtgaagaacaacaggccgtcagccgcgcgtatggccgcttggacgacctacgggctcaagctcgcgcccgtctcgacaccgtgcgggcagcgggctcgcacggttcgcccacgcaacgcaccgaacgcgactccttcgccaccatgtacgaggaccgtctcacccagttgcgtgcagtcgaggaccgtctggtgttcggcaggctcgatgatgttcacggcacgcaccggtatatcggtcgtatcggattgtccgacgagcaccatgagccgatcctcaccgattggcgagccgacgcggcacgcccgttctatgaggcgacgccttcgcaccatggcgatatcgtaatgcgtcgccatatcacgctgagtttccgtgaagtggtcggtgtcgaagatgaggtgctcgatgtgcattccgaccaagtaggtcaagcgtcctcggacggcacgctaaccggtgaaggcgcgctacttgcatcattgaacgccaaacgcaccggcaagatgaccgacatcgtggccaccatccaagccgaacaggaccgtatcatccgtgcagacctcaatcaggccgtggtagtgcagggcggtccgggtaccggcaaaaccgccgttgccctgcatcgcgccgcatatctgctctacacgcatcgaagaatgctcgaacgttccggcgtgctggtggttggtccgagctccacgttcctgcattacatcgaccaggtgcttccctcccttggtgagaccggagtagtcagccgaaccatcgccgatctgatccccggcgtgatcgcgacggcgcatgacaacccgttcgccgcgaaattgaagggcgaacgtcgtatgtccaaagccatcgccaatgccgttgccgcacgagaacgcgtccccgcatcattgccgtcgatccgcatcaacggattcgcagtgcccatcgtgcgcgcggatatcgaacaggccatcaccgatgccaagcgcacgcgacagcagcacaacaaagcacgcgaaactttcgtgcatagcatgttgatcgccatgcgcaaccgttatgtggacaagcttgattacgagccggagcaggcggagttgacggatgtgatgcagcagttgcgcatgaatgacaccttgcgcaagacgttgaatctcgcatggttgccgatgaccggcgaatggcttatcgaccaactgttctgcaagccgcagcagcttcgtcgcttcgcaccatggcttgaggaacgcgatatcgaagcattggttcgtcccaaagggtcgccgtttaccgtcagcgatattccgctgctggatgaagccatggaactgcttggccccgaccccaaagcggtcgcccgccaaaaggcgttggacgccaagcgcgccgaggaggagcagttcgcgcaagatacgctggctcaggctggcatcggctccggcatcgtcacttcgcagatgttggtcgacaatatcaacgggatggacgcggaactcaccgcgcagcgcgccgccgcagaccgtgaatggacatatgggcatatcgttgtcgatgaagctcaggaactcaccgccatggattggcgcatgctcatccgccgttgcccgtcgcgttcgttcaccattgtgggcgatgttgcgcaaacctccgcattgggcggcacccgttcgtggcggcgtatgatggatccgttgttcggaccccacaattggcaactcaacgaattgacgattaattaccgcaatccgaaggaagtgtcgcagctcgcctgtgatttcgcggcaacggagggattgtacatctccaccgtcaatgcggtgcgtggcgtgccggattcggtcaagcgcctcactctggccgacgacagtctgattgccgatgccgtggcacagcagaccgtcgatctggtccgcgcattcgtctcctccgatggcaccggacgcgtggccatcatcgcacctgacgatatggtcaagccgttgcgcaggcgggtgtacgaacagcttcgcgaaacattgacggcgaaggagttcgaccgtctcgatgcgcagagctcttgggatgaacaggtcaccgtttgttccacgcaaatggtgaaaggcttggaatacgacgcagtgatggtggtgcagccgggaagcatcgaggagaatgccccctcacgcattgtggccgcagccgatttatacgtcgccatgaccagaccgacacaacgtctgcttatagtccggacaaatgcagacgaaaaactgctcaagctataaggtaggaaccatgcctaaagcattgttacttgaaaatattcatcctgacgcggcacagtcactgcgtgaccacggcttcgaagtcgagtgcctcaggggcgccctcaacgaagatgaactcatcgacgccttggaagacgttgatctgctgggcattcgctccaaaaccagcgtgaccagcaaagtcatcgacgcacgtccgacgctcacggccgtcggctgcttctgcatcggcaccaatcaggtcgatctcgactatgcgggcaagcacggcatcgccgtgttcaatgccccatattccaacactcgctccgtggtggaactggttatcggcgacatcatttgcctgatgcgccgcattcctgcgcacacccatcatatgaagcacggtatgtgggacaagtctgcttccggctctcatgaagtgcgaggcaagacgctcggcatcatcggctacggcaatatcggatctcagctttccgtcatcgccgaggcacttggcatgcgcgtggtgttctacgacattgaagagaagcttgccatgggcaatgcccatcgttgctctacactgaacgaactgctcgaacagtccgatgtggtcacactgcatgtcgatggccgcaagtccaataccggtttcttcggtgaggaccagttcgcgcatatgaagcaggattcgatcttcatcaatctttcccgcggttttgtggctgatttggacgctctgaagaagcatttggactccggccacatttcgggcgccgcagtggatgtgttccctgtcgagccgaagaagagcggcgacgagtttttgacgagccttgcggatgaagacaatatgattctgaccccgcatattggcgggtctacgcttgaagcccagaagtccatcggacagttcgtctcacagcgtcttgaggattattggttcaggggatccaccatgttgtccgtgaatcttccgcagatcacactgtctgatattcgttcgaacttccgcatcgcgcatcttcacgcgaatttgcctggcgtacttgccaaggtgaaccgtgtgctcggagaagagaatatcaacatcgcggcacaggcactgggcaccgaaggcgaaatcggctatgtggtcaccgatgtggcccagcgccccagccagaaggctttggacgaactcgcagccatcgaaggcacgatccgtatgcgtgtgatcagctgacgatcccaatccggcaaacgccactacgatacgaatgcattgtgggggttccaatcacttattggctggaacccccacaatgcatgaaccctaatgccgtttgccgtaatcgcccagttttgcgctaccaagtccatttcagccaaaacaaacgcattatcatatgcgttcgcaaccgttcgaacctacttcagcgcatcggccttcagctcgtcgatcgcgttctggaaatcctcaagattctcaaaattctggtatacactggcgaatcgcatatacgcgacctcatcaagatcacgcaacggtttcaaaatggccctgccgacctcgtcggatttgacttgagccagtcctcgggcacgaagatcctcttcgacctgctggccaagagccttcaaatcgtcttccttgatcggacggccctggcatgccttgcgaacaccagaaatcaccttgttcctatcgaactgctcaacgttgccggaacgcttcaccaccaacaacatagtggtctctagcgtggtgaaacgcttggagcatttcgggcattcacgcctacggcggatggaatggccgtcatcgctgatgcgggtatcgaccaccttggtatctggattctgacaaaaagggcaatgcatggtgtcaagaatagcctgaaccattgaactaggccaatcttgcgcgggttcatacctcgtcgggaacgataagtctttgaccggcccgaagcgatactgaatccagattattcagtcgtaccagctcgtccacagtatccgcaacattgccaccatcaggcgtaatacgcgcagcgtacccccacaacgtatcgcccggctggacggtatataccaccaccggcgtcgctccgggatctgactgcgcgcgtgcaggcatcatcaatccagccaaacaccatgcgagcaccatcagcatcatgattacggccagtcgatccgcccagactttgaaatcaacgccatgagccttcggcacacgatccatcacgccactccttctcgaacagctgttctatcgaacgcatgttctgagtatggcacaaatgttcgataattgcagacacacctcgaacagatgtttgattttctcggcgtttcgcgttatgcttgcctaagacctgaaaggagcccaccgtgagcaccgtcccattcacgcccaaaaaggatgccgagcgtccggatgaaagcacgctgaccgaccgtcagcgcaaggtgcttggcgccatcaaaaaacatctcgtcgagcaggggttcgctccctcattccgcgaaatcggcgaagccgcagggcttaaaagtccgtcatccgtcaaacaccagttgcaagtgcttgacgacaagggcttcattcgcatgaacgcgaacaagggcagagccatcgaagtcgtgagtttcgacgatgacgaggtttcgcccggcaaagtagcgcaggtcatcccattcccgagccaatctgattccagcggatccatcatggcttcccgcgatgtccccttggtgggacgcatcgcggcaggcgtgcccatcaccgccgagcagcatgtggacgatgtgatgcgtctgccggaacgtctcactggcaccggcaatctgtttatgcttgaagtgcatggcgactccatgattgacgcggctatctgcgatggtgattttgtggtggtacgcgagcagaacaccgcggaaaatggagatattgtggcggcgctgctcgacgatgaagccacggtgaaaacgttccgcaaggatcatggccatgtctggctcattccgcacaatcccgcctactcccctatcgatggcacgcatgctgagatcatgggcaaggtggtcaccgtgctccgcaaaatctgacgttagactattcaacgccattgaaatcgcgcccacaaagatgaagccataaacaaagactccatctttgtgtgcgcgattcttttccggtaaacgcaccggtcatttaagaatgtttaggaatgcatttcggatttgctggtcgaactgtatccttccggttcgagttggaaggtggtatgaggtacggatacggggaaatgttcgcgcaggcaatcttgtagttgtgcgagtatttccgccgcttctttcatggtgagtccttgttcgaccacaacatgcgccatgaagatcggcatgcctgtggatacgatgctcgcgtggatgtcgtgtaccgccacaacatgcggcacttgttccaagtgggaacgcacttcatcgagatcaagaccgttgggggtttcttcgagaagcacgcgaaccgcgttgcgcaacagtttgatggctcgcgggatcatcatgagtgcgatgatgccacctgccacagcgtcgaatccggcccagccggtgcagatgagcacgcttgccgatacgattacggcaacggaccctaaagcgtcattcatgacttcaaggaatgccgctttcatgttcatgttgtcttcgctttgcgatgcgaggataaagattgatccgatattggccgcgaggccgagtatgcccatgaagagcagcaatcgcacgtcgtttacttcgtcggcagatccgccgaaaagtctcatgccggcttccacaagcgcatagatacctacgatgaggaggatgagggctccgactgccgctgttagcacttcgagccttgcccagccccaggtgcgtttgttgctgggcttgcgttgcatcagtattgcggtgacggttgatgcgatgagtacggacatgtcggtgagcatgtgtccggcatcaacgagcagcgccaacgattctgtgatgaccgcgctgatgacttccgctatgaataccgtcgaggtgagaccgagcgacatcatgagccgtttttgatgttccgctcctgtgttcgctatcgatccgtgcgcgtggtcatgtgccatatgcttaatctttcagcccgattaagaaacttattgaaattgtttctcaataccattttcattgctctcaaaacgcaagaaaccccagccataggccggggtttcctttatttctttttgcagtctaacgactgatcaatcgcctgtcaatacccaagcaaccaaaaagcggtaacgcagctggcactccgttaccgccagaaaacaataaaaaacgcggtaacgcatgtgacagcaaggcgcacggaatgaaggcgtacagaggtacgtcgaattccgtgtaacgcagctagcactccgttaccgcgtttttatcagaagccgaactgggcagcggtttccttcagcgtctctgcggaacgcgtaagggctgcaagctcgcggtcggacaccggggtgttgatggcggtgttgacgccggaacggttgaggagggtcggcacggacatgcagacgtcggagatgccgtggaagtcgtggagcatggagctcaccggcaggatgcggttggagtcgcgcatgacggcttcgatgatgtcaacgccggacatgccgatggcgtagttggttgcgcccttgccgttgatgatcttgtaggcggcgttcttgacgtcctggtgaatctgctcacgaacttcggcgtcgagcggagcgtgacccggcagcggggtccagtcgcacatcgggacgccaccgatggtggcggaggcccacagcggcacttcggagtcgccgtgttcgccagcaatgtaggcgtgcacgttcttgacgttgacgccggtctgctgggcgatcaggaagcgcagacgtgcggagtcaaggttggtaccggagccgaagacctggtttgccggcaggccggagatcttctgggcaacatgggttgcgatatcaaccgggttggtgatgagcatgtagatggcgttcggagcgaccttcacgaggccaggaatgatggccttgagaatgttgatggtggcaccgaccagttcgagacgggactgacccggcttctgacgcggacctgcggtgatgacgatcatgtcggcgtcgcggcagatttccggatcatcggagcctgcgatggacacggtcgggaagaagctggagccgtgctgcatgtcgagtacttcggcttcgacgcgttccttggcaatgtcttcgagcacgatctcacgtgcgacgccacgctgagcggcagcgaaagcgagagtggagccgactgcaccggcaccgatgatagcgagctttgtgggcttgattggtgaatccaccatgtgcttacctctcttataagaaagaatgtcccgctggtagcaggttttctcttagaatttcatctttactttatccacacagcatgacgtttcaaggcgttataacacgacttgcaaataatgaaaagtgatatgcatcacaaaagatgtgagcgctcacaaacgctgtgttcgttgcgttgcactgttttgcaaggttttcagccgattgactgttccacgatttgcgcagccaaatgatcgtccacttccgcttcgagcatcataccgtcgtcacggtattcgacgttgatcactttgccgtattcacgtacgcgcgacaccagcgaaccggcagtgtatggcagcaacgcctcgacatgcacgttcggcgtcggcagcatggattccacctgcatacgcagctcgtcgacgccttcgccggaaaacgccgatacgatgtacgcttccggcatcaacgcctcgatacgctcgcgtgtggcctcatccatacggtcggccttgttgaacacgataatcgtgggaatggtttcgacgccgtcgatgtcggaaagcacatcgtcgaccgcgtcgatttgcgagaacgggtccggatgcgatccgtccaccacatgcacgatcagatcggcttcggaaacctcctccagcgtggatttgaacgcttcaatcagctgcgtaggcagtcgacgcacgaacccgacggtatcgacgtacgcatattgacgtccatctttggcacgcgccctgcgcactgcggtgtccaatgtggcgaatagcgcgttctccaccaattccgctgatccggtcaaccgattcgtcaacgacgatttgcccgcgttcgtatatccaaccacagcaacggtcggcaatccgaaacgacggcgagcgccacgtttgacgtcacgcgcgggagccatctgttcgatctgtttgcggagtttggcgatgcggcttcggatcacacggcggtccatttcgattttcgtttcgccaggtcctcgcgagccgatgcccgcgtctcctgcggcgcggccacctgcctgtcgcgacagtgatccgccccagcctcgcagtcgtggcagcatgtactggagttgtgccagttccacttgggctttgccttcgcgtgaggtcgcatgttgggcgaaaatgtcgaggatcacggcagtgcgatccacgaccttcactttggtggcgtcttccaaggcgcggcgttggcttggcggcaggtcgtcgtccacaacgatggtgtcggcttcctcttgcgccacgattccggcgagttcgcgggctttaccggagccaacgtatgtagctgcgtccggcttgatacgatgctgcagcaggccgtcgcataccacggcgccggcggtttcggcaagcgcggcaagttctctcaatgattcttcggcctgtgcctgtgtggtttcacggctggaccacacgccgacgagcacaacgcgttcgaggcggacttttcggtattcgacttcggtgacgtcttgcatttcgccgagtccggacacatgcttcaacgcattgcgggattcgcgttcctgccattgttcgtcatgggattcgttgaaatggttctcgccgttggtatcaagcagcacctcggactggtcggcgagcacgcctgacacgtcgttggcgctcatgctatgctcgatgtcgttttcttggctcaatggcacctctcacggttaaactatggtgtctttattatcatcattctctagagacatgggtatcgggcattcgccacgtggatgagcgcggcttgcgtgatgccggaggcgagcgtttgcaaggagtgggtatggcacaggccgaacagtatttcgcggctgatccgcagtcgaaggatgtacgtaagaggctgcatgttgtgttgcgaggcaatgaggccgatgttgaggtttccaatggcgtgttttccggcaatcgcgtggatttgggaacgtccgtgctgcttcgtcaggctccggagcctcctgaggagggtacgttccttgatctgggttgcggttggggcccgattgcgttgacacttggttttgcttcgccgaaggctgatatttgggcgttggacgtgaatgaacgcgcgttggatctgacgcgtcgcaatgccgagctcaatggtgtgaggaacgttcatgcggtcaccgccgatgagatcccttcggatatgacgtttgatctgatttggtcgaatccgccgattcgtgttggcaaggatgtgctgcatgagttgttgatgacgtggctgccgcgtttgaatgcgggtggtaccgcctatttggtggtgcagaagaatctggggtcggattcgttgattccgtggcttgccacgcagcttggcgatggttatgaggtaagtaagtacgcgagttcgaagggcttccgcgttatcgaggttatgaaggcatgaaattcgaatatccttcccaactgccggtttccgctgcacgtagcgatattgccgaggcggtgaagtcgagccaagtcgtgattgtgtctggtcagacgggttccggtaagaccacgcagctgccgaagattctgttggaattgggccgtggatcgcatggcaggcagattgtgcacacgcagccgcgtaggctggccgctcgtaccgtggccgaacgtatcgccgcggagatgggcgtgcgtttgggcgacgaggtcggctatcaggtgcgtttcaccgatgagagctcaccgaagacccgtcttcgcgtggtgaccgacggtattctgttggcgcagattcaacgcgatccgaaactgatgcaatacgatacgatcgttatcgacgaggcgcacgaacgtagtctcaatattgactttctgctcggttatttgactgcgctattgccgaaacgacgtgacctgaaattggtaatcacgtcggcgacgattgattcggtgaagttccaggagcatttcgagcacgctttgcatacgaaagtgccggttatcgaggtttcgggacgaacctaccccgtgcaggtcgtgtatgagccgctgggcaccgctcccgcgttgatgcgttccgtacccggttttgaaactggcgcgatgccgggcgatgccgactatgaaacgttgtcggccgctcctgacgcgaaggattcccgcgagccgaacgttgacatgccgacggcggtggcgcgcgcctgtgccgagttggtgattcattcgagtcatgaccgtggaccgcgcgatattctcgtgttcgcctcgggcgagcgcgacattcatgattttgagaatgcgctgcgccatcattatggtccgcgtgccattgatatgcgtcgtcctgatgcgattgagatcgtgccgttgttcgcgcggttgtcctccaaggagcagcatcgcgtgtttgagccgcatgaccatcagcgtattgtgatcgctacgaatgtggccgaaacgtcgttgacggtgccgggcattcgttatgtggtcgaccctggcaccgctcgtatttcacgttattcgaagagcgcgaaagtgcaacggcttccgattgaaccgatcagtcaggcgagcgcgaaccaacgttcgggtcgttgcggccgtattgcagatggtattgcgattcgcttgtattctcgcgaggatttcgagacgcgcccggaattcacggagcctgagattctgcgcacgtcgttgggtgcggtcgtattgcatatgctgtcggtgggtgtggctcgtaccgcgcaggatgttacggatttcggcttcatcgatccgcctgatatgaaggcggtgtctgatggtttcaatgagttgaccgagttgaaggccgtggcgcgcaagcatggcgaggttgtgctgacgcacacgggtcgcatgcttgcacgcattccgatcgacgtgcgtttgggccgtatgatcatcgaggctgcgaagtcgaccacgccgaacacgttggccgcagtgctggtggtggtcgcgttcctaagtttgcaggatccccgcgaacgtccggatgagaatcgtgaggaggccgaccgcattcataaccggtatgccgatccgtccagtgattttctgaccgcgttgaacttgtgggatcgcgtgttccaagctgatggcgagccgagcaattccgcgcttcgtaggatttgcaagactgagtatttgagttggctgcgcatccgtcagtggaaggatctggtcacgcagttgcgtgagatgtgcaaggaattcaagttcaaggttggcgatccgattccggcttcgcgtccgccgcttgagattcgtcagcttccgtcgaatcagcaggctgcgcattcgttgtgttgttcgtgggatgcgcagggtattcatacgtcgatgctttcgggcttgttgtcgatgatgggcatgcagatcgtgcgtgaaccgaaggcatctgatttcgctggcttgaagggcgctgcccgtgcgcgtgccatgaagcgtgcgcagaagatggcgaagaatgattatcagggtgcgcgtggcacgcatttcgcattgttcccggcttccgcggtcgccaagtcgacaccgcaatgggtgatgagcacggagttggtggaaacgagccgcttgtgggcgcgatattccgcccagatcgatcccgcttgggctgaaccgttggcgggttcgttgacgcgaaccacgtatgcggatccgcattggtcaggctcgcgtggctccgcggtggcgagcgcgaaggtactgttgtatggtttgccgatagtgcaggatcgtacggtgcagtggggtcgtatcaatccgctggaggcccgtgattttctgattcgtcagggtttggtcgagggcgatattcagcagcggttctcgtatgacgatttcattgcgaagaatcgcgatgtgctggaggacgccgccgacgatgcgagtcgcacacgtcagatggcgcaggcggtcagtgatgaggatctgttcgatttttataattcggtgattcccaatactgtcacgtcggttgcggatcttgcgaaatggtggaagtcaaagcatgatgagcagccggatttgttggattttgatccggagaaggtggagcgtcttgctgatgccgagtcagtgtcgttggctgattatccggatcattggcatacgttgggtacggacggctcccctatcgatttgcggttgagttatgtgtatgatccgcatgatccaaacgatggcgtgaccgtgcatgtgccgttgaaggtgttgtctcgtttgacaccggaacagttcacgtggaatgttcccggattgttggatgagttgattgtcggcatgatcaagtcgttgccgaagacgttgcgcgtgcagtttgttcccgctcctgatacggctcgtaagattcgtgcgtggattgatgagaggtatccggatctgcctggttccggtaaccagcagaagccgaatcttgctcctaccaatgcggagggtgtggccgcgtggccggatttgcctcatacgttcacgcaggcggcaatcagcattgttggcgcgcagattcaccctgaagtgttgactggtgaattgtggagcaagctcatgccgtatttgcgcgtgacgttctctgtggagcagcagttgcctccgagtcgcaagagtcagcatggcaggcgtcatgcgcggggccctgtcaaggtgcttggctcgggcaaatcgttggtggagttgcagcgcaagtttgcggagcaagccgaggcttccgcacggcagatggtgaagaagcaggcggaaaacgctggaaatcagggcaagcttgtggagcaggccaatctgctgcataaggctggtgccactaccgaagctcgttccaccatgctgtggcgcggtgcacttgatgttttgcgtatgccgagcgagcgtatttcgtcgcgttggttgggtgcggaggcgttgatgttggcgtccgcaccatatcagtccacgaaggatcttactgaggatctgcagttggctgcggtgaagcgtttgctgccgaatgttgacgaattgccggatgatgaggcgttggcgaatgcggtgcttgatgtacgtgaagtgttcgaagataccgtgtatgcggttgcgcatgatgtgatcgctattttgaagcggtatgcggaggttgataaagccgtgtcaggcaaggccgatctgccgatgttgagcgttttgcagtcgattcgtgagcatatcgccacgctggtgtatccgggattcattggtaagactcctccggatgcgttggcgccgattgaacggtatctgcatgctgacgtgcttcgtttaggtaaggcgaagaacgacaagaatcgtgatgtgcgttgggcttgggaggctgatgaggccaagcagttggccgacaaggccatggcgaaggccgaacgtgagcctgcaggtccgcgtcatgaggcgttgatgaagcaggcggtcaccgcacgttggatgcttgaggaattctacgtatcattgtgggcgcaggaactcggcacgccgaagccgatcagcctgcagcgcatcaagaaagcgttgagctaacgcatcatcatctttcgcattccattgccgtcgatacttgcggttttccagtatcgacggcaatagaacctaatgaaatcatcctcaatcgaaccatggttagcggtgtctagcgttgcttgaagaaacggaacaactgcgtttcatgtatcgtcataccgacgagcacgcttgataccatcactccagcgaatatcgcacatggcgcgcgcatcgcacccaaccatacggtcattgaatcggcgatgctcatgcgaacgcaatacgcacccaacagcgcggccgaagaggcacacgccaagccgctccaaatcaacgtttccacagcgatttccagcaattgcgcacctttggactgccctgaatgcaatgcgccagcatattccaatctacgacgacgcacgccgaacgcgccgaacatcagccccacagccaatcccagccacggcatccaacgagtcatacgctgcccgtacgaagcttgcgcatcgtaatgcgaatcgaaactcttattcacctgcgtcacgccggcattggatgacgaacccgacgcaaccagcgtggaaaacaacacatcctccgtctgcccgctttgcggccactgtctgacccaacattcgtcgaacgtgccattcgacgcagatacgggcacaaggagagcgtaggcgaatcgcgtgtcacgaccatcgttcggccaataaaacacgcctgcgacgctcatcgttccctgttcggtctgcattacgctgcctttggtgagaccaaaatccttggccacgtcggtagatacccacacgccggacacatcggacttcgcgctcccggcgatcatcctgatcatgccgggcgtcacttcatacgacgatatatccttgccgggcgtggcaagcggcacaatctgttgaccggcacgcatcgcaccggccaaggtgcccatcacaccgccgccagcgtcggcgagcctgtcacatgcggctccgtccaccgttcccccaacgatggcgccaacgtcggcataggcgttgatgcgttgcaccgcctcggtttcgagccccaccacattggcggcctcatatccgccgagcaatgtagacgcgaacaataccgctgcaaacataagcagcgcatgactcactcccgcgccaatattgcgcaacgcttcggaaagcaccgatcgtaatcgcataatcgcctactcgcaggtgagattgttaagtccgctgccgatttccacattggagatcgaagcgatgtcttcgctgtcggcttgcacgaggctcacgccaagttcgcctcccacgatcgacactttcacgggagtgctgccatgattgttggatgcgggcacgatgcagccggttgaaccgttgatgccgaataccgcgccggcgggaacgcgcagcactcgcatccgttcgctcaaggccaaagtggcgtcaaatcccgcttttctggattccacgtccacggattggtaactgtcgttcgcttcgacttgttgcaggaacccggcatccgtgatttcagtggtattggctggcaatgttcccgtaatgccgaatatcgtcaacgaacgttcctgcgcggatgcagtgccgtttttgatggtgagtttcgtcaatgatccggggattttgccgattgcggtgccgcccgtcaccatggatccggcggttgcgttccactcggcaactgcgacttcgtgttcgggaatccacaatgtgtcggccaatgacaacgatccatccgacgtattaccgttgtcggccatcaactgcttccacccgtccgatgtggcccacccgtaggtatccgatccgggaacgctgttgtagccaagtaagctgagttcattattcagggcgagcacatcgccgccgatgtctccggtcttcaaatcgcgatacaagggggttgcggtgttcaacgccactaccgtgcgatcgttcacctggtaggcgcctttgcctgagatcaggccgtcgccggaccagtccgcggtgaccatgccactcgcattgccggaaagatcacggtcactggaaatggtgggcaccacagtaacctgctgcatgcccgtatattcttgcacactggcgggagccacggtcttctccaccgccgagctcagtaatgtcggcgtgcggtcaggcagccacaatgcgcaggatccgaccgcaatacaagctgccgtgacagccgccagcagagtccaagtcacagcagtgcacttcgaacgcttaccgcccgtcctttgcctcattccgaatcgtcgcgtcatactcacatatacccattcactcacagccaacaagcaccatcagcgaacacatcaccataattcccctggaatcacttaccttctcaccacaactgttccgtatcgtcggtcgcatatcccacgttgtagccgttcgacacaaggcaactgcgcacttgcaggttctgcatgtcaaacgaagtattgccatccgttccggaaaactccttgttgaaccggcttacggtatagtccttcggcacgagcgagtctctatgcaaacaatcgaccacggcttgcgcttgatcggcatacagattcggattgcccacgataatgccgtacacatcctgcacatctgcaacatactcatcgccgcattccgtggaatcatcggaatatcgggattcctgaatggtcgtcccctgtttgtgtccagcttcggcatagagtccgctcggatatttgatgagtttgatttccttatatcctttgtcgatcatgcactgccggtaatcagaccaggctttctcataatccgacgtcgaaatctcacccgtacttttggctttgtccaatatcgttttctgcgattcagcgatattaccttgcgattcccgctgttcaatccattcactcaacgacgccgccaatttctgtccgcccgccgacccattttcggatgatgattccgatgtggcagaatcagaagatgcgcctgtggcatccccattaattgagcatcccgccaaaagcattgacaatgcgacggcaagaacgcaagtcttgcaaaatgacatccaagaagtcaccatcttcacccccgtactaatgtatcacaacgagtgtagcaccgcatgataatgtgcatagcaggcggcatttccgaaaaacttacttgcatatacgcaaatgaggtagggtggatgttgcgtggttgcgattaggggactacaaatgattggcaagggtgcatcggtaaggtgattgcctcgtgaaaggttggctatgcgcgttgcggttgaggggttggctcatcgatttgagggaaccgatctgctgttcgagaatttgagtttcgtggccgaacctggtgtgaccattgcgatatgcggtccgtcgggatgcggcaagtcaacattgctgtcgattcttgcaggatgggagcagccttacgctggcacggtgacgcgagaaggtgtggatcgtgttggatggatgtttcagaatccgtatggtgttgcggaacgcacagcgctcgaccatgtggtgtttccactgctcgccaagggaatgagccgccgcgaagcggaaccaaaggctttggaagcgatggaactgttcgatctggaatatgcggcagacaggcgtttctgcgctttgtccggaggcgaggcgcagcgtcttatgctcgcgcgtgcggtatgttccaggccgaacatgctgctggtcgacgagccgaccgcccagttggatacgcgtacatcacattccgtaagccatgtgctcggcaatctggccggtcaaggcatgatcgtgctggtggcaacccatgatccggacacgcgggacgcctgcgatcgcgtaatcgatctagccgactacgctccgcaagtcggcgggtccactgcccagcccgccaacatcgcagtccactaatcgctttccgcaatctcaacgaattacagataaaacttctataactttgccgctttcagaaaccgctcgttcaaacccgaccaaatgccatcaggcttgctgtttggcgtagaaatcgcgttctcgagctgcgaacgggcgcagcagggttgtggtgccaaccgcacacagcaggaagatcgcgcccacagggccaagccacatcagtcccaaatgggcgttgaccagtccaccaaccgcggagccgaccgcgatgccgatgttgaacgacatggaattgagcgatgcggccagattcagcgatcccggatgcgactgagaggcaacatccatatatagcacctgcgaggcggaattctgcagatacatgaacatgccaagcaccaccagcagcaacgcaccatacaccggcacccaatgcgttacgatcagcgatgccatgagcacggcgtgcgcgcagtagatcggacgaatatgcgtcagtggttccactcccccgccacggtcggcaagcttgccgccatacaggttgctccacaggcaggccgcgccgaaaatcaccaggccgacgcttaaatactgttcgggaacatgcacttcgtctcgcatgatcggcgtcagatacgtatagaacacgtaagttgccgccgcgccaaacaccacggcaagcacgcccaactgaatacgacggtcgaaaaacaggcggaactgcggcagaaaaccaatcttcacaatacggctgttgcgcggcaacaccatcaccatgagcacaataagcaccactgtgagcacgttcaccaaatggaacgcccaacgccagccgaacgtgttcgcaacccacgtgccaaccggcacacccaccacggatgcgatggagaagccggaaaacacccatgcgatgaacttcgtgcggtactgttcagttgttacatcgggcgcgtacgtcatggcaatggccaccagcgtgccggacaccagcgcgatgagaattcgcgccaccacgagcacgccataattcgacgcgaacgcgcacagcacgttgccgataaggaacaccccaaccagcgtcagatgcgtggcaaaacgcggaaaacgagccgacagcgccgatccgagcggcgtgaccggcgcatacacgaacgcgaacagcgacacaagattgccgaccgtcacctccgacaccttcaagccagccgcgatatccggcagaacgccaacgacaatgaactcgctcatgcccagcatgaaactcagcgagatcagcacaatcacaggcagattgaaaaaccgttccttcgccacatcactcttcgccatacacttctcctccatagcccctcgaactccccacgcctcgccaaactcgcattgtcattaaagcttctcacgtcaatcgattgacgaatcaatcgtcaaacaaacgataagccaaacgcgatacaatgacgcgcgatgacacgcaaaacaaccaccacagcaaaaaacaaccgcaaacccaagaaaaacaagcagccaagcctcaccaaactccgtaacgcctggaaaaaagcaaacaccccaaaacgcatcctcatagtcggcgaaacactgatagccagtatcgtcgcgctcgcgttgatcgttggattggtgcgattcgtcggttggcgtgtgcaagtggatgaagcggtcgcatcgcaggaacaattgcagacgcaatacgatttcaatccgggcaacatcatttcagatggtctgttcttcaacgggaacgcgttgagcgagcagcaggtgaacgccatcatcgaaaaacagggtgccgcatgcagcggcgagaaatgcttgaaatccatgacgtttagcaccgaatcgcaacccgccaacgaatactgcgaagcatatgagggagagccgaacgaaagcgccgcggcgatcatctacaagtcgggaaaggcgtgcgacatcagtcaaaaagtgctgctcaccgtgctgcaaaaggagcagcatctgcttaccgccaccgatccaagcgacttccaattcaagtcggccatgggattgagctgcccggacgacgcgaactgtgacccggaatatgcaggttttttcaaacaggtgtatggcgcggcgaaacgctaccagtattacgtgcaacatgaggatcgctatggataccatgcgggcacgctcaactatattcaatacaatccggacgccagctgcggtggcagcaacgtgtacatcgaaaacaaggcgactgcactgctgtacatttacacgccttatcagccgaatgcagccgcattggatgcgggagtcggcgaaggcgacgcctgttcgacttacggcaatcgtaatttcgcaatcatctacaattcgatgttcggctctcctcgaggctgatttttcgatacaattgctcatggaagggactgaccagaaggagcctttcatgggcctactcaacaacaacgactatatcgacccattcaagggttccgattacatcgatcccagcagcaacgccgaacgcctgtctaatcaggtgaaccgtgaccatgcacggcgtgaatcctatgtccagcggcgatatgtgaaacccgcgcagagcgatcaggcatcgcgcgacaggcaggccccacaaaacacccgatccaagcaagacggtagatctcaacaggcgcaaggcgatcagtccacacgaggagacacgctccaaaccatgttgaacgactggtccacgcaaaccatgcggtatgcccagtccatgcagcaaagcttgcaacaggcgttgcggcaaaatcagcaaaacccgcagaacccgcaaggacgcccatcgcagccctataatccgccgcgcatacaaacggaacgagccacacgcgagttccaatccacttccgacaagaagcaacgccgccataaaaacggcttcgtcaccgttttggagatcgttatcatcatcgctgtaatagcgtcgattggcggaatgctttctgacagcatgtcaaacatcatctccgatttcgatggatccacaagccagttcgaggagctgtccacacaggaaaccgtcagcgaagacgttggaaagctctactccaccggaggaaaagcattggaagtgaacatcgaaggcgtgcagacaggtccggaggatttgaacggcgacgccacgctcacggttttgctcacctgcacgaacatcggcaagaaaacgatgtatcctcatgccgtcgcagatctgatggtcatgcaaaacggcatcgagcttgcccctgcattcacttccaacgaggattccgaccgcacggagttctccggcgccgaaatgaaaccgaagaaaagctcgcagaccaccagcagtttcgttcttacggacaccaattcaccagttgtggttcagctgatgaattattcgcagcataatgttgttcgcgccgcgttttcctttgacgaagtcgacatagaaggatccttgaaacatattgattatgcggccgtccctcagcccgagcaagtggacgcttcgaatttcgacgaagacggatccgtaaccgattatgacgaaagcaccctgcatttccgcgtagactccattgagaagacaagcccctcatatgccgatcatgacatagcgttcgcacgcatatcctggtatgtcgaaaatggaagcaaataccgggctttcctgaactatatggatgtttccgcgacccaagacggcactgagttgcatagcacgtatcttgacgatgatagctattccacaacacgcaaggtcactcccggcgtgaaaatgacgacgacagtcgcttttgaaacgcaaagcaactcgcctgtgacattcatattttctgactatggtgatgagattcttcgcaaaaccgttaatttacggtcaattgagtcattggaactttaatccgatacttgcagaaacatcaaaagaagattcaaataatcattcggaaagcaaaagaccgttgttgcaatcagttttctcatgattgcaacaacggtctttgatgaaacgattgcggttcgcttacagcttcggcaggtacttcttcagttcgaaaggagtgacctgcttgcggtattcctcccattcctgacgcttgttgcgcaggaagtattcgaaggcatgctcgccgagcactccggccacgaagtcggacttctccataaccttcaacgcctcgtcaagagactccggcaatggctggatgcccatggcctgacgttccgcatcggtaagctcccacacgtcgtcgctggtcggctcgcccaactgcatctgcttgtcgatgccgtcaaggcctgctgccaagagcaccgaatatgcgaggtatgggttggcgaccgggtcgagcgcacggaattccatgcgggcggaattgcccttgcctggcttgtactgcggaatgcgcagcagcgcggaacggttgttgtggccccagcagatgtagctcggagcctcgttgccgccccacaggcgcttgtaggagttgacgtactggtcagtgaccgcgcagatttcagccgcgtggtacagaatgccggccgcgaactggcgtgcggtgacggacatgttgaattcctggcccgcctcgtagaacgcgttggcgtcgccttcgaacaggctcaagtgggtatgcatgccggaacctggagcgtcggaaagcggcttcggcatgaagctggcgtgaatgccgcgctccagcgaaatctctttgacgacggtacggaaggtcatgatgttgtcggccgtggtgagcgcgtccgcataacgcagatcgatctcgttctggcctggacccgcctcatgatgcgagtattccaccgaaatgcccatctgttcgagcatgttgacggtggcgcggcggaagtccatgcctgggctgcgcggcacatggtcgaaatagccgccctcatcgattggggttggcgtctgggaccaatcatcctgtctttcgaacagatagaattcgatttccggatgcacgtagaaggtgaagcctttttccttggctttcgacagagcctgcttcagcacatgacgcggatcgcccaacgacggctcgccatcaggggtaagcacgtcgcagaacatgcgcgcggtgccttgcgggcctccacgccacggcagaatctggaatgtcgacgggtcgggcttgacgatcatatcgtcttcggacacacgggtgaggccttccactgcggaaccgtcgaatccgagcccttcctcgaacgcagcttccaattcagccggtgcgatagccacggacttcagcgttcccaacacatccgtgaaccacaaacgaatgaagcgcacgtcgcgttcttcgactgtgcgcaaagcaaactcttgctgtttatccatagtgccccatcgttccatgcgcatgttacgaaagtcgttaacacgcgccgaatatgacgagaccgtccacgttgtggacggccgtatcgtcatgggtttgcgaacaatgctcaacgtgcgacttcaagcgcctcttccaaagtgaaggcgcgcgcatacagcgatttgccgagaatcgcggaatccacgcccagatcggcaagttccttgatggcgcgcaggtcatcgagcttggaaatgccaccggacgcggtgaccttcgcatcagtgcgttccgcaacctcacgcagcagatcgatgttcggaccgctcatcatgccgtcgcgagccacgtcggtgaccacgtaacgagagcagccaacggaatccaggaacgccatggtttcgaacagatcgccgccttccttcacccatccgcgggctgcgagggtgtggccgcgcacgtcaaggccaacggccacgcgatcgccgtacttcttgatgacggaagcggtccaatccggattctcaagcgctgccgtgccaatgttcacacgggcggcgcctgcttccaaagctgcgtcgagggatgcgtcgtcgcgcacgccaccggacatttcgatattgaccttgtcgccaagctccttgacgatggcgcgcagctggtcacggttgttgcccgtgccgaatgccgcgtcaaggtcgaccagatgaatccattccgcaccggactcgacccacgtgcgggcagcctccagcggcgaaccgtaatcggtttccgaaccggattcgccttggcgcaagcgaacggccttgccatcacgaacatcgactgcgggaagcaatgtcaaagacatgtctgtacctctctgtgatcaaccgaccgccactaaacggcaatcgcaaataaatgtaccaagtggtcgttttaaaagcgtatatgtcaaagcatcgtcgaaacaatcatcggcgatctcgcaccatcagaacgtcgcaatccaattgcgcagcagctgcgagcccgcttcggcggatttttcagggtggaactgcgtggcgaacagcggaccacgctcgtaggccgccacgaaacggctacgtccgtacgtgcaccaggtcacgcgctcctcggcgtcaccgaaatcaagctggtcgccggacgtgtcggcgggagcggcactcatcgcggcgaaggaatgtacgaaatagaaacgttcaccttccacacccttcatgagcacggaaccttccggcgcctcgacggtgtcccatcccatgtgaggcaccacatcggcgtcaagcagttccacgtcgcccttgatcaggccaaggcccggagtgccggtgccgtgttccataccgcgttcgaacatgatctgctcgcccacgcacacgccgagcaccggtcgcccggcacgcagacgatccttgatcacggtgtctccgcccaccgacttgagtccttccatgcatgcgccgaaagcgcccacgccgggcactaccagaccgttggcttccaaggcctgccgatggtcggaagtgagggtcacgtcaaggtcgagatcagccagtgcacgaaccatggaacgcacgttgccgaaaccataatcgaaaaccaccacggaagtcatgggcgttctccttcttgtgtcattcgttgttctgtggcgcgagtcgtcttgtgtcgcataacgcatgttcggcaggatgactcgcgtttaccgtcgttaactgatgcttgatgtgccgcgtccgaaccgcgtatgctcggcgataatgctcatcgccgcatcccgatcaaggtcagcggaatcgaaaatggtcatatccgcctgttccagcgcgttcatatcggtgatgcccagcatgagatcctcaacgaacggcgcggtggaggtgaatagcaccggcggagcgaaggttttgcccgctctgccttccacgtacatcgtcgcttcgagcttgtccgcacggttgacggcaagaatcgcgggcatgccggcaacgacgatcgtcatgtctttgaccgccgcttccggaccgtctccgtcgagattgcgcagcaccgcgacagcaccttgcgccgatccgatgcattgcgcggaaatgtcggacaattcacagaatgccgacagcaatcgtggcgaggtcagtctggtgatgatcaccgccactttcgcgcgattgccaagcagtccctgcagctcgtcttcgaatttcaacgaatcctcagccgcgttgagcatatcgtcgacttccgaggattcggaggattcggaggattccgcgttatcggaagcttcggaggaatcgaaagcttcagatggcggattgtccgcccgctcatgcttggacgcttcggcatccttgaattcctgctcgaagccggccatggccgcttccagttcctcttcgctgaaatgcatgccgtcggcgttgaggtcaccgaaatcgtttgatccatcgaatccttggaaatcgtcgaaatcgttatttcgatcgtcgctcatcacagagcgcccttcgtgctcggaataccgtcgacacgcggatccgactcgatggcgaaacgaagcgcacgtgccaaggccttgaactcggcttcggcgatgtggtgcggatcacggccggagatcacctgcagatgcaggcagattccggcatgcatggcgatggattccataacgtgacgcacgagggagccggtgaaatggccgccgatcatgcagtattcgaagccttccggctcgccggtgcacacgcagtacggacgcccggaaatatcgaccacggccttggcaagcgcctcgtccaacggcacggtcgcatcagcgaagcgacggatgccgcgcttgttccccagcgcctgcttcaacgcctcaccgaacacgatggcgatgtcttcgacggtatggtgcgcgtcgatgtcggtgtcacccgtggccttgatggtcaggtcaatcagcgaatgcttgccgagcgccgtcatcatatggttgtagaacggcaccgacgtgtcgatgtcagttttgccggtgccgtcgagattcaggctcagttcgaccttggattcgctggtttcacgaacgatggttgcggtacgcgccatgttgcgactccttttggaaaatgttcggtcctgttgtgttggttcagtcccgtatgtgctcagtcttgttccacaatacgcaacacttcgaccaaggcttcacggaaacgcgccatttcctcgtcggtgcccatgcatacgcgcatccagccgtcagggccgacggtgcggatgagcacaccacgcttgagcagttcgtcgaagatgcggtcgcgatcgtcgaaatgaccgccgaacagaatgaagttggactgcgtctcggccacttcgagcggctggcccttgtaggtttgttccttgagccatgccgcggtctgattgcgggtgtcacgcaggtgcgccacacggctgagctgttcgtcggtatgttcgaacgcggcaagcgcggctgcctgggtgacggccgacaggtggtacggcatacgcacgatgcgcacacagtcgataatgcccttgttggcggccagatagccgactcgcgcgcctgcgaaggcgaacgccttgctcatggttcggctcacggcgagattctcatactcgccgatgagttcgagcgcggtgggcgtgcccggatcacggaattcgatgtaggcttcgtccaccacgaccaccggatgcacgccttcggcggcaccggccacttcagcggtttcggcggcgccgagcacgcgcttgagatcatccatcttcagcggtgtgccggtcggattgttcgggctggtgagcacgatcatggccggcttgacgtcttcgatggccttgatggtggcgtcgacgttcagcgagaaatcctcgttgcggtgcgcaagcttccatgtggtgaacgtgtcgcgggcgtattccggatacatcgaatacgtcggatcgcagccgagcgcaatgcgtcctggaccgccgaaagcttggaacagctgcagcatgatctcgttggatccgttggcaccccacaactggtcgacttccagcttgacgccggactcgcgttcgagatagtcgcagaatgcctgacgcaacgcgatatgctcacgatccgggtaacggttgagcgtcagagcgatttccttgactcgctgcgcgatggtttcgaccactgccggttccggcgcatacggattctcgttgacgttgaggcataccggcacgtccaattgcggcgcaccgtacggctcctcaccgatcagatcgttgcgcagcggaagatatgccggaatggcgttgctggaagtctcactcatcgaaggcctgcctgctcttcctgttccttgatggtttccttgttgtacggatcgtcgatgaaacggctcagcacgctttcaccgtgtgccggcagatcttcggaaacggcgaaggcgttcacacgagcagcgagggtcttcaatccctgctcgtcgtattcgatgacttcgaccggcttcatgaaggtgtgcacgcccagaccggaggcgaagcgtgcagtgccggaagtcggcagcacgtggttggagccggacatgtagtcgcccagcggcaccggagagtacgggccacggaagatggcaccggcgttgcgaatcttggcgatcacggcatccgggtcggcggtctggacctcaaggtgttcggcggcatacgcattggccgcgtcaatggactgctcgatgccatcggtgaggatgatgccggactggcgtccgcgtagcgacgtgttcacacgctcggagtgctcggtgcgcggcacacggtacttgaggttctcctgcacctgttcggcaatctcttcgctgtcggtgatgagcacggaaccggcgagttcgtcatgctcggcctgaccgatcagatcggcggccagccagctcgggttggcacccttgtctgcgatgatggcgatttcggtcggtcctgccacggcgtcgatgccgacgatgccggacaccatgcgcttggcggtagcgacgaagatgttacccggaccggtgatcttgtcgaccggatcgcacaggatttcgccgtcctgcggttcggatcccttggcgccgtaagcgaacatggccacggcctgagcgccgccgaccgcatacacttcgtcaacgccgagaatggcgcaggtggcgagaatggtcttgtcaggcagaccgtcggcattgttacggctcggcggggttgcgatggcgagggattccacgccggcggcctgtgccgggaccacgttcatgatgacggagctcgggtagacggccttgccacccggcacatacaggccgacacgctgcaccggaatccaacgctcggaaacgcgcgcgccttcagccagatcggtgtggaacggcgccggcacctgggaagcggacacggcgcgggagcggcgcacggattcttcgatggcggcacgcacttccggatccaactcgtcgacggcggtcttcatggcttccaccggcacgcgcaggttctccggacgaatatggtcgaatttctccgcgaagtcacgcagggccgcagcaccgcgggccttcacatcgtcaaggatgggctgcacgagatcggtggcctcgttggtgcccatctcggcgcgaggcatagcctccagcatttcagctcgggtcagcttcttgccacgcaggtcaatgattcgcatatagttttcttcgctcataacgccccatggtaacaacgtgatgtcacgagaacgcccgcgcgtctcaagttcagccgcatagtgagatattcggctgaactttcggcatcatccccacgaccggtcatcccaaaggcagagaactgggaccgaaaaggattttgatttcggcgaacagactcgtgtcgcggcgtacgcggaaacggtcgccgaacgtcagtaccttggcgttgcccttatcgtccatcaaggcgagcttcacttcgcagggtccaggatgatttgaaagaatctgccccaactgctgcacatgcgattggtcaagcgctattggcggcagcataatcgtcaccggcttctcatcctgcgcttccaacgtcggcacgttgaattccgtggcacgcatgcttaccgtctcatcgcgtttctcaacctgtccgcgaatctgcaccaccgtgtcgaccgccagttcgggagcggcggtctcatacactttgccgaagaacatgcactggatggagctttccaaatcctcgatggtcacaatcgcccaaggattgcccttcttcgacatacgacggtccacgttcgtgatcaaacccgccaccgtcacctgctggccgtcaggcatattcgccgcgcgatcgatcagatgcgcgatcgacatttcacgcaacgacaccagaatcgactgcataccgctcaacggatggtcggacacatacaagccaagcatttcacgttcgaaattcagcttggttttcttatcccactcctccacatcgggcacattcaccatggcatcgcccatgcccgcatcgtcttcgccggcatcttccaaatcggagaacaaatcaaactggccttcggcctgcttgcgtttcaaaccgaccaccgaattaatcgcagcctcatgaatcgtaaacaaggcacgacggttcggatcgatcgaatcaaacgcaccggccttaatcaacgattcaaccaatcgacgattcaacgcctccatcggcacacgcctgatgaaatcagggaaattcacatacttgccatgatcgttctcacgttccttgacaatcgcatcaaccgcagccttgccaacgttacggatggcgccaagaccgaaacgcaccacatcgccgacagcggaatactcgtacaccgactcgttcacgtcaggagacaacacctggatgcccatgcgacgagcctcgcccaaatacaacgcggtcttgtctttgttcgtactcgcaccctgcagcaacgcggccatgaattccaccggataatgcgttttcagatatgcagtccaatatgagatcaaaccgtatgcggccgaatgcgccttgttgaacgcatagcccgaaaacggcacaagaatatcccacacggcctgcgccgcctcctgggaatacccatgctccttcatgcccgcgaagaacggcaccttctccttggccagcacctcgggcttcttcttgcccattgctcgacgcaacacgtctgccttgcccaacgaataacccgccagaatacgcgcggccgactgcacctgctcctgatacacgatcagaccatacgtttcgtcaagcacttccttcaacggctcggccacttcaggatgaatcggcgtgatcttctgcaaaccattcttacgcttcgcataattcgtatgcgaatccatatccatcggaccaggacgatacaacgcgatcaatgcggaaatatcgttgaagttattcggcttcaacgttttcagcaacgaacgcataccatcagaatccaactggaacacgccaagcgtgtcacctcgcgacaacagatcgtacgtggcacgatcgtccaatggaatcttcgtatggtcgatacgcgtcttgccattcgcctcgatattgttcaacgtatcgcgaataaccgtcaagttggaaagaccaaggaagtccatcttgactaaaccaagcgtttcacacgtatgatactccaacgtggtcgtaaccgtaccatcggtacgttccagcagcggcgacgtattcgaaatcggctcgctacccatgatcgtggcgcacgcatgcacaccggtctgacggatcaagccttcgatacccatcgcctcatccgtgacgcgcttcacatccggatcggaatcataaagctcacggaattcgcgggcctccgcataacgcttcgaactcggctcgaaaatatcatgcagcggaatatccttgccacccgtctgcgccggcggcaacgccttggtgatgcgctcgcccatggagaattcgtagcccatgattcgtgcggagtccttcagcgcctgtttggttttgatggtgccgtagatcacgcattgcgcgaccttgtctcgcccgtacttgtctccgacatagtcaagcacgcgaccgcggccgtccggatcgaaatcgacgtcgatatcaggcagcgacacacgttccgggttaaggaatcgttcgaagatcaagccgtgcttgattggatcgagttcggtgatgcccatggcatacgccaccatggcgcctgccgcggagccacggccaggcccgaccatcacaccatgcgatttggcccagttgatgtagtcggccaccacaaggaagtatccgcagaactgcatctgacagatcacaccgcattcgtaatcggcctgcttgagcacttcgatcggcggatgcccgtcataacgccgttccaagccttcctcgacttttttcaggaacagcgacgtctcatcccaaccttccgggcagtcgaattggggcatgaacgcgccatcttcatgatcgtcgaacatgacattgcagcgttcggcgatttccaacgtattgtcgcatgcttcgggaatgtctttgaacagctcacgcatttcttcggcggatttcagatagtagccggtgccgtcaaatttgaatcgtcccggctcgtcaagcgtggatcccgaattgatgcacagcatggcatcctgagagccggcgtcttcggcgcgcacgtaatgggaatcgttggtggcgagcagcggcgcgttcagttttttcgcaatgtccagcagaccgtcggtcacctgtttttcgattttcagaccgtggtccatgaattcgatatagaaattgtcacgtccgaaaatatcctgcaattcgcctgccgcacgtaatgcctcgtcgaattggccgagcagcagtcgcgtttggatgatgcccgacgggcatccggaagatgcgataatgcctttcgaatatttggcaaggatttccttatccattcgggggtatcgcatgacacgtccctcgagattcgcgtcagtggacgccttcatcagattgacaaggccctcatcggtttccgcccacatcgtaaggtgggtgatcaggccaccgccggatacgtcgttggggttgcgcctgcgatgttgcggatcgatatcgggattccagttggtatcccagctgacgcgggtttgatcttggcgtgcggtttccggcgtcacatacgcttcaatgccgataatcggtttgacgccttccttgaccgcagtgctccacatttcgtatgcgccatgcatgttgccgtgatcggtgatgccgacggccggcatgttgagttctttggcgcgcctgaccagatccggaatctttgacgccccgtcaagcagtgaataatgcgtgtgattatgcagttgcacgaaatttccggaagtagccatacgttccaatctaccggtgattggtgacgtgcgatcacacttcaggcttgtcttgtgtgtcgtgcctgccacgcatcacgtcgagcgcatgctgcaaatcagctggataatgcgatttcaccgtggtccacacatgggttcgcggatggcggaattcaagttgcttggcgtgcagccactgccgttccaatcccaatgcctcacccaactgcggattggcaccgtacatggcgtctcccgcaagcggatgcccgatggacgagaaatgcacgcggatctgatgggttcgaccggtttccagattcacggaaaccaacgtcgcctcaccgaaacgttccatcacatcccaatgggtgatggcttctttgccggcgggcgtaacgcaaaaacgaaaatcggagactttggcacgtccgatcggcgcttcgatcgtggccttgttttccttgagattgccttgcacgagcgcatgataggttttgacgacttcatgttcggcgaactgcctgcgcatttccacgtaggcgaggtcagatttgcacacgagcatcaatccggatgtgcccacgtcgaggcgggatacgataccctgacgtcccgcggcgccgtaagaggtgatgtgcactcccctgtcaagcagactgccgagcaccgtcggaccggtccaaccgacggaagcgtgagcagccacacccactggcttgtcgaccactatgacgtcatcgtcttcgtagaccactgccatatctcgtgcgatcggttcaggctcggtccgttcctcgacaatatcgaattcgacggtttcgcctgattgcagagtcgatgatttggaaatgtcacgaccaagcacgcgcgcctgtccactttcgatgagttccgcggccttggctcgggagataccaagcatcttggccacggccacatcgaatcgtttgccgacaagcgcgtcgggtgcgggaacaagacggctcatgcgttctggtctccggtcgtctgtttcgtctgttctgcggcctgttcgtcaagatccttctggctgaagggctctccgacaaacagcagtacgacggcggcgacgcccgccaccatcaggaaaatatccgcaacattgccgaccgaccatccgtaattgaggaaatcgacgaccttgccattaaggaaaccttcggcatacatcacacgatcgatgagattgcccaatgctcctgcgaaagcaagagcgaacaccaccgtccatttcatggaaatggtacggattgccagtacggccaacgccacgcacgccacgatggcaagcaacgaaatcaaccaggtcatgttggatcccatgcccaaggacgcacccggattatgcaccagcgtgaatgagaggatgcccggaatcacacgtaccgtctgcccgtcggcaagcgccgactgcgcccatgccttgctgatctggtcgagtaccagtgccacaacggcgatacacgcaaagacggccacgcgggtgcgcagccgtctttgatcatttgtcatgatgtcagacacagcctaatctcagtcgtcctgggagtcctgatcatagttgttcgtgtcggacacctgggacacgagctggccgaggaattcggtaagacgtgcacggtattcggtttcgaactgcttgaggccctgaatgttgccttcgatgaccttggtctgcgcttcgagattgtcgcggacctgctgggcgtagtcgtcggctgcggtacgggtcttcgaatcgtagtcgaaggcgcgcttctgcacttcggactcgtattcgtcggcttcgttgtgcttcgtggagaagtaggtatcaccatcctgggtcttctgagcaaggtaggcgtcgccttcctgagtcttctgatccaagtaggcatcaccctcctgcgtcttctgagcaagataggcgtcgccttcctgagtcttctgatccaagtaggcatcaccctcctgcgtcttctgagcaagataggcgttaccttcctgagtcttctgatccaagtaagcattaccttcctgagtgcgctgcgccagatagtcatcgccttcctgagcacgcttggtcagataggcatcgccttcctgagtcttctggttcaagtagccatcagccttggcacgagtgtcagccaaatactgatcggcttcggaacgggtgccttcggagtagttgtcggcttcggtgcgagtgcggttggagtaatcgttggcattgccgatgagctcatcgtacctacgctgggactcgtcggtgatttccttagccttggctttgcccttgtcgacgtactggtcgtgcagctgcatagccagggtcagcatggcggtggcacgctccggctccgtgttggcgctggctgcggctcctgcaatcttctgcaggcttccggtttcggtactcggttcgaccttggcgacctgctcgcgcagctgggcttcacgctgctgcgattcctgcagctgctgtgcaagctgctgaatctgcgcggcctgctgctgggcacgctcatcctgctgctgggactgtgccgcatgctgctgcgtgagctgctgagcttgggcgacctgctcctgagcctcttcaagccttgcattgagctgctggatctcagccgcctgctgctgggccaccacaacctgctgctgtgcggaagccagctgacgggacaggtcttcggtctgtgcacggaatgcgtcgcgctcatgctgcatggaggtcagctgttcgcccagatccgcctggcctgcagcttcagccgcctgtgcggtgagctggtcgacctgtgcggacaggcgatccacctgacccttgagctgttcgttctgagccgacagagcacggttgctttcctcagcctcggtgagcttggctgctgcgacctgtgcggcctgagctgcctgatcaccagcgccagctgcctgctcggaggcggacttcaatgtcgcgttctcctgctgcagggactgaacctgggcgctgagctcggaaatcttggagttgagccccgcaacatccgggccgagggactgagtagcctggccgctggcaaccgcctgcttgccaagggcctccaccgtctcggttacctgatcgagaaaatcgtcgacttcatcgacgtcatacccctccttgaacctcacggtctggaaggtatgctctctgatatctttcggcgtcaacagagccataaatcttacacctcgctttgggcttgatgccttgctgttgttgctttcattgttcgactctagcacgggaccaccgattttttgcgaaaaatcggcatttgacatacattaaatgaggaaatcaatagcaatgagaatgaaataaagaacgatgaatgccacatcgaagtagatgggacccaatggaatagggcggatatattggcgtagccagcgcagtgggggctccgtcaactggtaaaccgcgtcgatcaacgacgacaccaacccccgtggacgccatgccgatgccaacacagcaacccaatcgagaatcatgcgaatgaacagcaccagaatgtaggcattcaccaaaaagtggacgatgctaccgatcaaagacaaaatcatggggcaccaccttagcaacagaacataacaaagcccccatcacgggtgacggaggcttcatgcagtctgctttcgcaacggctttcgtctatatcagtcggcgaacaaatcgtgcgacgagttattcgcctgcggttcctcaaccttgatgttcacctgagctgggctcagcaggaacacgcgcggagtgacacgttcgatggagccacgcacgccaaaaaccacacccgcggaaaagtccacaatgcgatacgccacggcctcggccacaccggtcaggttcagcaccaccggaacgccgtcgcgaatggcacgtccgaccagctgagcgtcctcataggatttcgggtgaatcgtggtgatacggctcacccttccgccttggaacgggttggctttggtctgctcgcgcggtgcggacgtcgcggcaggagtcgaagccatcggggtcacggaatggtcggaatcgaacgaggtttcgctgctctcagcctcttcgttgaaatcctcgtcaccttcggcaacgtcggtcatgcccaaataggacatcgcgcttttcataaaacctgccatgaacgatcctttcgcgtcttcgcgttgcttttagcgcaggaaatccggaatatccaaatcgccggcatcgttcgaagacaccacttcatgctcggtggtctggtcgaatgacggaacgacgggttccggagtggacggaatataagtggacagcggctgcaccttcggggcttccggagtctgaataagctgaggctggggctgctgcggaaccgccgctgccctcggggctgcggacaacgccgacagcggcaccgtgctttccgcaggctctgcctgcttctgggcttcagcctgagccgccttcttggagttggcatcaaagcctgctgcgataacggtgacacgcacttcgtcgccgtaagcgtcgtcgagggaaagaccccagatgatctgtgcttccggatggatggccttgcccaccagctgggtggcggcggccgcttcctgcaacttcagatcggacgggccggcgatattgatcagcgcgccgtgggcaccctcgatgctttcttccagcagcggcgagctgatggcgatttcagctgcctgggtggcgcgatcctcgcctcgtgcggaaccgatgccgaacagtgcggtgcccgcgccacgcagaatagcgttgacatcgttgaagtcgacgtgaatgtacgagttcgaagaaatcaggtcggtgatgccctgcacgccggccagcaaggcggtgtcggcggtcttgaacgcatcgacgatgccgatggtgcgatcggaaagctcaagcagtcgatcgttcggaatcacgatcagcgcatcgacttccttgcgcagattctcaatgccaagtgctgcggaagccgcacgctggggaccttcaaagctgaacgggcgggtaaccaccgcaatggtcagggcaccctgctgatgcgcggcgcgagccacgatcgggcttgcaccggtaccggtgccaccaccctcaccgcaggtcacgaacaccatatcggcgcccttgagcgattcctcgatatcggactgatgatcctgagcggccttggcacccttctccgggtcggcacctgcgccaagcccgcggctggtggcatcgttcaaggagatcttgacatcggcgtcggaacgcatcaggtccttcgcgtcggtattgatcgcaatgaattcaacactttgaagaccctcggcaatcatgcgattgacggcattaccgccagctccaccaacaccgacaaccttgatattcgttttgtcgttgaaattgtcagtctgggcaatctcgctcaccatagtctcctgtcactcgcgtttacgcacaactttatcgcagacacgctgcagtacgcgcacttttcgccgtgtgtaacggcgttttttcacttttttattgctaacgtgttcatttcgcctgcgatttaccctctttcggtgcccccacgacgatttaaccacatcagcatgtcatattcaatagctggcgtccatagggtcatccccaaacaacgcctgacgttcatcatgcgttgtttcccgtgattccaaccatccgtaaggcagatgcactttctttgcgaagcgcacgcgcccccttggcttgtcgaccactcgctcgggaaaacggatgttgggatccagcttgcctatttcggctctgacatcctcaagattttcacattccatgaacgcgcgacgggtggagcctccaacggggaatcccttgagataccacgcgatatgcttacgcagatcatgcacggccatctgctcatcgccatcatagaattcggtcaacagttccgcatggcgttcaaccacacggcacacatctcctaacgtggggtcaacacgcttgtcgctgccagcgaacgcattcttgatatcggcgaacagccatggcctgccttggcagccgcggccaatcgcaacgccggcgcaaccggtttcggcaaccatggcaagcgcatcgttcgcaccccaaatatcgccgttgccgaacactggaatgtcaagcgcttcgaccagctcgccaatccggctccagtcggagtgcccgccgtaatattcggcggtggtacgcgcgtgcaaggtcaccgccttgcagccttcctcctgcgcgatatggcccgcttccaagaacgtttcatgctcatggtcgatgccgacgcggattttagccgtcaccggcacgttggcagcatcgcagaccttgaccacacgctggatgatctcgcgaaacagatccgtcttccacggcaaagccgatccgccgccgcgtcgggtcactttcggcacggggcatccgaagttcagatcgacatggtcggccatgttttcgtcgatgacgattttcgcggcctgttccacgatcgccgggttcacaccgtacagttgcagcgaacggattttctcgctcggcgcgaaatggcacaaccgcaacgctttgggattgcgtgcgaccaacgcgcgcgcggtgatcatttcggccacgtatagaccgtccggtccgtagctttcgcaaatcacgcggaacggccagttggtaacgcccgccataggcgaaagcaccaccggggtttcaacgtgtaccggccctaaatcaacaggcttcataaccggaggaaccgacggcctcaccgcgtcggtacgcgggtcgagcacgtcggattcctcgtaagcagtcacaatgctatctggcataagaacgctatggtaaccagtatccagctttaatacaagccaccggcttcggcgatcttgacggactcaggccaagcctcgccgcccatctcaaccggcacctgcgggtaacgtacatgcttctcgccaatacgtgcggccacataatcagccaccttgtcgagtgcgacgcgctcctgctgcatggtatcacgttcgcgaatggtgacggcctgatcgtcaagcgtgtcgaagtcgacggtgatgcacagcggggtgccgatttcgtcttcacggcgatagcgacgaccgatcgcaccggcctcgtcatagtcgatcatccagtcatgctgacgcaaatcggcggccagatcgtgtgccacggtctgcaattccggcttcttgctcaacggcagtacagcggccttgaccggagccaagcgcggatcaaggcgaagcacggtgcgcttatcgacgccgcccttggtattcggggcctcgtcaacgtcgtaggcgtcaacaaggaaggccatgagggaacgggtcaggccggcggccggttcgatgacgtacggcacgtatttttcgccggtggcctggttgaagtagctcagatcctcgccggaatgcttggcatgcgcggaaagatcgaagtcggtacggttggcgacgccttcaagctcgccccaatcggaaccctggaagccgaacttgtattcgatgtcgacggtacgcttcgaatagtgggccagcttctccttcggatgctcataatggcgcaggttctccggcttcacaccaaggtcgatgtaccactgggtacgcgcgtcgatccagtactggtgccattcctcatcggtgcccggagccacgaagaattccatttccatctgctcgaactcgcgggtgcggaagatgaagttgcccggagtgatctcgttacggaaggacttgcccatgttggcgatgccgaacggcggcttggaacgcgaagaagtcatcacgttcttgaagtccacgaaaatgccctgtgcggtttccggacgcaggtagtgcagcgagttctcgtcttcgaccggtccgaggtgggtgcgcagcatcatgttgaagtcgcgcggttcggtccagttgccacgggtgccgcaatccgggcacacaatgtctttcaggccgttttccggcagcttgtcgccatgcttttcggcataggattcctcaagcttgtcggcgcggtggcgcttgtggcagttgaggcattcgatcagcggatcgttgaacacggacacgtgaccggaagccacccacacggccggcggaagaataatggacgtgtcaacgcccaccacgtcgccacgggtgacgaccatggaacgccaccattcgcgcttgatattgtctttcagcgcaacgccgagcggaccgtaatcccacgcggaacgggttccaccatagatttcaccggcgggaaaaacaaagccacgacgcttggcgagggatacgacttcatcgagtttggatacagccacaatgcaccttctggtttgaacggtttggggtctttacaagcgcaaagcctacctttacgcggtgacagaacaccacccgcgttactgtttcgtggcgttctcgtcttcaaccgtgtcgttgtcgagcaatagcgaccagatcttgcaatcgatcaccacggcatttttcgtttcgtcaccgtttctgtcaagtgtgtaggtcacattttccggcacggcgatacggttgatgttctgcacggatgccacgaaattacgcatggcatcatagcttcccgtggcggtaatacttaccgacacctgcaccagctgaccggcttgaatggtaccttgcatttcagctggaatgtcggcgtcgaccgcatcatcgaaattcaccgatttgatggcgacgccggttcccgcagcggacgcatccaacgaattgatgaattcctgctggttatagccgtctggaatctgccgctgcaactggcgcaaacggtctttctgcaggccgatcgtttcgctggcgatgcgtaatgtttcgatttcgtcgcgtgtttccttattgttctcatcgatttgcgcagtttgcgcgtcggatgatttgatatggctgatttgcggggaaacgccgaccagccatgtcagcatgatgacgaagacaatacctgcggccaatgcgatccatgcgattttatgcttgttcatgattgctcccgatcattcattggatgtttcgtcagttgcggtcgcgctgtcggtagtatcagtcgactcccctgccgcggctttgttcaggctgtcgcgtagctgctgctgcaatgctcggttggcttcgtcagcaccggccgcgttgtcgcttcgtgacgtggtattggtatccatcttcaacgacaccgttcccgtgtatgtataggtggtgccgttttcatcgctgttttcggtaatggaactcacatagcctgttttataggtaggaattgcagcaaaattaccgataaaatcttttgcagatatgaaatctggagaaagaacggtaaaatcaacggaaatcacaccattcccagaccatactgaagatgtagcgctatgcgaagaagcgtcagacccgccaatctggaagctgctcaacgacaggttcgtgtactggcctccggctggcagcgcgccattgagcgaatccaccaccttcatccaatccatttcgtcgtagagcgcggcgatacgtgacctttgcgaatcggacagcgagttcaacgtgtcttccacgtctttgaattccgccttttccttctgcaacgacagggttttcgcctgtgcctcctccacgcgatggtcggcccagctcacgcgcaccgccatgcccgcgctgatggcaatggccgcaaccaccaccacgataagcacgtatgacagcaagtatttgatggcacgatcacggttgagcgtcacgatggaacgtggcagcaggttggcgcgcacattccattcggcgggcagatcagcctttttggaggttttcgaactgctcgcacgcagcgctttgccgatgtcggaaatattcatcgacaaaatcgaggttttctcgccatcactggtttcaggattcggattatccttgattttgccgcgtcgaccgcggtgggagctgccgatctgcttcatgcttccgttgttttttctgctcatcgtccgttcacctcggcttctttccgattaccagtccaagcactgcgcccaaatcgatcgcgtgcgccatgatgttctgccgttccacttctttggaaagccggaaacggatgaaggggtcgccgatccgcaccactttgttgatggaactggccaataccggcggcagtccgatcagccgtgcgccggttccggtaagcaccacgccgctgatggtgccgcccgcatggtccacgtcgtacaggttgagcgtattgcggatgccgacgatcagctgcgccgtggtttcgcggatgacttcctcggctttttcgagtcgttcgtcgccggtcacgttttgcaggccgatctggtttttgatgcgttcggcgtcttcgaatgagatactgagcgcgttggcgatggcgtcagtcacgtcatccgcgccggatggcacgacgcgcatgtaggcgggctgcccgttttcgagcacgatcacgtcggtgccgttgccgctgatgttgaccaccgcttcggtctgctgctggttggtgtcggcgaacagtctggcaagcgcgaacgggcccgcatcgatcgatgtgatcacaaatcccgcgtcttcggctgtgcgcgcggttttttccaatccgttacgcaatgtcgccacgagtatgccgtgcaactgtttgccttgttcgctgtcgatgacgttcaatggcacgaagtcgagctcggattcctcaataggcagcggaatcatgcctttggcttggaaaggcaaggtggatttcagatcgttcagcgacatgtagggaaagtccgtctcgcgaaacaccatgcgtcggctggagtagacgagagccgtgtcctcgcgggggaatttgaatcgcttcaccagtgtgttcagcagtccggccaccacatcatggtcgaccacttcgccatccactacggctccgttcggcaacgggatcgcctggaaatgcttgatggtgggcagatccgaatacgggtctgctatgaccgccgcacggatggcgtcgttcgcgatcgacagcgccgttattgatctcatgctctctccttatatataacgtgttgcaggttggctggggattggttcaggcgagtcccgtcacttgcaagtacagtgtggcgatcggagccccgacgaatatgccaagccatatgccgagcagcatggacggtccgaacggtatgcctccatgcatatcgacttttttgccgataatcagcacaagacttaagaatcctccaataaagaaggctgcgaacgccccgatgatgaattgcgaccatccgagccagcccgtaatcaagccaagtatgaacgcaagtttgatatcgccatcgcccatgccacctttccatatgatggaaagcaataggtagaacgcgccgagcactatcgcacatatcacagcgcgaccgagcctgttccactcattcgtaccgagtgatgccaaagccagcagtgccagtgttgcaatcagcgttggcaatagcacaacattgaggatcagatgatggtcgagatcaatgtatgcgatcacgatcgaaaccgctgcgaatacgtagagttccggcaatatccatggcgaatacgcgccgaatagcgcccccaaggtgacggcgaggaacgacagtccgcccaacgcttccacaatcgggtagcgtacggcgatcggctctttgcaatgccggcatttcgcgccgagcaccagccaagaaatgatgggaatattgtcataccatgcgatcggggcttcgcagttcgggcagaaactgcgtttcggatttaccaagctgatgtggttgggcacgcgccaaatcaccacgttcagaaacgatccgaaaatgcagccgattaccagcgatgccacgagtagcagcaccacagttggcgtatcgttcacaatgctcatgttcacatccatctcgcgcagcgctcaccatgcgatagtggacgggttcagttctttggatgtcacgtagcctttggtggaggatggctccaatgtggtagaactaccaccgccataaatcacgccgccgcctgagccgcctgttccgaggttaaccgaggcattccacacctgcgatttgatttctcggttcaaaaagtctcgtgacgatccgcatttggccataatcacgtcggcatgcccgtcgatacgtccggagtatgagggattgccgtcgattttgtctcccggatacacttccgtcaggcattgaccgttgagttggaacgtacctttactgtgctcgtcagacgctttttcgttgtatcgggtgaatgttggcgcagccgagcattccataagttggaatttgcccgaaccgccgaacccatagcaacgcttcgacccgttcaccatcgtccaaatctgcgtgttcacgccactgccgtcactcgacgtgtcttcaacatattcggcctgatcggttttacgcttggtggaatcggacaccccgcagtagtcgatctgatgcagatcggaagatgattgcgccggattgccattgatggtgttgtggtagcagtatgggttgaaatcaccgccacccactcggcaggttgacgtgtatgcgtcgaatccgtcttgcgatgacgaaatgcagaatccggacgtttcattgacgatctgcttcgtggcatagccggcttctcccgcctgtccgaacgatgcggtggcgtcttcgaaatcaccgttcacgtcgaaccaggatttcacgtcggtgagcgaataatcccacttcgacaccatcaggaaatgcggagtcaaatcgacagcatcatcgacgttggacgcccagtgaccgccgctcagatattgaatagtggcgcccacattcgccttgttggaaacttccagcacttggaagcgcgtcttcttctgcatttgcacaccgccaacggcatagccttgcgattccggtagagacgcatcatacttgttcgcctcatcgcgcacgctatctagctcgttgtagtagcccgcattgatgaaaccgttatagaacgcccacttctggtatttgttgagcaggcttgacggatcgttcttttcgtcttgctgcgctttcttgtcaggatcggtgtaatagtcgctttggtagttggggccgtacgactcgccgcatttctgcaatgtggcggctcctgcagtgcctccgccaacatgcgtaatgtcagctccggtaacgcacaatgtcagattggatgcagggcgaatggaatcatccttccaatacacccatgtgttcaggtctttgtaggcgccgttggctttgcactgttccgtgtaatacaggtcgtcgctgctggagtctttcttatgcgcttgcataagaatcaccaacgccgatccttccaccggcttgccgttcgggtcaagcatggcgtcaagcgtttcgaccttgtctacaggcttggtggtggcaagcatgcaagtttggtttgccggattcatagtgatggtattgctcatagcgtcggccgcattcttggagccaggcttgttgacatagttcaccatgccggtcggatcaccgttctcatcgacatcatatgaggcgatttccttccaggtcggctggttggtacggcgctcgttgtttggcgctgccgcgtagaagcccataccgagacgtccacccttggtggagatcacgtagctgtcatcaccgctcgctgtctcgaattggtagatggcgctcatggctcggcgcgcgctggtttccgtacccgcgcttcgcccattcggatacctgttgatatacccgtaggaacgcacccacgcatatttcgcgttcttcagctcgctttcggatgtgagtcgtttggccggcgatgagcttggatcgtcgtcataatatccgatttgcactcggtacgagatatcgtctggagtgaacgagctcacgcccgttgccgacacgtcgttgctgacttccgcattgttgagcagcaccgacccgtccgatgctgtagtgaaggtctcatccaagctggcattgccagtgtttgatgcggtcgacggtagcagtttcttatagtccttgcttgcttccgcttcgcgcaggaaactcaatgccacttcgagtccagattcggcggcatacccgacttgcgcgttctccttattattcctgtacggcaatgcttgcgaaagcagtatggtcattaccagtgccgacgtggtgagcaccaccattacgaacagtaccgcgagcatcatggccgcgccccgctcccccatgcgttggcgtaatctggcacgatacctgcggttgagtccggcccacaatccgttcttcatgttcaaccttcccgttttcgcttacgcttgcccgttgatggcgtcgaacatggagaacatcggcatgtacaatgccaccaccatgaagccgaccacgctaccgagcaccagaatcatcaacggttccagcagcgaagtgagctgtttggcgatggattgcgcttcttcgtcatacgctttgcccgcgctggcgagcatctggtcgatggcgccggaatcctcaccgatcgccaccatctgcaccatcatgttcgggaacactttttcggtacccatactgtccgccagcctatagccgcgttccacgagtcgagacactcgtttggacgcttcgtcgattacataattgccggatgtggatccgacaatgtcaagcgcctgcagaatgggcacgcccgaagcgagcatggatgtgaaattgttgcagaatcgcgccaatgccacattggtggtcagtttgccgaacacgggcgccttcaacgtgaacggatcccaccaggtacgaatgatgtctttgttgcgattgcgcttccaaaacatgacgaacgccaccgcgcacacaatgatcacgggaatgccaaccggtgcggtcttgcccatatcaaccatgatctgcgtgacccatggcagttccgcgcccatcgacgcatacatgctgtcgaacatgggcacgatggtcagcagcatcacgcccaccagcagcacagcaatgccgagcaccaccaccgggtaagccagtgcgcctttgatctgaccttgcaaacgcacgtccgcttcaaagctgtcggccacggtaatcagggatttgtcaaggaagccgccggtttcgccggcccgcaccatgttgatcataatgggcggaaacagatggtcgggattattgtccattgcttcggaaaacgatgatcccgcctcaacctgctgcatgcagtcacgtaccgcattgcgcagtttcacatttccgatttgttcagtaacgatattcagtgcgcgaatcagggagacgcctgccgccaccatggtggcaagctgacgtgacataaccgcgaagtcttttttgcttggatatttttcgaatgctttgatttcaatattggtattgagaccggtgcctgcgttcacgtcaacaagttccgttggaatcagaccgagtttattcacgcgatcgatggcctgatctcgcgtctgcgcttcgataacgcccttctgcttggtgcggccgtcagcggaaacacccttgtaacgccacttcttggtgccgttttgaaatgccacttgcgcctgttccctggccattactcccccatggaatgattgacgaacaatggaacgaatatggatacggaacaaggtatcggagcgatacctcatacgctccgatacctttagtcccacgcgaattattcgctatgccttttattatttagtaccagtcttagagacgacaccgttggccgagtcatacaggaaaatcgctgtaccagagttctcgttctcgccctcgatagtgtaggagttatctgctttaccggtaatcttcagggtaacaccctcagttacggtaatcgtattgcctccaagcgtgcagcccgtattctggctcttactgcacgtggccgttgcaccattaatctcagacggaagcttgccattgttggcagtggacgcagtttcaaccacaaggctggcgttcttgacgtcggactcggtctgggagttccaggccgacttgcgctggttcaggtagatcggcacggagatggcggcgaggatgccgatgatgatgaccaccacgagcagctcgacgagggtgaagcccttttcgcccttggcgcggcggttgagtgcgttgcgcacgctcttcataattgaatccttctttccttcgggaaaggtcgccgctcgcatcccacgatggagcttcgcggcgttcttctatcgatcgtccccttatgggggctgctggctcacataaccaacagtcctaactttatccgcattgacatcgtttgcagaaccattattccggcgtcaatcgttttacgagcgtttcattttcgattcattttcccctcatccttcatccgcacaaaagcgctttagtttaccccacaacccccttcacaaccatcaagcaaatcacactttttcaagcggacacaaaaggtacaacacaaaaccaaaatcgtgcaacaaaaaatacaacaccacaaatagcttgtttttcagtacaatcgctcagcaaatctttgcagtcacgtttttttgaaaaaactggaataaccacccttttcgggcgtgtcgcagggtgctgacggggcgacaaaaacggctggctccgtaaggaaccagccgtctgccgcaagacctatcggaacactcagacacacggagtgaaatcgattgcagttccacccgatttcacattgcgtgcggtgaacgacgtggacgtattcgacgtgaccggcttgccgctcacatacgaccccgtcaccggcgaataacgcaccacccgattggtgccatccaccgtgaataatcgcgaggcgaacatcgaatcatcagacgtgcctcccgactcgttgttcattaccgaccccaacaccgcgcgcgtgctccatgacgtgacggacgcatcatacggcttcgtttttaccttcacgctaccgtaatcgcttaccgtaccgttcttccacgtggcgtcctggtacgtgatcaccacgcactgcttcgcaccagaatcccccggagtgaccatggtgatcgtatggttcgtggcgtcatactcaacaccctccgcgtagcgcacataccggtcgaggctttgcaccgacgtggctatttccgtggaagacctgcttcgtatcgcatccgcgctggtggaatgcaggtattgcacgatcgccgtggtgaacatggtggagacgatggcgaagatgaacagcgacaccatcatctccaccaaggtgacgccgctttcaccgcgcgccatacgttgcgcgacggcgcgaatacgcagttttccgcttgttgttccgctcattgcaacccctcactagatgatgagcttgttgtcgacaccaatatccagcagttccgacgtggtgtacaggcaggttttgccctgatgcatgttgtcgtcccaggtgacacccaccaccacgcggatcatgggcatatacgtgtgcgcaccgaacgtgaacgcgcccgataccgttttgcccggatccagaatgtcggccgtagcgcttgttgaggtattggccgtatagctcgttgcggaactacgggaaatgcccagctgagatgcggtcttgcacgagatctcgccgctggcacggaaacagcgctccaccaccgtgttcaccgtgtattcggtatgcttggcgtccttgcccgcagtggcacgaaccggctgaatatacttgctcttgtctggatcaggcgaactggtatagctcagatccgccaattgcgacgcgatggcgccaacgtcggaaagattcttttgcgcggcggtgacggacgtttcccccatgcctttgatgagttcatcgagatattggttggcgtctacattggcgatctgcgcacgcattctttccatgccgtcgtcgcccagcgacacggcggtggaccgctgctgctgcgcatatgacgtgcgaatggccgtaatggcgaactgtgcggcggcaagtcccgtaatgctcaacaccacgatcgccaccagcacttccaccaacgtgaagccggactcgccacgttttggcaatcgattgacgcgactcgccgcaacccctgaatcgggggcgtctcccgctgtgcgcaagctgtactccatgagcagctccttcacaagatgccaccccatcattggaagcggcaggaattcggcacgcaaccaaacgcggtgccataaacatgagttactgtatcacgatattctgccaacgttttcacagcaacatatttctcaaaaaactttgccccgattagcttttacctgtttttgcggctacaatgctgatttagcagtacacaatactgcaatcgttgtagctcacatgacttcgaacaactgaacatcagcctccccacaaatgctgccgtttgcttggggtttcatgttatgccgtatgacaggcgcataagcgcgcatgcggtgcaggaggtcattatgagcgacgccggttcgggaggccgtttccccttcctcaggcgaaacaaaaacagcgacacgccgaacgctttcccgcaaagtatggatccgatcgcgccgacaaccggcgagatccatcaggtgttcacgccgagcacaccacgccatgcggcaatgacaagcgacgccaccggagattttcccgccatgccaacgtccaccgaaggcatggacgaacagaccgaacgccaatatgccatggcgttggcgcaaggcatgagcctgccgttcgtggacctcaatgaataccagatcgacaaagaagtcatcagcatggttcccgacgatctgtgccgacgcaaccagcttctgccgctttccatcgtcaacgggcgcatcgccgtagccatggcgaatccgaaaaacttcgccgcggtagacgatgtttccgcaacaaccggcatgcccgtcatcgccatggtcgccatgccatcgcaggtacgcgactgcatcaaccggttcctgcgcgccaatgcggagttgaccgaactatcgcacgagatcgccgcgaccgcgaaaaaagaagtcgaccttgaacaagacgacagcgaagacgcctcccccgtggcacgcttcgtaagtctgctcatcaaccaggccatcgacgaccactgctccgatatccatatcgaaccgcaggaagacggtctgctcgtacgctaccgcatcgacggcgtgttgcatatcttccaaaaagcgccacgcgccatgacccaaggtgtgatcagccgcattaaggtcatggccgaaatggatatcggcgagcgccgcaagccgcaggatggccgtattaccgtacgtcacaacggtcagaaggttgatcttcgcgtggcggcattgcctacggtgtggggcgagaaaatcgtcatgcgtattttgagcacgccttcgggcaatctcaaagtggaggatctaaatttcagcgaacgcaatttcgatgtgttttccaaagcgtacaaccgcccgtacggcatggtgttggtgactggtccgaccggttcgggtaagtcgaccacgttgtatgcgacgttgggcgatgtggcccgcccggaaatcaacatcatcacggttgaagaccctgtggaattccgcatggagggcatcaatcaggtgcaggtgaacaataaggcgggtatgacctttgccgccgcgttgcgttcgattcttcgtgccgatcctgatgtggtgctgatcggtgagattcgagacgaggagacggcgaccattgcgatcgaggcttcgctgacgggccatttggtgctgtccacgttgcacaccaatgatgctccgagtgcggtgacgcgtttgacggaaatgggcgtggaaccgtttttggtgagctcgtcgctggctgcggtgatggcgcagcgtctggcgaggcgcctgtgcaagaaatgccggaaagccgatacggccactcccgtggagttgaagatgatgggtgtgccatatacgcccggctctccgttgccgaccgtgtaccgtgcgatgggttgccgtgaatgttccaacaccggatatcacgggcgtgtggccattcagcaggtaatgggcgtggacacgcagatggaggatttgatcgcgcgtggcgccacgtcgctggaaatcgagcaggcggccaagtcgaaaggcatgacgtcgcttcgtgaggatggctggcagaaggttctgcaaggcattacttccgtggatgaagtgcttcgcgtgaccgtgtagttgtgtaatcgtgtgaccgcgttttcaacatatgtaaaggacaatgatgaccgatattgaacagcaacccgagctgaaaaccgaaatgaacaccgcgacggatcccgatgcgcagccgacttgggatgcgaacaccgatttgtctggtttgaaaggtgtgaccattcccagtaccgctccttcattcaacgaggatccgcgtaggggacgccattggtcgcccgacaatgcgattcaggctgacgatgacagtttgcgcagtattttcgcgtcgcttgacgccatgcccgcgttgcggcatggttccggtaccgttcccgaccccatgtctaaggccgcggtcgagcaacagccggcggccgagcctcaacagagcgcacagcggcagtctatgcaacagtcagctgccccgcaagccgttgcatcacaatctgtagcggaaccgcagcccgctccgacacggcctgcggaaacaccgctcattgcagaacaacaggaactctcctacgacaccgcttttccggaaaccccggaaaacgaagccgtggatcagcagaatctgcaattcgacgatgacgtgacggaagtcacccctgcattcgagtatcatggaccgatccagcaaatcgacggcgatccgccatcattcattccaggcggcacgccgttcgcgcaacagccggacgactatgcggcgtacgaggagaacgcgcagaccatgcagccttccgccatcaaccatattgcgcagcctacgcccgctgccagaccgcaacccaatatgaacaacaggctaatcgtggatttcatagtgcccgaaaccaatgattccgacgaggacgctgttcccggacaacgcagaatcaaagcgcaccaggtcaaagaaacattgcatgccgaacatcccgatgcggatccggaattcgtggctgccatatgccagctggtggaattgaacgcgtccgatcttcatctggtggtcaacgatccgccaatgctgcgcgtggatggcaagctgcgccccgccaaagggctgagcgtgtggaacaaggaccgcacgtatgaagccatcaaagtgatgaccaacgagctggagatggaacggttcaaagacgatttggaacttgatatttcattctccatcggcgatctgctgcgattccgcgtcaacgtataccgcgaccgtttgggcgtgtgcgcggcattacgaaccattcccacggaaatcaaaaccgcgcaggagcttggtctcgacccgcatatcgccgatctggcgttactgccgcgtggactcgtgctcgtatgcggtccgaccggctccggcaaatccaccacgctcgccgcgattgtcgacagagcgaatgccgaacgcgccgaccatatcatcaccattgaagacccgatcgaattcgtgcatcaacacaagcgttgcgtgatgagccagcgtgaagtgggaaccgacaccaaaagtttcgcggaagcgcttaaacgcgcgcttcgtgaagatcccgacattatcgaagtgggcgagcttcgagacctcgaaaccatttccaccgcgttgaccgccgtggaaaccggccacttggtgttcgccaccctgcacacgcaggacgccggttcgaccgtggaccgtctgatcgacgtgtacccggaaaatcagcagcagcagattcgcgtgcaggtggcctccactctgcgcgcggtggtcgtgcaaaccctgattccacgtgccagcgggcatggccgcgctcctgccaccgaagtgatgatcaacactccggccgtggccgcgttgattcgcggaggcaaggcgcatcagattcgtaccgtgctgcaatccggcgaaaaggaaggcatgcatacgcttgaccaagatctggcgagactcgtcaacaagggcgtcatcaccttcgaagacgctcttgccaaggtgcaggtcctcgaggaattcgaaaaactctgcggcgcccgctcctccttctaacctcgccgtacccatacaccatctttacacctatcatgagcaacacagcagaaacaccaaccatcatccagcccgacgtttcggcgaaccgcgtgacgaaccttcgaaaaagactcttcacctggttcgccgaacaacggctgcactgcattgtcttcatcgcctacgtgacagtgaccgtcaccgtgtcgtgttttcacgaaccatggtttgatgaggcgcaagcttggctgatcgcacgtgattgctcatggaaggaactgcttaccgtacgcacccattacgaaggacacccacctctttggtggatgctgcttgccattcccgccaaacttggcatgccttacgaaataggattgaaatccctcaatcttatgtgcgccgcgctgatgatctggcttttggaattcaaaacgaaactaccagaattactaaaggtaatactgccattttcctattttctttgctaccagtatggcgtaacttccagaccatatgcgcttatgatcgccgcaatgctgctcatagccatcaattggaacaaccgcaacaccaagccatggccagtcatactcagcatgatgctgctatgcgccacgagctcttacggattggcaatcgccggcatgcttgccttgaattggacgattcaatttctctgcggcgaacgctcgcttataaaaaacaagcagcgtttcgcgggacttgttctgctactggtattcgccattatactgctcctcaacgtactccccgcacccggcacataccacggtgactttgacatacatggcactgcaacaacatcacccgcatgggtttccgtattcaacacctggctggtaatgccttccgagacgttgttcacttcaaccctgtcggatggcaatatgcagttcatcgctctcacgccaagcgagctgtttatgccgtgcgtaatgtcatgcctgatgtggtgttttcttattcagatttgcctacgccggaaaaccgcatcattgctgctcaccacatacttgggtataagcgttgcgttcaccgcgcatctttccatgcatcatgcgggaatcatcttgggattcttcatcgccattctcgccatcgattgcgatatcgaaaaaatcaattccaacgattggcctcagtggatccgtaatctcaacaaccgtgttatgactcttcttggaccgaagaaaacggaacggtatctccgtttcttcaaaatcctcggtcttatcttcatgcttgtcagcgtgtattggacggcaagcgccagtatttgcgatattcggtacgactattcgtcttcccgggcggtagcgtcttttatcaaaaccaaccatttggagcaataccgttggatggcaggctggacacgcgtcagcaagaacgacaccgcttccaatccagaaatcaacaaaatcatcgacaaaggcggatattgcggcggcaccgactgcatcgactacacttcttggtacggcagcacccttatcgattcagccccttacttcgaccatacgcttcttgccaatgcatacaagggacgaagctattcgtcgtgggaatggtgcgttgacccctatgcgggaaagaaagacatcgaaacatggaaatcgtggggcgaacccgaattctacgacactctgtatcagccatttttcttctccgaccttggttacgacagaaaccattacacgaaaatcaaaatcgccgaaaccaagacaccttggaaaagcacatggtcggaaggcgcctgcgaaatttacgtgcgcaacgacatttacgagaacgtattgcattcgcccgatcctggaatcgactggcccgacggcgcaacgcgcagataacaagtggaccggcatccaactggaacgtgtcgattgttcgtttatgcaaaacgtgccactgtcagcacctttgtataggttagatatgttatgtacatgcaggggggcttccggcgaaagcggaagctgagataggcaaatgcctgaccctttgaacctgttggttaggaccaacgtagggagcagacaatgggcgatgactcatatgcagctgcattgcgtgaacagattgcgcaggcagtaaacgacgtacgcgaaaccacacctttggcacagtcgttcaccaatttcgtaacgatgaatcttgtggccaacgcgcagctggccgccggcggcaccgcagccatgagcttcctgcctgacgacgtgatcgacaccgcggaaatcgccggatcgaactacatcaatgtgggcacactcctgccgttcttcaaggacgcgctaccggaaatcgcctacaaactgcacaagaacggcaagacgtgggtacttgatccggtcgccgcgggcatcggcaaaacccgtaccgccattctcgaatcgttccgcacatacccgccgaccattgtgcgcggcaatgcgagcgaaatcatcgcgctcgatgcgatgtggggtttggcacagcatgattccaccgttcccggcactcgcccggcaggcgtggaagccgtcgacgaagtcgattccgccgttgacgcggccaaacgagtggctcgtcatcttgcgaaatactcccctgttggagccggcgcggtggccgtttccggagcagtcgatctggtgactgacggcgagcgcgtgttccgtttgcccggcggcagcgcgatgatgacgaagatcaccggcgccggctgttcgctcggcggcgttaccgcaacgtatctggccgtggccgaaccgcttgtcgccgcgatttcggcatcattgctgtataacagggcttccgaaatcgccgaagcgaaatcgtccggtcccggatctttccaagtggcgctgcttgacgcgctttggaacgtcaccgccgaggaagtcgccgcttccgaaatcatcatcgactaggctttgccgaaccctgcatggtattcggcatatcatgcggggttcggcaattgcgtatatggaaaatatggacgattgccggttcacattgtaggttttctgaatcacttaccgagaagggttgattatatgaacaattattcatatgcatcgatgcgcgatacattcgatatgagcgcctactttgtggtcggcccgcaggattgcaagagccgtactattaccggtgtgattgaggatgcgttgcgcgggggtgcaacgttcatccagctgcgagccaagaacaccgacgcgaaagacatcaccagcatggcacgcgatatcgcgcaggttatcgagaacaacggcaaatccgattccgtggcgtttgtgatcgacgatcgcgtggatgtagtttggcaggcacgtcacaagggcatcaaagttgacggcgtgcatattgggcaaaccgacttggaaccgcaggaagcccgcgcgttgcttggggaagatgccattgtgggcttgtctgccgaaacggaaagcctggtgaagctgatcaacgagctgcctgccggctgcatcgactacatcggggccggcccgttgcacgtgtccaccaccaagccggaagcttccgttggtggcaacgatggttccgggcatacgctcgacgaggcgcagatcaatgcgatctgcgatgcgagtgattttccggttgtggtcggcggtggagtgaccgccgacgatatggagatgctcgcacattcgaaggcggccggctggtttgtggtgtcggccattgccggcgcaagcgatccggaagaggcgacccgcaatatggtttcgcgatggaaggcagtgcgcggtgatgcaaagcatgggcacgtactgcgcaaatagcaatcacggatcacgaatatttcagaacttcgcatcataagcaagcaaaagcaagtaaggagtcattcatgaccagcactttggcaccggtattgagcatcgcgggatcggattcctccggtggtgccggcattcaggcggatttgaaaaccatgcttgccaatggcgtgttcggtatgaccgccatcgcggcgctgaccgcgcagaacaccacaggcgtgaccatggtcacgaacactcctccggaaatgctcgccgcgcaaatcgacgcagtatttgaagatattccgccggtcgcggtgaagatcggcatggtgtcgagcgtggagctcatcaacgtgatcgccgaccgtctgattgcgcatgatgccacgaatattgtgcttgatccggtgatggtggcaacatccggtgcgaagcttatcgaaggcgacgcgattgcggcactgacttccaagctgttcccgctggccaccgtcatcacgccgaatatgccggagacccaggcgctgtgcgagctggccgtcgaacagggtgccgacgcgatcgactacgagaatggcgaaagcatctccagtgagaacgacatggtgacggcaggccatatgctcgccggccatttcggctgcgcggtgctcgtcaaaggcggtcatggcacgcaggatgccagcgatgtgctcgttgaaccgagcggcaaagtcacttggttccgcgcgcgtcgtatcaataatccgaacacgcatggcaccggatgcacgctgtcttcggcgatcgcatcgcatctggcgcttggcgagacattgccggaagccgtcgatagtgcaaaactgtatctgacgggcgccttggaggcgcagcttgacctcggtcacggatccggaccgatggatcacgcttggaaatggcgctgacagccaaatccgcaccagccaatccaagtcgtatcaggccgataggaacgcaacgaaaggaacgaacatgacccttgatcgcaatgcggaaaagcaggaagtgccgatcaacccggaaaccggcaaaccgtatatcaacacgcttgccgcagtcgccatctcccccgccggcgcaagccctgaaaagtccacgtacgtggcgcaggcggtcgacgtgatccgtcaatccggattgccgagtgaaaccaacgccatgttcaccaacatcgaaggcgacatcgacgacgtgctcaaggtgattcgcgacgccaccatgaagctggctggccagggctatcgcaccgacgtggtgatccgtctcgacattcgcccgggtttcgaaggtcagatccacgccaagcaggcacttgtggacgaaatcctgtcggaataaatcaggcaataaactgttagatcgtcagaaaaatcgaaaagcgcgctatttataaggaatggcgcgcttttcttattgatttgggtatagtgtagcgaatatgactacgatgaaggaaattgccgaagcgacaggggtgtccatttccactgtttccctggtgcttaacggcagggatgaaggacgtgtgaaagcccctttggccgcgctcgtacgcgagaaggcagacgaactcggctacacggtcaatcctctggcgcgcagcctgcgcacttgccgcacgcgaattctcggcttcatcagcgaggaagttgccaccacgccgtacgcaggcggcatcattctgggcgcgcaagacgcggcaagcacctacgggtacatgatcatcacggtcagcaccgatggcagggcgagcgaagagaacgaaatcgccacgctgaaacggtatggcgtggacggtttcttctattcgaagatgtcgaatcgcattgcgagcgtgccagcctcgctcggcgattatccggtggtgatggtggatgccaccgatgccgacaaccagattcccagcatcgagccggacgaattccaaatcgcctatgatgccacgaaacggctgattcaggccgattgcaagcgtatcgcctacatcggatgctcggaaaacatgattgcgcaggatggccgttttgccgggtatcaggcggcattgcaggattccggtttcgcctatgatccttcgctggtatgcaatgtgctcaataatggtcctgcgttgcgtgccgtcgacaaactgtttgacgaacgcaatcccgacggtttcttttgcttcaatgatgcgcgtgcatggtatgtgtacgaatgtgcggcacgccgcggactgaccgtcggcaaggacgtttccatcgtcggcgtcgacaaccaccgcgtgttcgccgaaacgctggaaccgcagctgaccacggtggaactgccccactatgagatgggttattgggccgcatgcaagcttatttcgatgatcgaacgcaagcccgtcgacagttcgtcttggccgaataccaccgctcccatgccgccgttggattcgccgattcctgcgaagatccattgcgcgctgatagaaaagggatcggttcgcagctaagtttcgcgatctaagaccacatgaaaggcctgttgacgtgtccgttacgacacgccgagaggccttcttttttcatcccccatttcggcttaattccaacacttccgaaaagcgttggaattacttacgtcaatcgattgacgtcaatcgttttacgcactattatttaaccatgttcatccacttggcacggcagctgggtgaatgacggcataacacaacatcggcacacaaccgaggtgccgcgcggcagcggcacaaacaaagagaaacagagaaacaacaacatggcaagtacaactcgatctgcatggaagaatccttcctacctgcagagctccttcggcatcttcatgttcttctgctcgtggggcatctggtggtccttcttctcccgctggcttaccgacccggcccacggtctgggcatgacctccgccgagcagggccagatctactccatcaactccctggcaaccctggtcatcatgttcgcctacggcgccatccaggaccaactgggcatcaagcgtaagctcgtgatcttcgtctccgccatcgcagcgctcgtcggcccgttcgtgcagttcgtgtatgccccgatgctgacagccggcggcaccacccgtttcatcggcgtgctcatcggctccatcgtgctgtccgcaggtttcatggccggctgctccctgttcgaggcactcaccgaacgctactcccgcaagttcggcttcgaatacggccagtcccgagcttggggctcattcggctacgccatcgtggcgctgtgtgcaggcttcctgttcaatatcaacccgctgctgaacttctgggtcggctccatctgcggcctcggcatgctgtgcatctacgctttctgggttccggccgagcagaaggaagagctcaagaaggaagctgatccgaacgcggctccgaccaacccgtccttcaaggaaatgatttccgttctgaagatgccgaccctgtgggtgctcatcgttttcatgctgttcaccaacaccttctacaccgtgttcgatcagcagatgttcccgaactactacgcttccctcttctccaccactgaaatcggcaacgccacctacggcaccctgaactccttccaggtgttcctcgagtccgccatgatgggtgtcgttccgatcatcatgaagaagatcggcgtgcgcaactccctgctgctcggtgcaaccgtgatgttcctgcgcatcggcctgtgcggcgtgttccacgatccggtcagcgtctccatcgtcaagctgttccactccatcgaggttccgctgttctgcctgccggcattccgctacttcaccctgcacttcgacaccaagctgtcggcaaccctgtacatggtgggcttccagatcgcttcccagatcggccaggtgatcttctccaccccgatgggcgccctgcatgacgccatgggcgatcgcccgaccttcttcaccatctccggcatcgtgctggcagccctgatctacggcttcttcgtgatcaagaaggacgaccaggaagtcggcggtgatccgttctacaccgacaagcagctcaaggcccaggccgctgcagaagcgaatgcctgaacgcaatcgcaagtccagccaagaacataactgaatcgtgctgctcgaagcgtttcccctttttccgcttcgggcagcattcttacaacttttactcaaaactcaataagcagcaattcaacaatcacaagaaaggctattcaacgatgactggcttcaccccggacgcacccgtccttcacgaaatcaagaaccacagcgaagccctggcacaggcggaagcaggcgttgcagccatggccgccgaacgcaacaaccgctggtacccgaagttccacatcgcatccaacggcggctggatcaacgatccgaacggcctgtgcttctacaagggccgttggcacgtgttctaccagctgcacccgtacggcacccagtggggtccgatgcactggggccacgtctcatccaccgacatgctcaactggaagcgtgagccgatcatgttcgccccgactctcgaagaggaaaaagacggcgtgttctccggttccgcagtgatcggcgatgacggcgagctcaagttctactacaccggccaccgctgggccaacggcatcgacaacaccggcggcgactggcaggtgcagatgatcgccgaaccagacaacgacgagctgaccagcgccaccaagcgcggcatgatcatcgattgcccgctcgataaggtcgaccaccactaccgtgacccgaaggtatggaagaccggagacaagtggtacatgaccttcggtgtctcctccgtagaaaagcgcggccagatgtggctgttctcctccgatgacatggttcgttggacctacgagcgtgtgctgttcgaacacccggatccgaacgtcttcatgcttgaatgcccggacttcttcccgatcaaggacgccgagggcaatgagaagtgggtcatcggcttctccgccatgggcgcaaaggcctccggtttcatgaaccgcaacgtttccaacgccggctacatgatcggcacgtggaccccgggcgaggcgttccagccggaaaccgagtttcgcctgtgggattgcggccacaactattacgctccgcagtccttcaacgatggcgagcgccagatcgtatacggctggatgagcccgttcgttgagccgattccgatgcaggatgacggctggtgcggcaacctgacccttccgcgtgagatcaccctgggcgccgacggcgatctgcacaccgctccggttgccgaaatggagggcttgcgcgaaaacaccaccgatttcggtgcgatctcgctggacgtcaatggcgagcagaccattgccgacgatgccgaagccgttgaaatcgaaatgaccatcgatctcaacgcttccaccgcggaacgcgccggtctgaagattcacgcgactgaggatggctcttacacgtatgtggcgttcgacgatcagatcggccgcgtggtgatcgaccgtcaggccgcagcccagggcgatcgtggctaccgtaccgcgccgctttccgccgaagaactggcttccggcgagctcaagctgcgcgtgtttgtggatcgcggctgcgtggaagtgtacgtaaacgacggccgtcaggccatgagctccttcagctacgcttccgaaggcccacgagccatcaaacttgttgccgaatccggcacgcttgaggtcaagtccttgaagctccacaccatgaagtccatcggactggagtgaagctaatccaaggcagtagcaaggggtaaagagtaaggcgggtttcgtgtcgaatgagatacgaaacccgcctttcgttttggtttggaacgtggtttagggagtgctttatactggcaccccggtaatgaacttttctgaccggaacgcgggcaggctcctcaccttactgatttctcgccaccggtcacgtgcgcgcccactatggcgcagaaagcaaggtgaacgatggcggtttcgcacgttcaacgcagggattcggcaacaggatccataccctcaaacacgagttcgcacatgggttcgggcatggctgcgaacacgaattcaaaagccggcattgtcgcaaaacttctcgaagctttgtccgcctttgctcacgtttgcaaacgccgtattcccacggttattgcagtagtgctgttgctggcggtatgggaggcgtgggtccgcatcggcaatgtgcccagcaccatgatcgccgcgccaagcgaaatcgcacaggccaccgtcgaaacatggtcgacgttatggcctgccacgcaagtcactttgcttgaaggtaccgtcggattcctgttcgccgtactgttcggcattctcatcggcatactgctgtactgctcatgcattgcgaacgccgcattgctcccgttgctttcagctgcgcagaccatgccgttgatttccatcgctcccctatttttgatctggtttggctttgagatttccggaaaaatcgtgatcgtaacggtattcggcttattcccgattgcagtgcagacgattcgtgggcttgaagcggtcccccagttttattcggatgttgcgctgacttgtggcgccacgaaagcgtggacactgtggcatgtgaagctgcgtgtggccgctcgtcagatttatggcggcatccgcgtttccgccgcatacattttcgccaccgccgccaccgcagaatatttgggcgcgcgcaaaggtcttggcatttggctacaggccgcctacaactcgttccgcacaccgctgatcttctcggcgacgctggtcatcatcgccatcaccggcgttctggtgtgcctggtgaacctcagcgaacgcgtcctgctcggcccagctgatgccgacgccgatcccgatgcagaccagtaagtcaaacacgccaaacatcatcggccttctgcaaacgcagcattcgcagcattcgccactccgcattgcatgtcggtcacgctgcctacgtataataaaatccgctgttaagccaatgtgtggcaaaccggcaatattccacgcctttcactaggcaccgtaaggaatgtcgggggcattggacgagcgggggcctgaggcccttcgtatcgttttctgcccgaactccgctcgcagcatatccctagaaaacgatagagaatacagattcaagggaaatcgctttatgagcatcttcagcaggcatgacgccaccgcacgtactcacatcgcaagcacaataatcgcactcttcagcgcaatcgccatgttgttcagcgttaccgcatgcggacaaagcaacgattccgcaacaagcacagcatctggcagcagcgatctgaccaaagtgaccttcatgctgtcctgggcgcccgacaccaatcatatcggcgtatatgtggcgaaaaacaagggttatttcaaagaggcaggtcttgacgttgatatcgtggccgtggcacaggccggtgccgaacaggccgtgaacaacggcgtggccgacttcgcattgtcgaatctcaccaacgtaagcacgtacgctgttaagggcgcaaccatcaagcaggtgctgcaggtacagcagaagccaagcgccatctggtgttcgctcgcttccaacactgaaatcaaatccccgaaggatttcgacggcaagactttcgccacgttcggatccaacgaatccgatgcggtgatccgtcgcatgattcagtcggacggaggtaagggcgaattcgacaaggtgaccgtcggcacgtccacgttccaaacgctgtccagcaacaaggctgatttcggtggtttctatgccacttgggagggtgtgcaggccgacatgtacggtccgaagctcaactgctttaccgaaccggattacggcgttcccggcaatgccgacaccattggcgtgatcaccagcgacaagacgatttccaacaatcccgaactggtgaagaagttcgtacaagccaccaagaagggctacgagtacgcatattcgaatcctgacgatgcagcgaagatccttgtgaaggaagctcccgacgcgaatctcaagcttgatttcgtcaagaaaagcatgaaaaccattgtggacggtcagtattggggcgatcccgccaagatcaaggatggttcgttcacgttcggtacgaacgacgttgaaggcgcccagcagtatttcgacttcctcgctcaggaagacgcctacaccgattcgcatgacaaggtggtgcacgacgctccgcaagccaaggatctcgccaccgacgaattcctgaaataatcgggtttgaacgagtaggtttgtaacccgttcaggtacgaataatcgaaaatattggaatacggcatcctgcatttttatttcatgcccaacactgcttgctcagttcgggttgaacatggtttgtgggatgccgcaccattatgcgttgcatttggcttcattgcacgagtttgattaaatacaaatatgacacgactgattcttgatgtggacaccggtatcgacgatgcactggcgttggcataccttgcgacgttcgacactgttgacgtgcttggcgtgatcggcacgtacggcaatgtttccgtcgacactgcggttcgcaatacttcgtatgtgctggaacggttggggcttcggcacattccggtgatacgtggatcgtcgcatccttcatgggctcggtgtttcattccggatgcaggttgtgcgcagtttcacggcacggacggattgggaggattcggcccggcttgcgatagttcgtcttcggatactgctttttcagatattttttcggataattccggttctgatactgttttttctcgtgattatcgtagtctgatttccgttggcggatatgcgttggatgatgttcatgcgaatcctgcggttgattcgtttgaattgtcgcttactacggattcggcttcttttattcatgctgatgattcttccgccgactcggtttccgaaggcgtgcagttcattattgatcaggttcgcgcttatggtttcgacgtcactgtggttacgaccggtccgctgaccaatattgatgctgcgatcgcggccgcaccggatattgccggcaaactcaaactggtgatgatgggcggcacgttgacgcaggaaggcaactgttgggatctgactgcggaaacgaacatcattcaggatccggaagccgcagatcgcgtgttccattccggtgccgacatcaccatggtcggcttggacgtaacgcttcaatgcctgatgggttccgatgcgacccgtgcttggcgtgaagcagcgaatgctgacacacttaccagctcgaccgcatcccaagtcgctgattcacttgatggttcagctggtagttcaaatgcagcttcagctcgaacctcgagtgtggctgcaagcccatctgcttccgatgtgcgcgtattcctcgccgacatggctgatttttccattgccgcaaacctcaaggccgacgcgcgactgttttcacagggcatgccattacatgatccgctggccgccgccgttgccgtggacccgtcgctggtgacctgtatcgacctaccaatgaaagtcgaactcgaaaccggcgatttccacggcacccgaggccgaaccatcggcgatcccgccggactgatcgactccaacgcaccccgcatccacgtagccttccaagtcgactcctcccgtttcgtccccaccttcaccacccgaatcagcacgttgtaacaaacaaaacggggagaacattatgttctccccgcagttaacctaatcaactcagcaaaaactactttttgacgccgccgaaacgacggtcgcggtgaatgtagtggtcgatcgaacgccatagcacgtctcgaccgcaatcggggaacagttccggcacgaaatcaagttcggcatatgccgcttcccacggcaggaagttcgacgtgcgctgttcgccggaagtacgaatcaccaaatcgcaatcaggaatatcaggattgtacaggtgctcggaaatcattttttccgttacgcgatcgccggagatcttgccgtcacgcacttcctttgcgattgccgcgcaagcatccgcgatttcggcacgtccgccgtaattcaggcagaacaccacgtcgatggtcgtgttgtttttggtacgttcctgtgctttttccaattcgtcgataacggatttccatagtttcggacgtcggccggaccagcgcacgcgcacgccccacgcgttcatctgctccacacgacggtggatgatatcacgcgagaagcccatcaggaagcgcacttcctgcggggaacgcttccagttctccgtggagaacgtatacagcgacaggtaacgcacaccggcttcgatggcacctgcgatggtgtcgaacaccaccggttcggcagcctgatgcccgtcggtgcgaatcagcccacgctgctgcgcccaacgaccattaccgtccatgatcacgccgatatggcgcggaaccttgttcttcggaaaatcaggaataatcgacgggtcagaaaatggtgccgccggaatgtcaagggacttgtaatccacgttctcaaaagccatacccgctaatctagcaagcgcatggaacgaatcggacgttccaaatagtattcaccccatttttccaccatttgtcgggtttccggaagcaacgccgtaccgtccagctctccccaatcgccgtctacaagcgcctgcagctggcagatcgcattccacgaaacatcaaacgattcacgaatatgatcggtcaaacacattagtccgcccgcggaaatcgaaaagaaccatggacgatcagcagaaatcggctccccgcacaccacgcaggcacgcaaacgcggcgtccagccagcgatcgcaagagcacgcatcacgtaggaatcgccaatcgcagcagcctcatgcgcatgcttggaaagggcattcaacgctcccaacaccagccgatactgtgccacggaacgctcctgctccgtcaccaccagcttgtcagcggtttcgcaaatcacattcgctgcggtatacgccttgaaatcggtgcagatgcctctcgcatacgccgacaccgactcggcttgggaaatcacatcaagcgaacgcccttccgcaataagcaacgagacgcgcatgaaaggctccaaacgacctccgaaacgcgatttggttcgacgcacacctttggcgacggcgcggattttgccatggtcacgtgtcagcaaagtgacgatacgatcagcttcgccaagtttgacggtacgcaagaccacgccctcgtcctgatacaacggcattcacacacctccttcgcctcgactcgttttcttaactgaactatctatactttccgcacgttctcgcgccagccgcactctcccgcgatatcagtaaataaacaatccccagaacgcgaacaccaacagcacatacagcatggtgaccgccgtgatccaaaacatcacacggccgaacctcgtcgacgcgagcaccggctggcggccactcacaatcgcgcctatagcccccttacgcggtggccattgtgcaaggccacgattcgtcgcctcctcgataagacgcacgaacacgcgagaccacgcccacaccacaacaacacacaccatttgaataaccggccaactccaatacatcatgcccggatcctcggcgggagcgccaccccacgctagcttgaccacgcccataaccacttcgcccaatcctgcaccaaacagcacaaaagtggccatggtggcaacggcaagcgtaatcaacgcatttttgaacacaggtctcagccccaacacatatcggcgtcgatgcgcatgcgcccaaatcttacgtacgagcacaatcagccacagcacgccgatcaccagcagcaacagcaccatgctggcatgcagcaccacgagataaatggtcagcccgctgttcgcctgcaattccaacggcaccgcaatcgactgatacaagttggtaccggccacacgctcgctggtctgctgcagtccccgcgtgatgccgacagcccaactgattacatcatccacgtaggcgtcggcgaacggagtgccgctgttggattcgtcgccgagtcggagcacatggttggcgatggggtatgtgcgcacggtcacgtcccaattgcccgccttatgcgccatgtcgatgattttctccgtaccttccacctgcgcggtcatcacgtctttggtgccgtatgccacaagcgtgggaatggaataggcttggggattcaacgtgtcgaggtcgagattggtcaggccgaacaattccgcatcgatgttgaacgcgcggcgcacaatggactggtatccatcatgcgctccgaccagcgcgaaatcctgtgcggcaaggaatcccaacgaatgtcgtggcgaatacaccattgggctcagcaacacctggaatgccacgtcggggtcttgatcaagcagatatgaggaaatccaggtgctttcggaagtcgcgtaaatgccgacattcgaagcgtcaacgttgtcgagatcacgcaacatggtgatgacctgatcgtaaatggccgcggagcccgggtaatcacgggtcgcatcgttggtggaccataccggcttgtcgagcacggccgtcacgaagcctgcggatgagagatcggtggccatgtctccaaatgagttgtcacaggtgccatatccggcaccatgcatgaacaccacgccgggccgattgtttcccgcgtctttcggctctcgaatcaacactttgacctgttgtatttcaccggttgacggctgtttcgcctcaatggtgacatatcgttgcgtcacttcgtaatcgcctcgtttggcaagggttttgccggaaggattatcgaaggtcactgccgtgtcggatgataacgtttcgatggtttgaccggttggctcgtactcccatgacgatgccgtcaaattggataccgacaccagaatgcccagcaggatgatgaagataggcagactgaccatcagccgtctgcccctcgtccactgactggattggctctccgcgctggacatgactgactgacgttcctgatctgacacgccgttcattgtaccgactccagctgaaatggcaatcgacaaccagcaaaaccagcgggcggccgatcacaatctgcaatcgaccgcccgcggtcagcgaaatcaacaattaccttgcgccaccggcaccaccaccggtcctgtggcgttgacgggcacctgtccgtccgcttccatctgcgcggcgatctcctgcgctttgaccagcagcgtttccacaatctggtcttccggcacggtttgaatgactttgcccttgatgaaaatctgtcccttgccgttgccggatgccacacccaaatcggcttcacgggcctcgcccggaccgttgacgatgcagcccataacagccacgcgaatcggcgcggtcacatcctttaaaccttcggtcaccgcattggccaactgaatcacatcaacctgggaacgaccgcagctcgggcaggagataatgtcgaacttgcgcggacgcaatcccatgtattccagcagcttgcacccgactttcacttcttcgacgggcggtgccgacagcgaaacgcgaatcgtgtctccaatgccttcagccagcagcgcaccgaatgccaaacagcttttgatggtgccctgccatgccggtccagcttcggtgacaccaagatgcaacggccaatcacccttggaagcgagcagacgatacgtttccaccatggtgatcacatcatgatgcttgacggaaatcttgaaatcatggaagccgacgtcttcgaacatgcgcgcttccttcatggcggacgcaaccagtgcctccggcgtcggaccgccatatttcgcatacagttccttatcgagcgagcccgcgttcacgccgatgcgcaacgaaatgcccgcgtccgtggcggctttgcaaatggaagggccaacctcgtcgaatttgcggatgttgccggggttcacacgcaccgcagcgcagcccgcgtcaatggcctggaacacgtatttgctttggaaatgaatatcggcgatgaccggaatcggtgatttctttacgatttccggcaatgcgtcggcatcatcctggctgggtacggccacgcgcacgatatcgcagccggctgcggtcagttccgcgatctgctgcaatgtcgcgggaacattggctgtcagcgtattggtcatggattgcaccgagattggcgctcccccaccgactggaacggggccgaccataatacggtgcgatttgcggcgcggatgcagcgggctttcgctaatggctgcctcaccggttttacggaacggcttttcgatttctggcatacgtcaaatccttgcaataacaaggctcccgacttagggagccttgcgtcacttacgtttcgtctgtttgttttgtttcgttttccgttacttgtttatcaggtcgtcggctcgacgacgggcttccagctcgagttggctcatttcctccacggaagcgaatagcggattgccgcgcagttccgcatccatttcgtccaacacttccttgacggtatcgacgatgccgagatatggcaagcgatgttcgaggaaggcgtgaacggcctgttcgttggcagcattcagcacggccgtatgcttttcggaagcttccaagcaatgtcgagccaagctcactgcggggaatgcctcatcgtcaagcggttcgaacgtccacatggcggctttcgtccaatcacaggccgctgcgatgttgccaagtcgttcgggagccgataggccaagcgcgatcggcagacgcatatcaggcggtgaagcctgtgcgatggtggcgccatcgcggaattccaccatggaatgcacgatggattgcgggtgcacggtcacgtcgatacggctcggaggcacgtcgaacagacggctcgcttcgatgacttcaagccccttgttcatcaacgtggacgagttgatggtcaccaccggacccatattccaagtagggtggttcaacgcctgttcaggcgtgatgtcggtcatctgctcgcgtttccaaccgcggaacggacctccggaagcggtgaccacgagtttcgacacttcaccgtgcgtgcccgaacgcaacgattgccagatggcggaatgttcggaatcaaccggattgatctgctgcgcacgaacctgtgcgtcgaacagcagatgaccgccggccacaacggattccttgttggcgagcgccagctgcgatcctgcctgcagtgccgcaatcgaaggttcaaggccgatggatccggtaatgccgttcaacaccacgtcggcaccggatccggccatggcgattaccgcttccggcccggccatgatttccacatggcttgcgccggcttggtttagcgcatcttggagcgcatggaccgcgtttgtgttgaagatggcgactttcgaaacgtgaaattggaccgcctgttgggccagaagttccacgtgggagccgcctgccgcaagtccgaccacgttgaaacggtcgagatggcgggagatgacgtcaagtccttgggtgccgatggatccggtggatcccagaatgactacggttgaggtttgcatgggttatgcgtgtgctccgtatttgttttggattattcgtgtgaacgcgaaaacaggctgacggtcacgtcagcctgttcagtgcgattgcctattcaaaagaggggaacgacaggtcgggaatatcgacatccagattgctgttggatgcttcgaacatcggattggttgccggcttggtttcgttcttcttctcttcctctgccggtttcgccggttcaacgggagttgccgttgtcgagtgatctgcggaggttgctggttccagcgtgaaggagggtgggacggtcggcaaggttccgagattaatcgagtcggtattgacctgcggaaggttcggcgtcgacaggcttggcatgcgcggagtgaacgtgtcttcgaccggatcgggagcgtcgatgttctgggccatctgcgccaaggcagccaacgaagaatcgggagcgatgttgatgccgtgagattcttccggctgatgtgcgaccgaagtgtctggaatcacaggagccgcaggcgcggccggagcgtcatagctcagcgcgccatcatcagaaagcggattgaacgcttcggtttccgttcctgcggaagatggctcctcggcaaccgcattggacgctttgaacaggtgtgccaacgactgttccggagccgctggagcaaccggagcggcctgaggttccggcgttacaggagctgccggagttaccggagccgacggggtgctgatggttggctggaacacaggcggaaccacgggagcatacgtcggcgcagcggtttgagtggccggaatgctcaccggggacgttgcaggcgtggtgaaaatctcacgttccgccttattcaaagcgtcgaaggagtcagtgctgttttgaacctgagcgggctgcgcaataggttctgcggaaacggctggaacggcgaataacggcgagaccacctgcgtctcttgggatgccagactggttgcggacggattggctgcggtcatcgcgctttcggagggctcgcccacgaagtcggccacacgagcataggattcgagtctggtcagcagctgcacgcattcgttcaggtaataatccacctgacgctcgtcatagccacgcttgcccttgcgctgggtgaagatcacattcgccacggtctgggagttcagatcgacaagtttcttggcatcgtcttccgacacttcctcaacgccgagctcgccagcggccttcgtcaggcactgatcgacgatgcgatccacttgcttgcggtcatagctcggttccttgccttctcctggcttgaaacgttcgccgtgctcacgtttggaatgggcgtcaagctggcggaacagactttcggtctgcgctttccacgccacacgaccgtgctgcgaaatctcccatgtggtctgcttgtccaccacggcgcgctccaaacgagcaagggccgcgtccacttgggcgatcacatagccgcctttgaccaaatcgaaagaaacattctgaatatcatgctgggtgagttgcgctccctcaccttcgtacagcatgtgcgcacgctcaagaaaagcgtccacctgttcggaatcatacccccacttgcgctttgaagtacgagcgatccccgatgcgttcctctcggattcaggttcctgcgccattggctatcgacctcctactgcactactcaacgtccccactctacgtgattgattcgacgcttttggctttcttgtggaaaattcagcgaatcgacactcaaatcacaccatttttcacgcatttactatggaaggaacccctattgggcagcgcgacacacgttgaagctgtcgcaggcaacgaatactgtacagtggagctttgcgggcgattagctcagttggttagagcgccacctttacacggtggatgtcgggggttcgagtccctcatcgcccaccttttgtttccgcaaaaataagccgttccgactcttctgatattcccaactatctcgtgcgcgtgtcagcaaaatcatgacttttgtcaatatagacaatttcatggaaacatcttcttcgactgcttccgcaagcaaaaaaaggctcggaatcgtgtgattccaagcctttatatgagcgcccgaccttggccatgcgtgccaaggcaggtaaaacgaatacgatcagcggcctttgccgaatgcgcgcagacggatgccgttccagtcaccgctgacggtcagcggcgtggctgcattcatgccggcggtcttcgcggcggactgcacggtgcttgaacttgccgcgcccgggcgccccggcttcggggtgagcacccacaatggaccatcgtctccaaggaccgcatacgcatcgacgatggtgtcagacagttcgtcttcgtcatcgccgtcgcgccaccagataatcacgccatcaacggcggaatcatagtcctcgtcgaccagctcttcaccggtcagctcctcgatcttggcgcggatcgagtcgtccacatcatcgtcccacagccattcctgtaccaggtcgccggcgtggaaaccgaattcttcagcgttatcagatgccgtttgattcacgttcgtcaatataccaacactgctcgaacatatacgttacgaaccgtggaattgctcactttgcgagattgttttttcttatatctcggaatgcgtcactctcccgcggagcattgcggcagggatgcacccttgccgtctcggacggcaaccagcgcatcgtacgcctcctgcaaagtggacaccttcaccacgttcaaaccttccggaatatgatccacaacgctggaacaattggattccggggcaaggaaccaagttgctccgtcgcgtttcgctccgagcatcttcaaacggatgcctccgatttcaccgacttcacctttgtcgttcatagtgcccgttcccgcgatgatcttacccccagaaagtttttcaccggtcaccttgtcgatcagaccaagcgtgtacatcatgcccgccgacggcccgccgatgtcgtccacatgcatggacaccttcatgccggacacgtcataaccatgctcttccaggaactttttcgccgctgcggtggcggaatcctgcgatgacgtcatctccttgtcgctggactgcttgtattcctctgcggtctgcccaacaggaaccaccgcttcctgaggcatcaccgtggatttcgaatcggcccacgccaccaatgcctgcgcgttcgacaccgggtaccctggcacgcctgaagcattgaccgtgaccaacagcagttggcctgaatccttatacgttttcgcaccggaaacggcgatgacctgcttgccggaaacctccccgagcacattctgtgtcgggccgggcacctgcaccacatacgcgctgggcataatcaacaccaatacgcacagtaccgccaccaacggtcctgcaagataacgccatgaacgcgcggacagccaaccttccgcgcctatcagccatcgtttgacacgtcccggagcgccgctacgtgtgtttttgccgtgaattcgtcgtgtttccttcatcttgggcatacctcccataacatagtatggaaccaaccaaacttgaaaaaacgcttaggaaaaggcagggccggcatggacgagaacgcgatccgccaatggtttatcgattgtttcggaccaattcaaggcgagatggcatggaaccagttttccaacatgccggaagagttgcgcgaccagttgatgagtcaggatgtgagcaagcttcccaagccggccgaggtcaggtcgatgatgcaggcgttcactgcgggcgggctcaacactttcggagacatccagcacatcaccgaggaaggtccaatcaacgtcaaactggcgaaatcattggcattgcagcaggccaatggcgaaggatcggaaaccagtgtgagcgcggagtacggcgagatggcccggcgagccatcagcgaggcgaatctgtggcttgacaccgcttgcgaattcaaccccgcgcaaggcgaaacgcaggtgcttacccgcgcaggctgggtggaaggatgcatcgattcctgggcgcagtttgcatccccgattgccgagtcgatgagcgacgctctggcttcgattttgtcacagcgtttcggcgattccgaattccatacggaaatttccggcattttcgccggtccggtgcagattccgattcccgatgatatgaaagatccggcaaaactcatgcgtttcgtcggcaatacgtcgttcgccatgcagctgggacgtgccgccggcgatttgtcgcatgaggtgcgcggcagtttcgaccaaagcatttcgttgctgaagaatccggctggaggcctgatcgtgcagaatgtcgtcgaatatgcgaaatccttggaaatcgacgtgaacgaagtaatgagctatcttgcactgcaagagctcgcccattcgcgcctgtacgcttccgtgccgtggctgatgccacgcttcgaggcgctgttgggcaagtatgcccgtggcaccagcatcgatttggacgccatggaggagcagatccgcgatgcgcagtccgtcgacccggattccatggccgacgcggtgaacatcaccaaggtggcgttccctgacacgcctgaacaacagcaggccatgaaatcgctggagaatctgctcgccttggtagagggttgggtagacaccgtagtgtggcgcgccggcatggctcatattccgcatatcgaacagcttcgtgagatgctccgccgcgagcgcgccatcggaggtcccgcggaacgcaccttcgaaagcctgatcggcttgcaattacgcccgaagcgcatgcgtgaagcggccgcattgtgggataacatctgcgctacggaaggcgcgcaggcacgagacgcgaaatggtcacatcccgatctactgccgcaactgccgaatgatgacgatgacaacacctcacagtcgcagaacaacggatcgtcggaaaacacggaaaatacgacgttcgccgcttccaatgccaccgatatggcgtcgcagccccttggcgacgccgatggcatgaccatcgattgggatgccgaactcagcaagctgcttgacgaggaagagcacaagggcggcgaatccgataccaatggcagcgactctgacgattccgcagaatccggcagcaacaacgataccgacgccgagtaatcgcgctattccgttcgcagtatcagcggaagaagcgcgacacccgtcgtgccctttcaccctcattgccttcacgggtacgcgcatatgagacgtcaagcgtgtcttcggcgcgcgtcacggccacatacatgagccggcgttcctcctcaagcacgtcgtcatcctgcggcaacccatacggtatgagtccttccgagcagccgataaggaacacgtgcttgaattccaaacctttggacgcgtggatagtggaaatggtcacgccgctcagatccgcgccgacgcccaatgcctccaacatggccagtctggtctgcgtgtcgtcggaaagtgcggaattctgccatccgctatccctgcgcacgcgatatctcaaatgctgttcggccaatgccttgcacaggattttctgctgcgcgttgactctggtgagaatcgcgcaatcggccggcgactcccccgcatccaccagtttgcggatgcgcgccgccacaccttgcgcttcctcccaatcgctgccatatatggtttccacgaccctccgtcctttgctcctttcagagctgagcttcagataatcggcccgttgcggcgatgccgcaagcacacgattggcatagttgacgatctgcggcgtggaacggtagtcgttgttcagattgatgtcagcggtgagcggaccgaattccgaatcgaagttgagcagactgtagctacttgcgcccgcgaacgagtagatggtctgcgccggatcgcccaccacgcaaatattgcggtttgagccgagccatcgggtgagcagacggtgctgcaatggcgaaacgtcctggtactcgtcgacggtaagccatctgatgttggagcggatagctgaggccacttcctcgtcgctttccatcagatgacaaacgatcagcagaatatcgtcgaaatcgatttcgttgcggttggttttttctgcctcatacgctttgtatacgtctacgaattggcttggttcgaggcctgatggcggctgtcgatgcgttgccgcgcaaacccgcgcgtaatcttccggtgcgatcagtgagattttgcaccagttgatttccgcttgcaagttacgtatggtgtcgtcatccacttggaaggcggtgacgcggcgcagcgagcgctccaccagttcacgtggatttctggaaatgaacggcatcggcccctcgcatacgtccggccacacttggcgtagctgatggagggccgcggagtggaaggtggctgctttgacgtcggctgcgacatcgagtttcgataggcggctacgcatttccgccgccgctttgacggagaatgtgactgcgatcgtgcttcgtggattccacgctttggtggcgcacgcataggcgattctgcgggtaacggttcgcgtcttgcccgcgcccgcgcccgcgatgatgcgcactggaccgtccacggccgttgcggccgccctttgcgcctcatccaatccgtcaagaatctcttccgctgttgcactcatacgttccattgtggcagattgccgtcgccatgtgacgatttgcccgcggttcacctgcagttttactggcaagtcggcaacgcttcgcccctattgtgtattaaggttggaattgtgaccgaacgaagcaaatttatgatagctgccctgacgagtgcggcgatgccgaacgccgccattgcgggcgcgcgtgccagcgaacagaccaacccgaccgacgaggggtacggcgtcgaccatgccgtggttcaggatgcagcgggcaagctgtatgacgtgttcgcatccaacacgcctgaaggccgtaagcgtcttgccggtcgcgtgcgcgctgcgcagacgctctcgcaagcccgcgaattaggcggattgggttttgccgtcgatagcatagtagctttttcaaacggcgatttgaagcattccgccactggagatacgtccgtgctggtggccacccaccatgtgggtcaggcgcggccgttggagctgctgactttggatgattgttccagcgtaggcaccgctttgggcgcgattcatcgccttcgtcccgacttcctgcaggaagcgggctatccgacgtttgtcaccggccagattcgcgctcagctgaccgcttggatcaagcgcctgcgtcaggctggtcatgttccgcaggagatcaccactagttgggcgaatattcttgagaccgacggcctgtggtcgttctccacttgcccggtgcatggcgggttgcgtgacggcgatgtgcttttttccggttcctccatcaccgcggtcacgaattggcaggatatgcaggtcaacgatcctgcccgcgatttggcttggattttcgccaagcttgacgagaaccaccgcaatgccttgctttccgcatacggtcgcatgttgggcaatcgtttggatgatctgattatgctgcgggccaatctgtggctgcagatggagcaggtcggcgattttatttccgctttgaacaaggcagacaacgccaagattatgcaattcaaggcgcaggtggaacgcctggcccaccagttgggtgtcgccacagcgaagaatcgcgtgcaaactgaaacgaagcaggagtccaaggatcgcccccagcgcccgccgagcacaatcaccgtaggcacgttgctgaacgaatcggagcgtcgccgtaacgcggccgcacagcagaatgattccgacacgaccggcgaacgtcatgttgacgctgtggatatggatgattccactggcgatttcgacgtgaccggcgatttcgacgtgaccggctcccagccggtccgcaagacgaaggaaatcgtcaacgacgcgacggaagcgttcgtaccggccggagcccagccatcacaagcaccgtccggcaatacgaatgaacatgaggcgacctcggtcagcactttcattccggaacattccgcaaaagaacggcacgaatccatgccgtcaagttccaccatggtaatcagcaggctggaaacggccgacgacaacgacgatacgaacgaggaatcgattcccgcatcgcacagcgaggccgcgacagtactcattccactgttggagcgagatgaggcgaccatgcagaaagcgcaggcgcagatcaatcagtgggaggcggaagacgccaccgatgagaagctacgcgtagaataggcgcacataacccgtacatacacgtgcgcatgcattgcgcattatcacgaaggagcatccatggatattgaactcggcattcagaatgtggcccgcaccgtcaccttcagcaccgaacagagcgccgatgaggtcaacacggccatcgccgacgccgtggagaacggcaagaccatcaatctgacggacgacaagggccgtcgcatcgtggtgccggcaggctcgctcggctacgccatcatcggttccgaaaccaagcacgccgtcggtttcggcaacctctgacccgttcgcatcaccagatttcagcttcgaactgaaacacacgttttcgacgtcacaagaaaagccagacgttcacgtctggcttttccattttgggcgatcaactcgttcctggtttcatatcgcgattacgcatcgatgattgcgtttcggttttttattttcgccttcgacgattctttgctcaagtgaacgcctcgattgatgatttcctgaaccgtttcgtcgctggtgaggttctcccccagcgcgttcggcttgcctttgccgtgccagtcggatccgccagtcaccagcagatcgtgccggcgcgcaatggtgagcagacgttcacgctgttctgatggattgccgcgatgccacacttccaaaccgtccaagccttcggtgatgagagattcgatttgccggtcggtcagtaatgtccgattgcgccgggggtctccggcgtgggcgataaccaccaccccgcccgcacccttgaccgcggccaccacgtcgtgcgtggtcggtgatggcgtgggaatgtaatatttcgacgttgcgctcaccgcatcggcgaaagcgtcggatcgtgtttcatatacgccggcagccaccaatgcgtcggcgatatgcggccggcctatcgtggtgcgtttgccttcacgcacctgcgcgagcacatcatcccacgtaatcggaaaatcctgcgccatcagttcgaccatgcgcttggttctacgcagtcgcgcctcgcgggtggacgcgaacatctcgctgatatcggcgttcagcggatcatattggaatgcgagcatgtgcacggatacgctctcatcgacggcagtgatttccgtaccgcgtaacaacggcaatctgacctcccgcgaagcagccaacgcatcctgccaaccggaggtcgtgtcatgatcggcaatcgcaacaccatgcaatcgcaatgctctcgcttcctgcaacaacgcacgcggcgtttccgtaccgtcggaaaaaacggtatggcagtgaatgtcccaaccttcagcgggcggtgccgcagtgcctacgcgaatcatgtatccatcgtaagctgtttttggcgcgactcggcacaataccgcgtaaactaggcgatgacaacgtttgtattttgattcaaggatgcacgatgagcgatttttccggcgaacaggttgccgaagccactctcgacgatgattatacgaagccgcgcggttggcggcataccgcgacatggacgtatctagtcatgctgatcgcctcggcggtagcgctggtcgtatcgttcgtgctttccgccgagacactgaaaatggcgcgcaatcccggtcagaagctcagctgtgatgtgaatgccgtgatgtcgtgttccgcggttgcggaatcgtggcaggctgaggttgtgaagttcgccggtttgagtttcccgaatgcgttcttcggcatcgccgcggaatcagtgttcgtaacgatcgcggtgatcggtttgacgaaggtcgccgtgccccgctggtttgcgtcgtgcacatggctgggtggattggccgcgctggcttattcgtattggctgacctcgcagtcgttgtttgtgatcaacgcgctatgcccgtggtgtctgtgcctgatgttctccaccaccgtgcagttcatggcgttgtctcatgccacggcggtggttcaggagattccggccaagcgcgagggcgtacgcacctactaccgtcttaattacgatctgatggtcgatgccttatggatcgtgacattgattgtgatcattctcgtcgaagacggccccctgctgttcagttgacgtcaagtaacgtccaatcagcagtagggattcactcgcctacaagagaagccgactggaaacagccggcttctttcttttgcgtatccgcaaatttcagtgttatgcgcaaaaccttacagcagttcgattttgccgacgatggtggccgatccggtgagtttcacgtcgttatcggtcacgtcgacgcgcagggtgccgccacgcacggtgatcgtccaatggtcgatgccggttttggcacgcaacgtgatggcggtggcgcacaggccggttccgcacgacagggtttcgccgcagccgcgttcgttgacgcgcatggtagcgttgccctcgttgtcgccttcgctttgctcgtcgatgcgcacgaactcaacattctggtcgctttcgattcggggcgcgaccaccggcttggtcaccaaatcaagctgttccaccgtcggcaggctggagaacgcgtcttcgatgacggccaccacatgcggattgcccatgtccacgaacgtgccgcgtgcggaaccggccgtgccgggaatcgtcacttcgtatccatcaagatcgccacgcttccatgaacccatctcaacctggaacacgtccttgccaagagtcggcacatcgccaagtgaagtcagaaccttcacaccggcacgggtgccgagacggaacggttcaccgcccggctgaccggcaataccctgccgttgcgcgaacagagtgatcgcacgcgtgccgttgccgcacatctcagccaacgaaccatccgcgttgcggtagtccatgaaccaatccgcattgtcggcagcacaaacggcaatctgcttgtcgttcaaatcggacaccgcctgcggatgagtaaggcggatcaagccatcgccaccgataccgaaatgacggtcgcacaggaatcgcacttcatcggcggtaggctcgtacgtgccttcggcgtccagatacaccacgaaatcgttgccggtggcgtgcgctttgtaaacaatgcttggaatgctcataccgattcactctacacgcggtaggctattgaagaagttggacgcaacacgtgtgcattatgttgcagtatgttggcgtgcggaacaagggaggacgtatgacttcaacggcaccaatcggcgttttcgattccggtttgggcgggatttccgtggcgcgcgaaatccgccgcgatatgccgaacgaacgcgtgctgtattttggcgattccgcgaacgctccgtacggaaccaaatcacctgaacaggtacgcaagctgtccgacgccattgtgaaacgtttcgtggagcagggagtgaaagcggttgtcatcgcttgcaataccgccacttccgccgcagccaacgagttgcgcgacaaatacgacattccgatcattggcatggaaccagcgctgaaggtggcgtgcgatcgaggccatggcaatcgtcagcgtgtcatcgtcgcagctactcccctgacgttgcgggaacgcaagttcgccgtgctgatggatcgtttcaaaacagaccatacgatctttccggaaccctgccccggtttggtggagatcgttgagcacggccaactcgacgatcacgatgttgtgatgcacacgctgcaccagtatttcgaccagtatgatttgtcgacgatcgattcggtagtgcttggctgcacgcatttcgtgttttaccgcgactatttccgcgaactgctgcccgacacagcggcaatcatcgacggcaacgaaggtaccgtgcgccatcttggcgtagtgctcgaatcgttgggcaaactctctccggaagacgcggacggtggtatcgagctggccaattccgacacttccacacaaatcgcgcaattagcgcaatcgctgcttgatcgctgagcgcgaatgttccgatagaccgcgtaaagtcgattgaaacccgcaaaaactgctcaaccgttatcagacgtacaacgacgaagtggcgctggccaaggaatacgagcaggacggccgcgtgctcatcctcgcgccggaaagcctgtacggcctgaacacgttgagcaagtcgttcgaaggtttggaacgcatgtaccgcgcgggctatgcggcagtcgaggccatccccgcattcctagaaagctgaagataacgtccatatccaacgcctgccagcggttcgttttcaaattgagacatgacacgaaaattttataaaactctcatattatgtcctattgttttttcgtcgacataatcggcggaaaagtcgacattaaaggagaatgaaatgaagaacaacacattccggcgtctgctggccatggccgcggcgggtgccatgctgacgtcgatcgccgcatgcggatcgtcttccaacgatgacacagcctccaacggctccgatagcacctcgctgatttcagtgaacaacagcgaaccgcagaacggtctaattccaagcgacaccaacgaaatgggcggcggcagagttattcgatacctgttcgaaggtctggtgagcttcgacgcaaagggcaagcaacatctcgaagtcgccgagagtatcaccccgaacgaggatgccaccacgtacacaatcaagttgaagaaaggctggaagttcaccaacggcgaggcggtaaccgcccattccttcgccgacacctggagtttcgccgccaacgtgaagaacgcgcagaagaccgcaagccgattctccaccatcaagggctatgacgaactgcaggatccgaacgtcgatccgaaggccacactttccggtctttccaccccggacgactacacgctggtcgtcgagctgaacaagcctgattccgtattcccgaccaagctcgcgcaccaatccatgttcccgctgccaagcgtggcatttaaggacatcaagaagttcggccaggctccgattggcaatggtccgtacaagttcaagtcctggtcccacgacaagaacatcatcgtcgtaccaaacagggattataagggcagccgcaaggtgtccaacaaaggcatcgaataccgcgtctacacgaatgaggattccgcttactccgacgtgctgtctggcaacctcgacgtgatggatcagattccacagtccgcggtgaagaccttccgtcaggattccagcgtgatcgcctacagccaggcaggatcctcgttccagtccttcgtcattccggaacgtcttgagcatttcggcaacgacgaagaaggccagttgcgtcgtcaggccatttccatggccatcgaccgcgaccagatcgtcaagaaggtttacaacaacacgaagaccccgaccaccgatttcacttcaccgctcgtccccgaatatgtgaagaaactggaacagaacggcagcaacctgaaatacaacgcttccaaggccaaggaactctggaagaaagccaatgccatcaagccgtggtccggcaacttccgaatcgcctataacgccgatggcggccataaggaatgggtcgatgccgtgtgcaaccagatcaagaacacgctcgacatcgacgccgctggcgagccgtacgccacgttcagcgacgtgcgtaaccaggtgaccaaccgcaccatcaaaaccgcgttccgtgccggctggatgctggattacccgtccgctgaagattatctcaatccgctatatgcctccagctccgctgacggtcatggttcgaacgatggtgattacaagagtgcggaattcgacgagctcctgaatgccgcacttgcccagaccgacgtaaagaagcggaccgaggacttcaccaaggcgcaggaagtgctggccaaggatcttccggtgattccgctgtggaacgacaacgtcgccgccgcgtccgcgacgaacgtgaagaacgtgtcgttcgattacaccaatctgcctacctacaacaccatcactaagtgatgtttctggccggcggacgaacgattcgccggccagaaagggagctaaagcacagcggggttcgaatccttcatggattcgaaccccactgtacttttgtggcttgttttgccggtttgccactacagcatcaactctgcacgtagctgcccttcggagacttccaaccgcagttcatcatctcgctattgaacaccattgcgccttcaccatgagccggaacgacgatcataccgccatctccatgatgacgggcgacaccatccagcgccgccttcgcagcctcgatcggctcctccttggcgtacagaacacgatcggaaacctgatgcgcagcgacttccttgacgaacgcttcaccgatgccggtgcaggagatcgcgacggaatcgttgttggcataggtaccacagcccggcagaggcgaatcgccgacgcgtcccggcatctggttggtgatgccaccggtggaggtgccggcagcgatgttgccggacgagtcacgggcgacagcgccgatggtgccatgcttctcccattcatcgccgttggattgcgcctcgcgcaaggattcctgacgtgctggagtgatgaaatattcactgtcgcacagttcgattccccactccttgagcaaatcattaccgggcttggcaaacatgacatgcttggtcttttccttgatggcacgcgctacgttgatcggattcttagacgtggtcagaccgcacgcggaaccaacctcgccatcgacaccagtcatcaggcaggaatccatggatacgatgccttcactcgtcaatgcagcgccacgaccagcgttgaactccggagcatcctccataacacggatagccgcgcacacggcatcctccgccggagccccctgctccagcaacgcatagccagcttcaagagccctgttcaaatcctgctccacctgggcacgacgttccggcgtatcctttttgccacgattgccggcacccgcgtgaatcaccagcagaatcccgtccggatcagcttgggcgatgtggaccgtcgactgaggcagtgcagcttcgttcattgatatcttctccactccatttttattgattattcgcagatatcttacgtcgtccttcgataagaaatgaccgaacacgcaaaaatacgtcaattagaccgcgtaaagtcgattgaaacccgcaaaagggacgaacggcgaaaggacgggacgcatatggctcacaggacggcaatgatcgacgtcggcggcggtttccgcgcgatctacggtgcgggcgtgatggaccgcatgcttgaggacggcatcagcgtcgaccactgctatggtgtttccgccggcagcgccaacatggtttcgttcatcgcgaagcagcatgggcgcaaccacacgttctacacgcagtacgcgttccgcaaggaatacgcgagcttcgacagctatgtcaagaaccataatttcgccaacctcgattacgtgtatagcacgctcagcaatcatgatggcgaaaatccggttgactacgcggctttcgaagccaacccgaccggtttcaccgtggttgcgtgcaacgccgaagacggctccacgaagtatttcggcaaatccgacgtgggctacgacaatttcgacatcctgaaggcgtcatcagcggtgccggtagcttgcgaaccgtatgcgatcgatggcattccctattacgatggcggcatcgccgatccgattccggtgcagaaggccatcgatgacggccacgaccgcatcgtggtgatactcacccgtccgaaagacaccgtacgcgaacagaagagggatatcggccccgccaggattttgaggcgcacgcatccacaagccgcggaaaaactgctcaaccgctaccagacgtacaacgacgaagtggcgctggccaaggaatacgagcaggacggccgcgtgctcatcctcgcgccggaaagcctgtacggcctgaacacgttgagcaagtcgttcgaaggtttggaacgcatgtaccgcgcgggctatgcggcggccgaggccatccccgcattcctaaaaagctgagcactaccctcatatgaacactccagccgatagcaacacgcgtgaaaacgccaacacgaacaccgacatcagcatcaccgcgaatgccacgggattcagcacaaaaacactgaacccgcagattctggtgaccttgtggaacgtggagcgtttgggctcgttctccgcggtcgcgcgtgaaaccggatggtcgcaaccggccatcagccagcagatccgcaagatcgaacgtgaacttgacgcaaaactcgtgcagcgcacgtcgcatggcgtggaattgactccgatcggccgtattctggcacgtcacgggcagcttatcgacaatcgcgtcacccaagccgtcaaagatgtggaagagtaccagcgcaacggatcgacgcatattcgtttggtcgctcctccatcggtatgttcgtcgttcgtggcacgcgttctcgtgcatatcagcaaaacgtccgacattcgcgtgagcctcatgcagatggagccgcctgaggccatggaggcgttggaacaggggcttgccgattgcgcgatcatcttccaatacaattcactccccgctttggccggaccggacgatttggaagtcgctcctttcggcgtcgatccgctgatgctgctgatcggcgcgaacaatgcgatcgcgcgccagtacgaaagctcgcacctgccggtccaattggtttcggcacgcagcgaacagtggatcgccggctgcgaaacctgccaggcgaatctggtgtcgttggcgcgtgccgccggcttcacaccggaaatcacacattcgaccgacgatttttgggccacgcagaatctggtggaagttggcatgggcgtctcgatcgtatctcgcttagccacaaccgctggaatccaacccgatttggccgcactgccaatcgccgacaacaacgcattccgcacagtctgtttcgtcacaagaaaagtggacgaccgaccggcagtggcccgcgtcaaagacgaaatcgaaagggcgtcacaccagtatttggaaaacatttgattcatcgtttgatatccgtgcttattcgcaatcgcggaatactgcagcaaacaattgtttccagtattttgctatatcgtcataatcagattaataattgaatagcaaaagcatctgatataagaaaacttcataacagtctttgctttcagtacaagaacacactgttcgtgcaagcatcggtacgtcatgctggaaccatggaagaaatcatggaaatgaagcatcgtaccggttccggctttgacgccgacgccatcgaccacaccaccgcagccgatcttgccgcagtcggctccgacaagtggacacgctaccccggctgcattggcgcgttcattgccgaaatggactacggcttggctccctgcattcagaaagccatcgacaacgcctgcgaccattgcaaactcggctacattcccgaaccctggaaacagcgcgtggcagaagcatgcgcaggatggcaacgctcgcattacggatgggatgtcgatccgagcattattcgcgtggttcccgacgtactcgaagcgtacgagattttcctgcgtgaactggtcggtgcgggcaacagcgtgatcgtgccgacgcctgcctacatgccgtttttgagcgttccgaaactgtacgacgttgacgtgatcgaaatcgaaatgctgcaaagcggcgacgccgaaaccggagaggcgcaatgggtgttcgacttcgacgccatcgaacgcgcgtttgcggccggatgccatgcgttcgtgctctgcaacccgcacaacccgatcggcaaagtgctcaccttggaggaggagctgcgtctgagcgatcttgcggcacagtatgacgtgcgtattttcaatgatgagattcatgcgccgttcgtgtttgagggcaagcacattccgttccccaccatcagcgagcaggccgcattacagtcgatgaccgctaccagcgcgtcgaaatcgttcaatattccgggcacgaagtgcgcgcaggtgctgcttaccaatcctgcggatcgtgacatgtgggcggtcaaggcggagtggagcgaacatcagaccgccaccatcggcgcaatcgccaccaccaccgcatataacgaaggcgacctgtggttccaggatgcgtttgcctatgtgtgcaggaatttggcgttgttcgacgagcagatgcgtgaaaggttcaccggcgtcggctatatcaaaccgcagggcacatatatcgcatggcttgatttctcgccgcttggcatcgacgatccggccgcatactttcttgagaaggcgcaagtggcgttgaccgacggacgttcatgcggcgagaccggtgccggatgcgtgcgcgtgaacatagcaatgccgtatccgctgctggtcgaatgcctggaccgcatgttcaacgcattgcacgccgacggattattgtaggcttcgccacatattcagtgttttcctcaaccaacggcagcataacggtgaacgtcatgcccttccccacttcgctgtccaccgttatggtgccgttggaaatctgcatactatcgacatgcgatgggaggttgacatgcgtttgaacgtgagtaccagcattgagacggccgcctgcgaaatagccggcgatgatctgctgttcttgggatttcatggattcagcaatgatgaaaatgagatgatccgcattattgatgcgatttatgatgttccgaagcaagacgcatcttcaacggacaactccattgctcctgcccagcatccgaattatctgtcgttccgaggcacgtacgaacgtccttacatcggaagctactactggtatccggatggatgttccgtaggagagcgtcgacgcgagtgcagtgccgtaggcgacgccgtcgtacgattgctggattcgcccgcatacgcgcatttccgcaaggtactgatcgggttttcgcagggcggatacctatcgtatcgcatggttgcggaacatcccgatgcgttcgacatggcgattctgatgagcccatcattcaaaggcgaaaccgctgagcctttgcccgcgaccggacgcacgcgattcgcactctgttacggcagcgaagaccgcacaattccactatccgaccaacagcgtgcgcgcaacaaacttgcgcaaaccggcaatctcacgtatttcgaatatccgggaatggtccacggcatctgcgatcaggaaattcgtgacctacgcgcctggctgggattgtgatatgcgctgcgtgaggagttctgcgcatctgagactccgcacgcgtgcccataaactcgttttcaccccctcggattgtcattgaaaccaactcggaactcttgatacaccctaatcgtcgaaatttatggacatacacccagttcatctgaactgaaccgcgatatctggcttatatatggcagatttggcatcttgacctgaagtttctcgctcatatatggcacatgcccttcgagaaaagccacttagggggcatgtttttgacacttttcgcacgaacacctgccatatataagcgagaagcctccgtacgaacctcaaaatctgccatatataggcgagataggcggcataattaagcattttccctcactgatgagccgcagaacaaaccagacgaccgaagttttacgatgttatgtacgtcaagctcaccacgaacatctctccacatatgtcgcaacaatatggtcagcgatcgcccttttccaatgctcgggcggtcactgcatgatggtcgtaaagtcaagcttatgcgggttggattgtcagcctgccgccgagagcgtgcacgatcccttcataatggtatggaagctcgggttgacattcctgtcgaggctcttgtaaagactttcacgtcccacacccgcctccttcgtgatctgccccatacccttcgctttggtcatatcgccgattacggcctgccgcaacgccgaatcgtcaagctcggccaccgataaagcagcaacatgagcgagtcgctcttctgcgcggagcaaacacggtagccgggaccgaaattgaacctcagcgcgctggccccgtcaccaaccgtatgcaggtcacccaccggccgccccatctagaagcgcaatcggagtctcgcgctgattcgggctttcgcgttccggtcctttatccggctgaaccattggcgatattcgccagtcatatgtatttccatatgacatgttgcatcccatgagacacaatatgtctagcttgacgaccactcacgagatgaacgaccaaagtaaaacagaaattcgacaggttagccaatttctcgtgcatccgcacccacccgaccgttttcacatacactatttcttttacatagctttcagaagcgaccccatgcgaaacacccagtcgcagttcctgctcgtattaccgttgaagtcgccccgagcggacaaaaaccctggttttccgttgctagcagtcccgcacatgtggaatcccgcatgtgcggggaacactggacataaacagggaaagcaacatccacgcggcggccggaacgatgcagacaccgatttcaatccacgctctccatgaggagagcgactgatacgacgctcgaaaatcatcttaatcgtatcatttcaatccacgctctccatgaggagaacgaccccttgtacggcgcgaacgcactgctcccagctatttcaatccacgctctccatgaggagaacgacggggatgcggtcgaggatcgggctgacctgcgtatttcaatccacgctctccatgaggagagcgacatatccggcgtctgcacggtgtgaacaagtgtatatttcaatccacgctctccatgaggagagcgaccggtcatgacgtcatactccccattattttttaatttcaatccacgctctccatgaggagagcgaccgccgccctgcttggcgattgccacgtcggtcagatttcaatccacgctctccatgaggagagcgacacgacgacaatcaggttttgcgcttggggattattatttcaatccacgctctccatgaggagagcgacttccatgtaagcgttacccaactggatatcgtgttatttcaatccacgctctccatgaggagagcgacttatccgattttcgacgaaaactatagagcgagcctatttcaatccacgctctccatgaggagagcgaccggcgcgtacggggcgcaatgctgggatttatgggcatttcaatccacgctctccatgaggagagcgaccaaaatcatcacgacaaaaacgcagatctggaatatttcaatccacgctctccatgaggagagcgacgagactgattccagctgacgtgctcgaagccatatttcaatccacgctctccatgaggagagcgactcatgtcaaagggctcggcgttaatcccgatgaatttcaatccacgctctccatgaggagagcgacagaaccgtctgggcacgtcgaaccggaacgcaatatttcaatccacgctctccatgaggagagcgaccaacctcgcgccggaaaatcaacctcgggtggaaatttcaatccacgctctccatgaggagagcgacagaaccgtctgggcacgtcgaaccggaacgcaatatttcaatccacgctctccatgaggagagcgaccagtttcagcaacctcgacatcggcaaatacctatttcaatccacgctctccatgaggagagcgacgcaacgccttccacgatgcgatcacctcgggtgtatttcaatccacgctctccatgaggagagcgacgtatccgccggaattgttgaccgtcacgcgactatttcaatccacgctctccatgaggagagcgacgataagttcatccagcaaaaagcgcaggtgactaacatttcaatccacgctctccatgaggagagcgacgtcggcgctgagcgggtcgccgtcctgcatgagatttcaatccacgctctccatgaggagagcgacatggcgttctggtagtcgccttgcgctgcgtatatttcaatccacgctctccatgaggagagcgacttaatgatttgatgactaagaacaatgttctgacgatttcaatccacgctctccatgaggagagcgactgttggccgtgtccgtaatagcggcatgcggaatatttcaatccacgctctccatgaggagagcgaccgcctcgaacgctgatacccctcgctattatctcgatttcaatccacgctctccatgaggagagcgacaatttgttgtcgtcccttgtgattgcgaaatacgatttcaatccacgctctccatgaggagagcgactggatgccatacgcatttcctcacggaaaatgttatttcaatccacgctctccatgaggagagcgaccttgtcggcccagaggatggcgctcgcgagcagatttcaatccacgctctccatgaggagagcgacgccgcgatgccatctcacggtcaagtttcgtgacatatttcaatccacgctctccatgaggagagcgaccaccaacatcctaccagtatgggggtacgagggcatttcaatccacgctctccatgaggagagcgacagtgcagctggacatttttgtccgctttttgagacgcaagccagctgcctagctttaagcatatcaaacaacaccgccgatacgacgaacaacatgtctaaaacgagcaactggctttctgtctcattttaatgtccattatttagttttcaaaacgccccacgaaaatcacaattcggatttcgatagtttttcaggtgcgaaagacgtcccttatcatgagcgcttacacttcgcacaaacaccattccaagaccggccaccttgccgaaaacacaatactgctggctagaaaacacactctgaataccggacggcacactcaaacgctcaacccagcataccccacaccatatcgttatggcaccatgccattttgcctgtgctatatcatcatcacatcattaaccggcaaactccgttcacgtccataatgctcaatcctatccgcatatcgagcgccaagtttataaaagcgcaggctgtcctcatcggtattggcaatcttcagcaaatcgtgcaccaacaccagataatcggaaggactcaccgagcattcgaaaacactgttctgcacacgctgtccgtatttcacgcatgtcttcgccaccaaacgaagacgacgcttcccctcaggggtttccgtactcacatcgtacgcaaccacaaccatcatggtttttcacctccaataacgtatcaccacgaatcatcgcataccgccacacacagctacgcaccttttacttccacataaatggcgggtaatcatcaagatcaccccgcaacgatcgagctagcagcagcgcttgcacatacggaaccaacccccatgaaattttttcttgcaggaacggatgaagaatctgatcgctcttctttttctgccacgccgtaagcactttcttccgcccggaatcagacagcagcacaccaccattctcccgtatttcaaaatcccccggcttaacagcgcctgtattaaccaatgtcagcacaaagcggtcagccaacaccgggcgaaactcttcaaccagatccaatgccagagaggctctcccgggccgatccgtatgcataaaaccaacatacggatccagccccacgccttgcaaagccgcaatgcaatcattcgtcaatatggagtagcaaaaagacaacaatgcatttagtctgtccagcggaggcctcctcgacctattggtgaaaaagaaatcatctttattcttcaggaccaaatcgtcaaaagcgtagaaataatctttggcagcaagcccttcgacacccctcaactcatcaaccgtcaaacttttccgagcttctaacaatgccgccgacaatttgccactctgctcggcaagtcggtcaatatttacccgcaaagcatgatcacgtttcgtacgttcgagcacccatttcgcattgtaaagttttccaacaatgaaagatttcgcgtaacacaaagatttttgttcgtcatccgcgactcgaaattgttcacggcgaagtagcacattacgattctcctcccctaacacggaacagtaataatggcctctcggtgaatagaatgccatagaaacgcccagtttgccgcagcgccccataagagcaggcgaagcacccttatacgagaaacacatgattccctcaattgaccgtaacggcactttcgccaaggttttgtcattctgatgaatcacaacattgtcgttctccaaagcaagataggcatcttccgtcatcacaaacagcgtgtttaacagctgcttcatcactccccgctttccttgagccgttcttcgatatatgcttttgccgatttcaccttccgtaattcaggcaggcacaaatcccgtagagaacatgacgaacacgatctggtctgtttcactttaggagtccatccgcgggagaaaagatcatgcatttgcaagaagtcagcttcgaccatgttgcgaagatcttcgtccaattttacccgctcacgacgttttgtctgccgatagaacaaagcaccttcaggaatatcacacgcgagcatttcttccaagcacatcgcttccgcgcatagctgtaaacgatcagcatcaatcgttttgtatttgccgtgtttgtattcaatcggatatggcaaccacaatccatctcttccgtgaagcggaacaccatcattagacttatggaattccacaacatcacaggctccagttatgccgagcgctcgcgaatagactctcaaatcccgcatgatcagcgtatcgccgcgagattcagaagtcgcataatcgtgggcgcgttcatgttccagatgcccagctgtggtcaaataattctctgaccacagctgttcgatatggataagagcccactgtcgtttgcagaatgagaaatgctggatgcccgaaagggccagccaatcttcttccggatatccttctggccctttcatgcaacaccccttactctctcaattccaaacgcttcagcgtccttcaatcacttcgtaccgcaagtcgggaatagaagatccattcactgccaccgttccgtccacattaacggaaacggaacgatgaactttggcggaagagtattgccctgacttgctgttgtgcgtgaaccacacaacgtccaacacttccatggaccccgcaggacgagccgaactttcatcattctcaaacaacgtgacgagagcttccttgattttttcggcgtcttctgcagtaaacccggttttttcggcaagctgtgggctgatgctgccatacgtcgcatacaccgcacggccggaaacacggtatttcattcccatggtatcggaggatttcttaccggtgtccgtggtttcactgttcactgacttagtgatctgcacgtcgtcaatggcgatgggttcaaccgagaacgcagcctgaatggaaaccggaccgcgcacgcccaaggaaacttcgtcaacatccttagcttttttgaatgcgaatacttgtccgaacgcacgtacgtcaagccactgttcgcacactttctggaacaccaggttcttctgtttctgctcttctttcggcaaggttttcaaatatgtgttgaaacggtccgacaatgattttgcgccgtcatcggaacggtcatcggactgcacgaaaatcgtttcaccagcatcttgcaggcgattgcgaatcttccttttcagtgcaacgtcagaaacctcgcccagcccttccgatgtggttcgtggacgattgccattcaacggatcaccattaggattggcattattagacgcaaaaacgactgcgaaatcaatcttgttttccaaagctgccatgatatgactccttaactttttctttgataatcaacgtcgataacttcaaaaactaaacactagttttctttgctcttctgggatgcttcttgcgctttacgcatagactcccttcgctggcatgaataaccgagcagaaagagcggtgaaagtgcacggttatcttcgaagtctccttctttgaaaagcgccatgacctcatccacgctgttctggaaccagggcgcgccattcgccgatttcaggtagggcatcagttgcttccacagcgttccccatgttgtaaacggctttgcgacgaaattgctcatgagcttaacggcattggtcggacgggtgtcactgattccttgcttatacaggacaccgttttcaaagcggtccgcgagtgccagcaatctcccgtataagtagtcgcggtcatttcgtgttggttcaaggtacatggatatcgtgtcctcctgtttgttttgcttcctcgcgtcgtcaatgtaatgttttttccataggctgcatgcgatttcaaaatctcttagccatgctcctggagcgtcatatcccataggtttagtgactctgtggtatgtggcgtccaatatgaagcggggaagcgattctcctccgaacatgcattctataagctgctttttcgtgtttttcgcaaaacgtttataggctttgctgcttctgtctgacacgtcatatgcgcagctgatgatgtcggcaaatggtggcgcaccttcatatgcgacaaacttctttttttctttgtcgtacattttcaacggccatgccgcatcaacatgccaccgcaggatactttcgacatattcgtcttttgaaagttcacggtaatatgtaacgctcaaacgccctgatgtcgccgcatccagaatgacaatcatcattgggtcggcatgctttttgagtttgttagcattgccatatccgcgtagtaccttcgaaaaaacttgtgcgtattgaaagtttgttgcggtcagcgcatctgcaatatcgttgcggggagcttccggctcgtccacatccgatgagaacaaagagccaaaatcataagaaccttcctgagggtcaagcttcggcttttcgttggggtttttcaccgagcagatgactatggcctgggtatcggtaatcgttccatgattattgaccaaccattgcagcgtcgaatgtatcttctgcgatgtttcaccatcgacttgcaaagcctcctctttggatgcgaagcgccctcgataggtgaaattcgttgaatcgtttgccgataacagtttggcgttgccatttacgctgacaattttcttagggaagttcaatatcggagcatataggtcctctccgaacatatccttcccttttttctgtcgatcatggtacaaataagaaatccattgcgcctgtatatcgggatcgttcgagacatctgagttttgcagcccaatttcaacttcgaagcaaacacctgctttccggtctttttcggttatttccacattgaatcgagcggcttcttcgctgatgctgtgttccgaaacgcatcgatagatggcattgagtttgacgttgtcgcctttccaagcggcaagctgctccaaatacatggaggttttctccttgtcgaaatgcaagtcgagatattggagctgatcaaacagaggatgcggtaccggcttgatggtgcgtcccatggaactttctgtgcacgggataacaatcgtttgtttttccctcagaagccgtagtatctcaccattctcgtttacccctagcgtcaatagtgtcggaagtgtcgtatgccccggaggaatcaaggctttcctaatgtcaagcgtagaaccgtcgccacttctcggaatttttccggcggcgttgtgcacagattcgttgataagcaacagattgttcgacaggctcatcactcactcctctcccaccggctgcagattgctccccaaagcgaattccttgacgctctggtttttcctgataattcgtccatccaatttcgtggattccggacgctcaaattcgatgatgccgtcggacataacaggcgaccagaatcgggcgataaaatcgtggtcctcgttttcatccggatacgtgaatccatggaacatgtatcccatattccactcgccataaccgtcataaaacccttcgccagatccgaactcacatggttccacatacccctggcactcgcgcgtccccaagaatatgtctcggcgaccgcctttctgaacggatctcaaggcgatattatgatgtttgttttcgtcgcggtcagcgacaagatcttcacgctgatcattccattcgaaatgagccaaaacctgataacgcacgtctttgagatacgtgtagtacgaaagatcattgccaccgctcattttgatgggtcgaattccctttccttcagtctgaactctgttcatcacacgaacagcgtcaataacccacataaaagttggcttccaatagatgctttccgtaatgcctttcaaagcttggtacgttggcacctgatacgaaaatttctcacccccaacacgtgttgctgcttccgagaacaacgcatatctgcctgatacctcatattcaattgagttgcgatgtcgttgcatataactccttcgttaatcgttccctcaaccagccactgtcaatatagcacattttacgcttattgtacatagaactctttgagtgtttctcaatcaacaatcaaccagttattcttgtataagtaggttttcctactgtcgccacattcatggcgtggattgaaaatatgtacaacatgcgtatttaccaaacgaaactctcctgcagattcccatcgacctgcaggagaaccactgccctttcatatcatcaacagagacatgtccgtctctgtcaccacgccatattcgcctttgtaataatctccattcagaacgcaaatatcgaaatcctcgctagcgatggaaatcgcatgtttttcgttcaaaatcttgtattcgtaatcgaaaagggaaaccgtgtattcctgtagccgccgcagaatcgcaatcttctccctcaactcaccgtgacccaacatatccagtaattccatcgcattgccatagggaaccacaacattgtgcgtgattttcggaatcacacgatattcattgccgaccgttttgaacgcctgggcaaaaaacggattgtatctctcccccatcgtattgttctcgaattgcttacgttggctttcgttgtatgccagcaactcataaatcgtttttccagcgttttcctttttccaaagcggaccatccagcaaactattgccgccatctcgatcctcactttgaagcagcatgccataaaactcattgagcatgccagtagaaagcagatcagcatcaggatgctcacccataatctgcaaagtgagctttttgcctctgtgaatctctggaagatagtccttgaacctttcctcaccttgcaacggatagacatacacatccttgatttctttcgattcaccattcctgttgcacctgccagccgcttgcataatgctatccagaccagccatcgccctgactacgcatgcgaacgaaaggtccactcccgcttcgataagctgcgtgcttacgcaaatcaccggtttggaatcatgaggatcagttaacacctttattctcgctaactggtctgccctatgtttgccacacatggcagtactcaaatgaatcaactcaaactgcccgtcagcattgagctcttgcaaacactgatacattttgcgcgcttcactcttcgtgttgacgatagacagacaattgccgttccgaagtgcctgctcatatatgatgttcgcaagttcctcgcaactcttgctttcctgtgaagcaataatccgggtacgcttgagcttctcttcgtaaccatcagtattgtcgataagatcaggctcgtctgacagacgcagattctttcgcgccgttcgttccaataaaggctgcgtagctgagcacagcagaatagtcgagtccaatatcgtcgaaagaaaactcacaacttcattaaacggattgatgatattcaatggaagcgactgaatctcatcaaaaatgatgacgctattggccatgttgtggaatttacgaagtttcgtaccacgcgccgacataaccgtttccaagaattcgaccatcgtagtcacgatgatcggattatcccaacgttcagacgccagtttacgttgacgttccttcacatcctcttcctcacttgtgccgatagatcccgtgttaccggaattctgaaggcccgcggtggagtaatgctccagcacaatattgctgtcagcatccagaccaagcatattccggaatgttgccacggtctgtgacgtaatagacaagtacggaatcacataaatgattcgtcttttccctgtttccaaagcatgatgcaaggcgaaattcaacgaagccaacgttttaccgcctccggtcggaaccgacaatcggtaaatccctgtctctctgctcccagcttgacggcactgttccgtaatctgttgacggattttattgatttcggatgtcgaatcgaatgatttcatgctttcgtcaagacggcgaatcagttccgatcaatccgccttgatcggatgatattgctctttcgtctcaaaataagccgtatctgttctatcggcatcaatcaaacgagaataaacgtatttaactagtaatcccgagtagaaataacgactatctttcgacaatttcagcaatttagttcgtcctacaaaatcgaaaacatctttttcggcctgctggaaggtgtcttgcaagtcgaggtccaaatcatgtagcccctgtttgatttccccatacgcatatttaggattctgtttatctgcttccgtaaaacctgtgagaaaagcctcatcaccgatttcattgatgcaatcaggaagctctccatgatgttttgcaataacaagttcaagaatctctttcacgatttccgctgccgaattcgaaatcggcaggtcattgacgacgaacgcaccctgcctcgcatgaggaatctcaccacgacgtcccttgcctgatatcagatacgtttgaaactgttgcgcgacctttccaacatcatgcaggagcgccgccattcgcggaatctgagaaaactccgattcatagctttccgctaagtcacccgcattgtgaagatggtcacgcaacgtctgcacaccgccatccgcgtccttgtgcgccagcaaagtcataatctgctccttcacagatatgttcaagcacccctacattaccatagcgttacagttctcacgagcattgcaacgaggttcggcatatagagacagaagactttcaagtggaataatccgcatatacgcatactcattggtatacctattcatatctttccattttcaattccaaatggaaagatatgaatattttttgcgttagctacacttaaccgaataagtgtagctaaattccgcgttagccacatttattcgcacatagaaaaaaccggacagcggattcttggaatccacccacttgggcgaacccgttgaatccgccgtccggcggcgcgactgcttctcaagaatgtgtgcttgactcacatggatggtactgagaaccattcgcttaacgatctgtttccgtgcgcgccaaccgcgtaaggaacgcggctgcgcggcacggacacaaatcaagtcttgagtggactcgagccgcggtgggcaacgccacggcggctcgaaagccaagggattactctagccgcagcttggaataatcgcaagccgactgagcttcgttcagttcaggccttggcaacctccacgctgagctcggagccgccttccttcacgttgaaggaggtggcgagcgtctcggaagcgatgagatccttgaactgctcgaccttcgccacgtcatcggccggcacggtcaacgtcagcgcgatgcggtcggagatttccagatcagcggccttacgggcgtcctgcacggcgcggatcacgtcgcgggcgtagccttcggcgatcagatcatcgttcagctcggtgtcgaggatcacgaagccaccggtcggcagcgcggcggaaacggagttggcggcctcttcggcgttcttctcctccacgctgttaatcagctcgtattcgccttcctcaagcacgatctcgccgttcggcgtctcgcataccggagcgccgtctgcgttcacatgccatgcgccggacttggaggccttgatggcgaactgtacgtccttgcgcaggcgcttgcctgccacgcgagcgttcacgcgcagctcgttgatgatcttcaagccttgggcttcggcatcctcaagcgtgcacagttcaacgttcttcacgttcagttcggatttcagaatctcgtcgtatgcggccacggcatcagtgttttccaccaccacggtcagcttatgcagtggctggcgcacgcggatctgcttcgtcttacgcatcgacagggtgccggacacgacctcacgcaccttctccatcgcgtcaaccagagccggatcgtcaacgagcacacggcccagttcggtcgcttcgccggtctgttcgtcggcaaggaacggccagtcggccagatgcacggattcgccaccggtcagaccacgccacacggcttccgcttccatcggagcgagcggtgcgatcacgcgcatgaatgcttcaagcacggtgtacagcgtgttgaacgcgttcgcatcctcattccagaaacggtcacgattgttgcggatataccagttggtgagcatgtcgatgaaatcagacactgcttcgcaagcgtcggagatcaggaagttgtccagcgagctttgcgtcttttcgatcagacggcgggtacgtgccagcaagtagcggtccatttccggcagtgcggcgacctcatcggcacgcaacgcacgagcatcgaaaccggcaccattattggcggcgttcgcatacagggtgaagaagtagtacgagctccacactggcagcatgacctgacgcacggtgtcgcgaatgccatcggcggtcacgatcaggttaccgccgcgcaggatcggcgagctcatgaggaaccaacgcatggcgtcggagccgaaatcgttgaacacaccgttcacatccgggtagttgcgcaagtgcttcgacatcttctgaccatcggaaccgagcacgatgccatggcagatcacgttcttgaacgccggcttgtcgaacagggcggtcgccatgatgtgcagcacgtagaaccagccacgggtctggccgatgtattccacaatgtaatcgcacgggaaatgctgttcgaacgtttccttgttctcaaacgggtaatggtactgggcgaagctcatggaaccggattcgaaccagcagtccatcacgtcgctgatgcggtgcatgtgactcttgccggtcggatcgtccgggttgacgcgcgtcagctcatcaatgtacgggcggtgcatgttgacattgccctcatggtcgcgcggataatcgccaaaatcagccttcagctcgtccaacgaaccgtacacgtcaacgcgtggatacttcggatcatcggaaacccacaccggaatcggcgaaccccagaaacggttacgggagatcgaccagtcacgtgcgttggccagccacttgccgaactggccgtccttcacattgcccggaatccagttgatttcctggttcagttcgagcagacgatccttgatcttggtgacagacacgaaccacgagctcaccggcttgtagatcagcggagtggcgcaacgccagcagtgtgggtaagagtgtacgtagctcttctcctggaaaaggatcgcacgctgctcttccggaatacgctccagaggaccgtcaccggcacgcaggttacgcagaatcggcttgttcgcatcgaacacgtacatgccctcatagtccgggcacagcgcggtgaacttgcagcccgcgtcgagcacgtcaacgctcttgatgcccttggcgttgagcgtgttcatatcgtcctcgccgtacggagcctggtgcacgagaccggtaccttcaacggtatcgacatagtcggcggtgaagatctgatagccttccggacccggaaccttgccctcgacggcgttctcgtcgcctgcgaagtacgggaacaccgggtagtagcgccagccttccatctcggcacccttgagttcgcgcacgatctcatagttgtcgccgagttccttggcgtaggagccgagcagtggcttgcccaggtagaacttcttgcccgcgaacttgccttcggtcggacgcacttccacatagtcgatgtctgcgccgaccacgatggcgaagttggtgggaacggtccacggcgtggtggtccagaacaccgcataggcgtcttcctcgtcgcgcagcttcacggccacggacacggtggtgtcctgacgatcctgatacacgtcggcgtccatgcgcagctcgtgcgcggaaagcggcgtctgatccttcggacagtacggcagcacgcggtagccctgatatgcgaggcccttgtcgtacagctgcttgaacgcccacatcacggattccatgtatggaatgttcagcgtcttgtagccatgctcgaaatcgacccaacgtgcctgacggtgcacgtagtccttccactcgttggtgtacttgagcacggaggcacggcaggcgtcgttgaacttgtcgatgcccatttccttgacctgatcgaccgaatcgatgcccagttccttctgggcttcaagctcggccggcagaccgtgcgtatcccaaccgaacacacgattgaccttgcggcccttcatggtctggtaacgcggaatcacatccttggcgtaaccggtcagcaggtggccgtaatgcggcaggccgttggcgaacggcggaccgtcgaagaacacgaattcgttctggctgtgatcgccggaaggacggcgttcaatggacttctggaaagtggcgtccttctcccaataatcaaggacggattcttccagcttcgggaaactggggttcggcgctacattggcgctctgctcacccgcagctgccttcggatacacgttgttttcgctcaccgtatctcctcgtaggttttgctatctatctcctacgaggacgatggccgtaacgtctgctggacgccgccaccgcggtaccacctcgtttgccgcactttcaaatatacgtgcgaccgcttgtatgttcggctattcgggccttcccgccgggtctaataagtcgctcacgcgaccgttcttccggaagctccccgctgataacggatcatcgctcgcatttcggttgtcactatagcatgcagcgcgaactattttcgcttgttttgcatgattatggacgattcacaatagctcttatgtaggattacatacaacagaaatgccgatactgacagcccatcagtatcggcattgtaatcgtattttcaatatgtatttttagaacatactatgttcgatcattcggagatttcaccggaagcaagcttggcttcgagctcttcgacaatctcgtcgtgcatcttctcggtgatcttcaccttgaagaggaacacgagcaggctcagcacgatgatgcccagcggcacgtagaatgcgcagaccttgaacatgccgatgttcgcggcggtcatatccgcggcggttgcgtcaccgatcatgcctgcggctacggcgatgaagccgacgataccgttggagcatgcgcctgcgatcttgtcgagcatcgggcggacggacagggtgacggcctcgttacgcttgccgttcttgagctgaccatattcgatggagtcggtcagcgacaggatggcggtcatctgaatgaaagtctgcggcaggtagaagaagaccagaccgacgatgaccattgccagattgctggagccgacggcgaacagcaggtagccgacgatcatgagcaccatgccacccaagtacaggtagcggcgcggaatgcgcttgttcaggatcgggtacagcggagccataaccaagccggtgatgaccgggatgacgcccacgatggagtatgcggcggtgttgtcgaggatgtacttgaacaggtacatgagcacgccggtggtggccacgttggcgatggcgtacagcaggtagctcaaggcaacccacagcagctgatcgttctgggccagagccttgaaggcctgcagcgggccgccgttgtcttcggccttggcacgcagcgtggtggtgctttccttggtgccgaacgccacggagcacacggtgaggatgccgaggatggccacgatgatggcgaagcaggtccagccggactggctttcgacgtacttgccggtgaacacccagctgaagtaggtgacgatcgggatgaccacgatggtcagaccgttgtagccgatggagccgccgaaggagccgagtgcggtgtaggtggagcgctcgtgggagtcggaactcaatgcagggatcataccccagtaggaaatgtcacgcagcgagtagaacacgtcgagcacaatgaaggtgatgatgaacagcacgatgaacagggtagtattcacgttcaccagaccgaacagaccagtgtagacgagcaccagcaggatggcggaaacggtaccaccgatgagctgccacggcttgaagcgaccccacttggtgttggtgttgtcgatgatgttgcccagcagcgggtcgatgaagatttctgcgatacgaatcaccacgaccaggccggtgatgatgccaatcagcttggtggcgacgctcttatcgacgccagagaacagcgagctcgtcacgtagacgatgaaataggtgctcagtgcgttgtagaacgcggactggccgacgttaccgaacgagtacgccacgcgagacaagaggttcccgcctttggaaccgttgttgccatttcccatctttgcttctccttagaagtcagatacaggtccttccttgacctaactatcagtatatccccttacctaaagttagtaaaatttatcactgaacatatcgcctatcggcgtgtcatattttgtgagcttctgctcgaaagatagccaaaaacgttattttttcgccatttacacaacaaaataggcaaactgtcgcattatcttgtggcagcttttaccaaaatcgatatttacgatatgcaaaagcttccacgtcgaaacgaaaccaagccaatctggaaatagcccgattactatacagaagtaaagaaataaccgctattttgccggcacaaaactatcgcgcaccaccagcgacgtcgacaggtacgcatgctgacgaatcgtgcgtttgccggaaatggcatcacccaacatcagcgtcgccacgcgcgcaagctcgttctgatcgatggagaatgtgctcaacggcggcgaggtcaactgcgaaatcgtttgattgttaatgctgatcacgctgatatcgcgcggcaccagcacgccaaccgcattgaacgcctgcagcacgccaaccgcaatcacatcggcagctacgatcacggcatcaggcagcacgccattatggtcgcgcacgaattgctcccccaacgcacggccgttgctcacggtgaacaagccgtcggaatacaccaatccgtcggattgaataccgaaacgccttgcctcacgacggaaatatgtggcgcgattctcctcatcgacctcataaaagttcatcaggcagcccttgcctccgatgaatccaacgcgcttcatgcccttggcagcacaggccgcgaccgcatcatgcatggtctgctgcaaatcaggctgcacggaatcgaacagattcggcgccggattcacgtcaatgaacacgccatacggcatggccctatgcagccgctccaagtcttcctcgctgatctggtcggcgcctatcgccatgaacccgtcgaatttggaactgcgagcgatcatatcgtcgagattgtggaacaccgtcatttccatgcgttgctgttccgcattgcattcgagcgccgaacgcaaatcggtgaaataggagtcccgcaacgcctcgtcggacttttcattgtcaagcaatgcaacctcatgagggatgacgatgcgcttggtctgcacgctatagccgaggtcctcgctcgcctgaatgatcttgcgacgagtctcttcacgcaccgatagggtgggatcaccgttcagaagtcgagacaccgtagcctgagaaaacccggtacgttgcgcaatctctttaatcgtcgccatgtctcgctctccaatttagtaaatcgtttacccatgaaaggataacctattattgacataacgacaaaccaagcgagatttatgcaacgatcacgcaagccaattataatcgctgctcatgcagcagtctcatgaacatatgacggaaccgccttcacggacggcgggctggccgcagccgaataccatgcatggcaaagacaataagaaatcccttgcttcaaaatcgcaatttcaaagcaagggattttccagaggatccgtgccgttcaaagccaccggccataagggcggtatcagccgacagggatcgaagcgcggctagtgtagaacgctagcgtgtgctcgcatcgctccaattcaggagactattagattattcgagttctacggcacctgtgtagagctgatagtactcgcccttctgcgcgatgagctcgtcatgcgagccgcgttcgatgatgcggccatggtcgagcaccatgatcacgtcggagttgcgcaccgtggagaggcggtgggcgatcacgaacacggtacgacccttcatgaggttgtccatgccggcctgcaccacctcttcggtacgggtgtcgatggacgaggtggcctcgtcgaggatcatggccggcggatcggccacggcagcacgtgcgatggaaatcaactggcgctggccctgggacaggccggagccgtcgccttcgagcacggtctggtagccgttgggcagcatgcggatgaagccgtcggcgttcgtgagcttcgcggcggcgatgcattcctcatcggtggcgtcgaggcgaccgtaacggatgttgtccatcaccgtaccggtgaacaggttcacgtcctgcagcaccacacccagcgaacgacgcagatccggcttgcggatgcccttgacggaaatgccgtcatacaggatcatgccgtcctgaatgtcgtagaaacggttgatcagattggtgacggtggttttgccagcaccggttgcgcccaccaatgcgatcttctgtccgggcttggcgaaccaggtgatgtcgtgcagcaccggtttgtcggggttatagccgaagttcacgtcagtgaagcgcacatcgccctgcaggagggtgaggcgaccgtccggtgaggtaatggcggtttcacgggctttcatggccacttcggcggcacgcgggctcaaggattgcgcggccttgagcgaacgggtgccgtcatcgccttcctcgcgcttccacgcccagtgaccggtttcatggtcaacttcggtcatggtgcgtccatcttcgccgagttccacgttcaccaaggtcacggaaccgccgtcgtcctccggctgctcgtccataagcgcgaagatgcgggatgcgcctgcaagcgccatcatcaccatgttgaactgcatggacacctggccaagcgggttcacgaaagagcgggacagcgtcaacagcgagatcagcgtacccagggtgagcgggccagcaccggacaatccgaagtttccaagtccgctaatcgcagcaaatccgccgaaaatagccagcagaatgtacagcaggtagcccatgttgccgacgatcggcatagtcacattgccccacgtgttcgcttcggcggaagcttcgaagagttcttcgttcttcttgtcgaaagtggtttgggtgacgtcctcatggttgaagaccttgatgaccttctggccgttgaccgcttcttccacgaatgcgttcacatcgccgatggcgatctgctgcttgacgaagtaacgtccggaacgggaaacgaccttgcgcaccaccacgaacagaattacggtgaatgcgagcacaaaaatagtgacaggcaccgacagccacagcatcgacacgagcgccgcaagcgcggacaccgcggacgagaacatttgcgggaacgattggctgatggcctggcgcaatgtgtcggtgtcgttggtgtaacggctcatgatgtcaccgtgttcgttggtatcgaaataacggatcggcaaggtctgctggtgagcgaacatgtcgtcgcggatcttcttcaatgtgccctgttccacggcgacgatgatccactgccatagccagctgcagaaaatgccggctgcatacaggcatgccatgagtgtcagcgcacgcaacagcggcatccagtcagggttggtggcaccaaccatgggcagaatgtaggtgtcgatcagcgactgcaggaacagtgacgatccggcctgcgctgcagctccgacaagaatgcacactactacgagcgccacgcgccacttgtattggaagatgtagccgaaaatacgcttggtggtgcccggtgcggctttctgcattggtggcttcggctgtttgctggccatgttgttgttttccttggatttcaatgcggaagtttgttcagtcatctgttgcctcctttcactgcagttcctcaggttgagcctgattcttggtttgcgattcgtagatggaacggtattcgtcgcagttttcgagcagttgttcatgcgtgccggctgccatgatgcgaccgtggtccatgacgagaatcatgtcggattcctgcacagaggccacacgctgggcgatgatgatcttcgtggtgtcgggaatctcatgatggaatgcggtacgaatcagctgatcggttttggtgtcgaccgcggatgtggaatcgtcgaggatcaggatcttcggctttttcagcaacgcacgcgcaatgcacagacgctggcgttggccgccggaaacgttggtaccgccctgttcgatgtacgtatcgtacttgtcggggaattcctgaatgaagccgtcagcctgtgcaagctggcacgcgtggcgaatctcttcatcagtggcgtttggattgccccaacgcaggttttcggcaatagttccggagaagagcacgttcttttgcaacaccatggcaacctgatcacgcaatacttccaaatcgtaatcacgcacatccacgccgccgaccttcagcgaaccttcggtcacgtcatacaaacgtggcacaagctgcaccagactggactttgcggaaccggtgccgccgacgatgccgacggtcatgccggaacgaatcttcaaatcaatatcgtcaagcaccggcttttcggaagtggcggaataacggaaggtgacatggtcgaaatcgatatcgccattcttcacttccttgactggattagccggattcgtaaccgtgctttcctcgttcagcacctggcagatacgttcggcggaagcctgcgaaataatgcacatcacgaaaatcatggaaagcatcatcatagccatgaggatctgcatggcgtaggtgaccaatgcggtcagatcgccggtggtcaagcctagggctgcattgttgccggacgccacgatctgccgggcgcccatccatgcgatgagcagcatggacacgtacacgcacagcatcataagcggattgttgaagctcataatgcgttcggccttggtgaagtccttgaagatgcgctgcgaaatgcggttgaacttttcggtttcgtggctttcgcgattgtaggacttgaccacgcggatgccctgcaggttctcgtcgaccacgttgttgagcttgtcgtatgtgtggaacacacgctcgaacaccgggtgcaccagcaccgccaggccacacaagccgatggcgagcaccggaatgcaggcgaggaacaccaaagagatggatgggctgatgcggaaggagaagatccacgccacaatcaccatgatcggagcgcgcacacccatgcggataatcatcgaatacgcgttctgcaggttggtcacatcggtggtcagtcgtgtgatgatcgaaccggtggagaaacggtcgatattggtgaagctgtagccttgcaccttctcaaactgatcgtgacgcagattcttcgcgaatccggcacctgcgatagccgagaactttccagccaaaaagccggatgtcagcgaaactaccgagcaaatcaacagaatcaagccgaatttcaaaatcgccggcatgctgccaccgctgatgccctcatcaatcagcgatgccatgacagtcggaataaggatttccagcacgctttccacggctacgaatgccggggagagcagactgacttttttgtattcgcgcagggatttgcccagtgtgcgaatgacatgctgctttggtttcggcgttgcggacgccgttgcgtttgccgttgtcactacttgccctttccttttatttttacctatgacgtgtgttacttgcgattgcgcgcgatcgccatttcctgcgatatccgcagtacgtgtgagacgtactcatcacgagcatcgcgattattcgaggcatagtcatcgcatgttttttgcggaacctgcgattcttgcggaacttgcgatttgcttgcgtcctgttcctgtatttccaaacttggatatcgactttcgtctccgatcaaacctgttttcaccagattcgtctgcatgacgtcgagcacgtgcatgaattggcggatctgatcgtcttcaaggccttccagcaggattcgttccatgttcttcgcattgtcccgcaagacttcggcgatatgcctcgatttgtccgtcaacacgatttttttcagtcgtgcgtcgcgtttcaccggttcgcgcgcgatcaggcccttctgctccatcagccccagcacccggcatgatgtggatcgggtcacgccaaagcgttgctcgatgtcttgaggaaagatttcctcgttgtcatgccgtgcgagatacacgatgacgtcaacgttgccgttgctgatgtcttccgccgcttcagggcgggtgacgcgcagataccggttgaccacgttgtgcagcgagcgaatggccacgctggggggctttgccaagccgctttcccagacttcgaagagtcgtgagccagtcggttccttgtattgttcgttcgtcacttccgtcacagcatacatagtaaaccgttgtatatacaactgttgcatatgcaacaattggcatgtcgtacgtatccgcttgccctgaaaatcgtcataaagcaacaatcccagagcaaccttccaacaatgcaaaggccgaggaatcaggtccgcaccggttcagagtaacggaccagattccccgaccttaagtcttgaatcccgcgaaactacttggtgagttcagcgtattcggcaagcatgtattcgaagatctgcttgccatcggcacccatcagcaccgacatgctgttgatcggcatggagtcgaggaatagacgggtcatgtcattgtcgggcacgatcggcatacggccggcttcaccttcggcacgcagcttctcgagcacctgggagccgagcggatccttacgccattccatgaagttggaccattcggtgagctgctgggtcttgccgtcgccatcgagctccactaccgcggaaccggcaatgtcacggctggacgtgccgacctcgatggcgtattcgccgctctccacgtgccagtcgttgaacttctcagaccagtaggcgaaggcgcgatcgtcgagatcgaaggagacttcggcggattcgccggctttgaggaacaccttcttgaagcctttgagctcgtgcttcgggcgggccacgtcagccttgccaggagccacgtacacctgcacggtttcggcggcgtcaacgttcgaggtgttcttgaccactgcgctgacggttgcggtgcaggcaccggtcttgacggccttcacgtcgctcacttcgaacgtggcgtagctcaagccgaagccgaacgggtagtcgacggccttgttgtaggtgtcgtaatagcggtagcccacaaacacgccttcgccataatcgacatgcccctcttcacccggccagttgatggtgctcggatcgtcgttgatgtcgaagggaatggtctgcgcaagcttgccggacgggctcaccttgccgaacagcacgtcggcgagcgccggaccgccggactgtccgagcagccaggattcgaggatgcccttggcgttcttggcccatggtgccacggtgacgacggagccgttggagagtacgaccacaacgttcttgttttcggctgcgacggcttcgagcagtgcgatctgcttggccggcatgtcgagggtctcacggtcgaagccttcggattcggccgcttcagggagccctaggaacatgagcaccacgtcggcgcccttggcagcttcgacggcttcggcttcgagtgccggatcggccggttcgaggtcgagggtgaatcctggggcgaacttggcatccacgccgcgttcggtgagggcgtccaggaagctggtcatcttggttggggtgatgtgcgaggaaccaccgccctggtagcgcggggtacgtgcgaattcgccgatgacggtgaccttggcatcgccagcgactggcagaatggcgtcatcgttcttgaggagcaccatggattcgacggcggcctgatgtgcgacctcatcgtgggcttcgatgtcgaaacgatagttttcgacgctcatggctgcgcgggtcttgttgaccaagtcgatcatgccttgtgccatgcggtcgagctgtgccggctggatgcggccgtcgcgtgcggcgtagacgatttggtcgtcggtgtagcttggcggcatttcgaggttgaggcccgcattgagggaggccacgcggtcgtggtcggcgccccagtcgctcatgacgataccttggaagccccattcgtcgcgcagcacgtcggtgagcagccagcgatcctgggcggcatgcacgccgttgatgcagttgtatgcgcacatgatggtccacggctgggcttccttgacgatgtgttcgaatgccgggaagtagatttcgcgcagcgcacgctgggagatgttggcgctgatgcgcagccggtcggtctcctggctgttggcggcgaaatgcttgagcgaagtgcccacgcccttggactgcacgcctgcgacaatgccaatggcctcatggcccgccagatacgggtcttcagaccagtattcgaagcagcggccgccaagcgggttgcgcttgatgttcacgccgggaccgaggattacggcaaccttctcctgaatgcattcttcggccatggcttcgccgacctggtggatgagttccgggttccacgagctggacagacccgcggccggcgggaagcaggtggcgggcacggagttgttcagatcgacttcgccggtggtggccgagttggacttgcgcagaccgtggggtccgtcggtgatcatatagccgggaatgcccttggcttcaacgccttgcagatgccaagcgtcgccgccggaagttagggatgccttttcttcaagcgtcaggtcattgacggaaggataggtgttttcgctcatacgttcctctttcgcatcgttttcttgagttcgtatcggttaaccggcctgtggaatctcaaccccgaaatctttactaaccggtcggtaggtactttatcaaaatcaacatcacaacacgccaatcttctttgaaaaatcagttaaccgaccgtaaagtaactgcaagtatttaccacttgagagaaatggcgattcataagcattgcagcgcacatgaaccgccactatgagtgcaagaaagggaatcatcatggccaacgaagaagtcgaccgaagagcggagattctcaatgcggccgtcgaactgtttggaacgctcggctattacggcacttccctgcagaaaatcgccgatcgcgtaggactcaccaaggctggcgtactgcattatgtcggcagtaaggaaggactgctcacagccgcgctggacgaagtctacgattccgagacggaagacattcttaccgacatagtacgtgagccacgcccattgattgccgacatgtggcgcagaatcgtggcggtgaacgcacgcagaccgattcaggtgcacatgttttccacgttgagcgccgaagcgatcgacccgaaccaccccgcacacgagtatttcgccaaccacgaactgcataatgccgacaccgcactcaacatccgttggcaagtgcccgaaggtgttgatacgcgtcggctgcttaatgcgggattcgccatgatggacggcgtgcagctgcgttggctgcgcacgcccggccaggatctgaactccatgtgggcggaatgcgaagacgccctgttccccctgcccatgtgggagggttaccgctaaacctctgccccggcactgcattaatgtatggatgcagacgtaaaaggaggcatgtatgcggattctgctggcaccggactcgttcaaggaagccgcttcggctgaagcaatcgcacaggcgatgactcgcggcattaagcgtggcaatccgcaggcggaatgccggctcatgcctctttccgatggcggcgaaggattgacacaagccttggttcatgccaccgccggcacgttgcacaatgttgagacagttgatgcgatcggccgcccgattaccgctcagtttggctttcttggcaataatcatgcttcttgtattctccgcaccgccgtagtcgagttggcttcggcaagcggacttgaacgggtctcccccgccgaccgcaatgcgttgtctgcttccacgttcggcaccggattgctgattcgtgctgcgattgacgctggcgcggatcgtattgtgcttggtttgggcggcagtgccactacggatggtggcacgggattggctcgcgcgcttggatttcgttttcttgatacggcagatcatgatattccgcttggtggcggttctcttgttgatttggagagaattgacgattcggaagttcccaattttgtaaaaaatgttccgattgttctcgcctgcgatgtcatcaatcctttgaccggaccagaaggtgctgcgcatgtgttcgctccgcaaaaaggcgcgaacacagcacaggtcgaactcctcgatcagggacttgcgaatctcgcacacgcgatcatgcaatacaatggccgcgatattgagcgcattcccggtacaggcgccgcgggcggtaccggcggcgggatgctcggcctgttcaatacaacagtacggccgggaatcgaacttatgctcgatcttgcgcatggtcgagaagcatgcgcatgggccgacgtcatcatcaccggtgaaggttctattgacagtcaaacaccgtacggcaaagtgccgagtggcattgcgaaactggcgcaatcgcaaggaaaaccaactattgccattggcggaacggtaacccgcgatccacacaccatcgaagcgttgaacgagaccggcatcgtcgcaacgttcggtattgcgcccgggccggcggatcttgcgacgctgatcgccaacacggaacgcaatgtcgagattacgtgtgccgcaatcgccggcacactgcgcgttgcttcggctactacagtaactgcagctacttcaccttgcgaatcagcatgataaacaccgtgcccagtagcaccgcaaccacagcgatcgggaacaaagccgtataaccgccagtggcaagcacaatcgtgccggcaagctgctgtatggcgttcatcaccgcggaacagtcggcgttcattgacgatggcaactggttcaacgcatgcgtctgatcaggcaccagtacgaatccggaagcagccataaataacgcgtatgccacggcaatggtccattcatgtgagccgcccacgatcggcatttcgtaggcggctcatatcagactagcgtatcgattattgggttctgcgacacggcttatttcgtttcgcttttacgcgacggtgaaggtggtgcgcttcaagtgttcgcgacggctggaacggccgataagcacttcgaattcgcccggttcgacgattcggttagcttccgaatcgacgatggtgcaatcggaaaccggaatgtcgaaggcaacggtcttgcttttgcctggttcgagttccacgcgctggaatgctttgagttcacgatcagtccagctgtaggaggtcacgatgtcgccgatgtagagctgcactacttccgtgcccttgcgatcgcccgtattggtgagggtgatttcggcatgcacggtgtcggtttcggcgaatatgccggattccgaaacgttggtgatggtcggatctccgtattcgaacgtggtgtagctcagaccctcgccgaatgcgaatgccggattctgcgtgaggtcggcgtaacggttgccgtgctggcctcgaatctggttgtagtagaccggcagctgtcctgcgtgacgcgggaaggtgatcggcaggcgtccgctcggttcggtttcgccgagaatgatttcggcgatggcctggccgcccttcatgcccgggcttggagcccacagcagagccgaagtgccttcggctggagtttcgtcaacaatcacgccgttggtgccgatcacggatgctggcaacacttgcggcttggagctgacgagcaccaccacgaacggcttgccggtttcgcgagccacgttcgacagtgcatcgatcagcgtattctgtccgccgagcagttcaagcgtggcggtggagcagccttcgccaatggcctggatcacatcgcccaccacggccacgatcaggtcgcttttgcgtgcgttttccacggcttcgtcaagcagtgcgcgatcaatcttggcggaaacgccgatcttcgggcgaggctgtccatccgggtagaactcgccttccggatcgggcaccaaatccacgatgttggcaccgcgagagtacacgacctcgcaaccttccggagcgagctgcttgaaaccatcaagcacggtggtgatcatttcacgcgggtggccgtcaggcatccagttgatctggccggagctgcctgcccagtcgcccagctgggtctgggcgtcatcggcgagcggaccaacgaccgcgatacgcttcgcaccggccacgttgaacggcagtgaaccgtcgttcttcagcaatgccacggcttcgcgagccacttcaaggttgagctgctgatgctcttcggaaccgatcactgcatcgatacgcttctggtcgggcaagcgtggatcttcgaacagtccaagacggaacttcagtgcgagaatacgagccacggcggcatcgatcaacgattcgtcaagcagaccggtcttcacggcttcgattgcaccctcgtagaactttggcgtggtcatcaccaagtcgttgccggacttgaccgcatcggcagcagcctgcacatagtcaggcttgaccttctgttcccacacggaacggccgacgttgtcccagtcggtgatgagcgtgccctgatagttccaagcgccacgcagtttgtcggaaagcagccacttgttgaaggtgactggcacaccttcgatggattcgtagccgagcatgaaggtgccacagccttccttggctacgcgttcgaatggcggcaggaaccaagattccagcttgcggtggctcaggtcggcttcggaagcgtcacgccctccctgtgtttcggaatagcctgcgaaatgcttggcgcatgcgaggatcgcgtctttggcgagcggctcgcccgccttggctccaccttgatagcccttgacaatggacgatgccatttcgccaatcaggtacggatcttcgccaaaggtttcgcccacgcggccccaacgggtatctcgcgcgatgcacagcaccggggagaacgtccaatgcacgccggtggctgacacttcctcggcggtggcacggcccgcggcctgtaccttttcggaatcccacgtggttgccatgcctagctgttccgggaaaatggtggctcccggccagaaggaatagccgtgaatgcagtcgtcgccgatcaccagcggaatgccgagacgggttttggcgttcaccgtttccacggctttcggcagatcggacggcgaggtatgcaggatggaaccaacgtgcttgttgacgatcagatcgtccaaatcgccgcttcgcgcgtcaagctgcatcatctgtccgactttttcctcaagggtcattcgaccaagcagatcggcgatgcgttcctcagtaggaagttccggattcctatagggcagatttacagtattttcagtggtttcggccatggattgctcactttcctcattgaagcgattttctttaattaccaattggtagtttagtatatcatatgcacatccgcaactcgacataaacccgtcaacgcaaaaggcgagggaccatcagaccctcgccttttcgtacacgcatgcaatgccaatctcaacaagtattcaaaatcaacgatatgcatcccacaacggggatggaaacagcatgttttccatctgagctcactctttgcataaatcaacttcaggctcgcgcaaccaccataattgcacaccatccatgatttccatggctttacgcaccaccggtcgcatgctcgacttccatgaacccaattgcggaggaatcagccaaggatattgcgaatagttctcccaaatatcgtccatacgagcagtgaattcatcatgcaacggatgttcaggattcaacgattccacagaaagcacggtaaactttgaaacagacacccccaagtatgccaaaaccaagcgtcactatatgtggacgcagcaatgaacaattcccctatgacaactagcatggggagacattatttgtaaagcataaaagaaggtccattcaaatggagaagccgaacgatattaaaagagactccatatcagtgaattactttttgaatactgctgcgtacagcggtctcttctcccttctttcggttattctcaccggccaagtttctgcggcgtcatcgctatatgttgggctggcgctcggaattttatctcttttttctagaggcagtactgtttttataggtagcctgattgagcgtttctcaacggtatccctcaccgaggccggtttcggattcatggttttttcacttttgctgctacaaccggcaatgggtggttttatcggcttcctttttgcggatttggctttgctgggactcggtctttcattggttaattttgccctacgagggcatatcatcgctacagtaaaggataaaaaaattcaggcttctttgtttgctttagtgactatggcagccaatcttggatccgcgattggacctctgggctcgaattacatatataaagctttcggacaaacgctctttattgcaatcatcgtcggactctatgctttttctgctttactagctccaatagcgctgactcatcatgtcttcatacgcaatgagaaaagcggcgaggaaaacacttcctccatcgtgaagaccattacagactcgctgaaaagtcccggtacggttcttgccatcctggcggtgttcgtgggcagtataatgaatggtcagctttttgccggaatggcattggaattccactcgttatccgatagtccagtcataagaggattgttctattccattgatgccatatcggtcatagcactgcaaatgccggtaagtaagatcatctcgcgcaatatgaccaaagaacataatgccacctcattcatagtcaaaagcctggggatttatggaatttccttcgcactattcgcctgcggagtctcgtcgtgctggtggatatgcatcatttccttggttgtgttctccattgcagaatgcatctatgcgccattaatcaatattgctctggtagaggcacagccagataagcctttggtggacattctgaactatcggctgataattgcagccattggtgaatcggcaggctcattccttggcggttggatcgttccggcactacgtcctgcaggattgacggcttggtattggtgtgcactggcgttagtgggaataatgcctgcagtcgtcactaatcaaattagaaaacgtggacaaagaatcattcgtcattgaaagaaaaagtcttggtgagtacaccggaaggggaatgacatgaaagtattattgctgcaacagcccaaatctttctcaaattatcctaaatggattgaggaaatccaagaacgtttcgattgtttagaagttatggtcttcacctcgaacgatcgagccgcacaccatagttggccgagctccgtcatcaaggaaatcgaggtttccgattattcctctgatagcgctaccgcaaaattctttgatattgtcaggaaatttaaaccagataggatagtttccagctcagaggaagacgtactgagggttgcagaggcgagaagtttatttggaattcccggtttacagcatgaactggcgttaagctgtcgagataaagtcacgatgaaacaatcggcccttgatgccggattaaagattattccctataccacctgccaaggctttggagatattatttcggcgttcgatcgttgggagacggttgttctcaaacctcgatggggcgcagggtctgcaggcattacgatattgcattcgaaagatgacctgcctgctttagctaccaagccggaattcatacgaaacgtgcattcaaaccagtattacttagaggaatattgttccggttccgtctaccatgtggatgtagtctatatcaattccggttcgattctgatctcaccatcacggtaccttgtcccgccactggatttcgagaaacaaaacaccggttccgtgatgttggatgagaacggtgccgactattccgagctgctccgactgacaaagcaattaattgcatctttcaacgatcagacgattccgaatgtgatgcatatcgaattctataagaatgaaaccggtgatttcgtattcggggaaatggcggcacgcagaggaggcggtctcatcaagcaggagctggcagccgcctatgacatagaccaaagcaaggccaacttcctattggaacttggtcttgtcgatgcggatgcgaatattacgcgatcatctcagtatggcatactgctggaaaccgctggattgaactggccaaaggaaaaagaaatcccggattgggcggttttggaatctgtgggcaagaaaaaaggtatcgctcataactctgttgattctgacaggaaatttcttatttccggcaagaatgaatctgagattattcaacgttctaattatcttataaatagtcaatataatgagtaaaattaactttttacagagggacaattgtaactaattctgcagcaggttctatatatgacgaattattatgtagaattggtaattctactgaatctagactcttccgtaaaataatgatactagtatcgctagggatgttgggagccagcattggcgtctatacgggaagcgcagcaggtagtctgactgcatcaaaatggtcgacatctcaagaaaccagcatgtctctttcagcaaacttttcaggcactaccacaatagaagataagcaaaatgagggtggccgtcaggtcacccccgaacgtatgcggaacacacataaaatcagcggcatgcatcccagaggggcgcgggaaacagcagattctccatttcggaccattcctcacacaagtccacttccggttcgcgcagccaccacagctgaatgccatccatgatttccatggctttgcgcaccactggccgcatgctgccggcccatgcgcccaattgcggcggaaccacccacgggtatttcgagtagtgttcccagatgtcctccatgcgtcccatgaattcgtcatgcaatgggtgatccgggttcagggattccaccgacagcacggtgaacagctgcaccatcatgcggcggcgcgagttgtgtttcaccaggtagcgcagatacgcgggaaaatgcggcgcggacgggtcgctgcccggcatgcccgaagagaagaagtcctccggcgtgccggtctgcccgtagtattcgtcatataccagcgccagcattttgtctttgttgtcgacgtatcgcaacacgccttgtttggagatgccgaccctgtcggccacgtcttggatggaaatgccattgaatccacgctcactgatcagctgaacagccgcatccagcacttccgctcgacgctcctgcggtgattttcggatacgtttcgaagtctcttcctctgccatgattccgagtctaatgcaccttgcgtcgattgccgttgattgactgcctatggcacgtcatcgtgagaggtatccgcccgaatccatccatgacgccatacgcgagtcagatcccacgcctcaagattgccgccgttgcgaggatcccgcggcggtttcccttcgccactacccggtttcgcggagcgcgcaagctggtagctccaatagatctgccccgccgacacgtcccatgccgcgcgttgcaatcgtgacacttggcggtatgcagccgatcggttttggctgtgtagggcccactgattctccacgcaccactcgcccaccagcacgggaatacgacgggccgccgaacggatggcgatgccactcgcgcccaccagcatccggtacagccatggcagtcgccgcgatcgcaggtacagccggcgtgccggtcccgaaaacagcggatcctccatcgcgatgagatactgatgggtgtcgagcatgacgttgcgcatgccagcacgacggaaccaaccaccccagcggagcagtcggaaaccgtcatggaatacgatcacggtttccggacgtagcacggcgcgcaaccgggcgtaagcgtcgcggtagaagcgcttcagaaaacgcagtgagacatacgtgctaccggaagcctcatgagagtctttcgccgtgttcgacgtgctatggaacactgaccagctcactggttcgttgagtacttcgatgccgtgcagggccggttcgtcgcggtatcggcgagccaatcgctccagcacgttcagcgtgtactccaccaagtccgtattctgcgcccatttgcacacacccgtcagaccgccgttgtcgaaaccattctgcgagccgggcacggtatgcaggtcgatcatgatcttcagtcccgtctcccgcgcccaacggaacgcgcggtcgaggtacgtgatgcagcccggatgcccgggccagtcgccgaagatgaaatacggtatgggaatgcgtacgaggttgattccgtggtcggcgatgatacgaaaatcctccaaggtgatgtaggtttcgcggtgccggcgcagttcctcggctagattccgttcggaccagagggatacgtgcgtgcggtgcatccagatttcatcgtcttcggcgctgcgggtgaacggtttcggatccatccatttctccagcaccagccagttgccgaggttcacgccgtcgattcgctcgtcgatgcctagcaccatgcgtctcaccgcccttacgttcgggggttgcccgacttttcgtttccgcccatcacaacccatggcaaaacccattcggcccaatgggccaaggaaccgcgcgtcattcgcaacgttccttggtccattgtatgcgccccgcgagcggccacgcggccgctcggaatcggatcacagccggatcagggtcgttgaatgatcgtggtggccggccgggcgggatcagtcgacgggcttcgtctcgtccgcctcgtagtcgaagaagtcgaagtcggcggtcttctcgtgcagagcggcgtcggtgacggcgatgccgaccatagtgccggtgaattcgccgtacttgcagtattcgtcagagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccgtcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttcgtggtgacggtggcgtacacgctggtgagtttgcgtgcgatcaggctcgtgcggttgagcgatgccaacgattcctcgccgcggatgcgcagccaaccggggcgttccgtcacgttggcgaaggtggtcggcatctgccgcggcgaataataccagttgccgatcgcgccgccgtcgaagtcgtcgtgcccgggaatctccggcatcggcgcatccggcagatccggctcttcgacttcgagtttggccagattggagccgtccgccatgcgcagccagccgtcattcgtccatgtcatcttctgaatggcggtttcacggccaagcgtacaacgtaattccggcacaaacggacggctggtcaggtgcacaagatatgtctcgccgttcggcagatccacgtaggagccgtgcccggacttctgcagcacggaatccgggttgaaatagcgcggcttcaaatgatcgtcatcagcacgctcgtttgactccttcggctgcgaagtgacgagcggaccattcggatccggctcatacggaccccacacattgcgggaacggcccatggtcacggcatggttgtagccagtgccaccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacgcccggcttctcatagccttcacgggtctcccactccaagctgacgatgtacttcttgccattgtcatcatgtaaaatggacgcgtcgaaaccagaagatgtcagatataccggctcgctccacggaccttcaatgctctttgacttaatcagataattattcacgtcgaaatagcgtgcattcatggagttcataacgccgtaaatcacgtaaaacatgtcctcttcctcacaatacgtgagacatggagcccaaatgcccttagcgctcggcagcttggtgaggttcggcttcgtatcatcagtaagcacgtgggtgagcagctcccaatgcttcatatccttcgaatggtaaatcggaatacccgggaaccattcgaatgtagagacagcaacatagtagtcgtcgcctttacggcagatggccggatcaggattgaagcctttgaagatcggattatgcagcattgtcgttccttaatgttcttgatatcacgcgttgctttgtacgattcttgcgtccgacggaatcacttttggacggggaaccagttttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctaggccccggtacagcgagcgcttctgttcggcggtcagggtttcgacctgagccccttcctcgccgttgagcacgctttggccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcgaggaccacgttcttaaactcgggcgcgagcttgccgtcggggccgcgcatgaagtccttccactgttcgatgtcgaaaccgtcgtggaacaccacgactttgtcggtcggcaacgcgcccttgtcagcgtcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggtggtgttcggctcgttgatgatttcgatgcccatcagcgcccgacgatggccgtaccgcttggagaggcgttcgagcacggacagcacgaattcgacttcgtcgggcagctgcgcccacttgcacacgccggagatgccgccgttgtcgaagccgttttggctcatcggtgcggtgtgcagatcgataaggatggtcaggccgtatttctcggcccagttgaaggccttgtcgagttcgtcgatgcagccgatgaacggcgcgcggtcgccgaagatgaagtacggcacggggatgcgcacggagttcagtccccacgatttgatggtggcgaagtcgcgctcgttgatgtattcggcgcggtgggtcctgatacgggcctcgtagacggccggatcaagttgcgtcggcagatagtattcgtcatcggcagtggttccatcgaataatgccgggttcatccacttttccagaaccagccagttacccaggttcacgcccttgatgtaattaaggtccatatgcactccttcgtacgctttcaatcatattttttattacttagtaattactaagttagatgatagtacatttttctcctccccgcaactcgtctcggacatctctccgaaccgctgtcgcactatttcgcataaagcaccctttgcgaaaatcgtgggaccgacaatcaaaatcgtgcagcaatttcacagaatcatgcgattaatcataagaaaaagcctctttcttgcgggaagaaagaggcaacctgcagccggagagacgattactgcttatcgctggcgaatcgttacgtgcaaggcactcaccgaggcagcgggcaacgttaccgtcagctcggcaccgccggcagattcgtgcacgctcacggcactatccacgtccacggcatgagtgcgcaccagatccgaatgctccactgtgttgcaatcatgcggatcttcggaagcaagcgtttccatcgaatcaacctgagcgccgcacggcaaatgcagccgcacttcggcaccatcgttcatatgcgcattggtgagattaatcagcagctgagtgccgtcttcattgcgtgacgcaaacgtatatacggcggaatcttcggaatcgttgcgattcacatcaagtgcgatcatgccacgatgcgccctgtacatcatgaatacgtcatagttaggcgtaaggatggtacgatcgccttcagtcaaaatcagtgagttaagcacattgatggtttgcgcgttgcacgccatggacaccttgtcgcagttgcgctgcagcagatccaacgtaagcgcggtagtgatggcgtcacgcatggtcacctgctgcttaagcgccgggcgcgcaaagaacgcggtcttatgccaattgccccactcaccgataatcagatcgacatgcgaaagcttggaatccatcgccacttccggctcatgaataagcgccaaaccatcgttcatcaaacgccactgatcacacagaatgtcttcaagctcaaggcaaccctcaatcaccgtgttccagccgtcttcatcgaactcggtcggagtatcagcatcgttatccacattccagttgtagaaatgcagatcataaccatcgattttcggctgacgatattcgacaagaccacggaagaagtcctgggtccactgcacgcgttcgcgcggcttgttaccgtcaggaccgctcgcgatggcatacatttccgtcggcgcgaacacatcggtggtgaagcttggcatagcggatgcgaacctgcggtattcgtcaaggtaggtttgcggcgtcatggtaccgcctccagcccacacttcgttgccaatgccccaatatttcacaccgtacggtgctttatggccgttggtctcacgttccttggccagatcggtgggctgctcacgattgcagtattccatccaatccttcatttcggccacagtaccggaaagcatgttgatattgatccacggttccgcgccgagcatttcgcacaaacgcaggaattcgtcggtgccgaagctgtgatcgtcgagttcgtacgtggcgaagttttcattaaaggtggttttacgttcgctttgcggccccacgccgtcacgccaatggtaggtgtctgcgtagcaaccgccaggccaacgaataaccggcggctgcaatgcacgcaaagcatccaatgtggccttgcggtagccatgctcgttttcaatcggggaatcctcccctacccacagaccttcatcaatgcattcgccaaggaattcaatgaattggccatgcagtttcggatcgatacgaccaatcgtactgttcgggtcaatgcagacaaccatggtttgctcctttgcagtagtactcacatctgcagtgttcgtaattcgtacagttcctgtagttattgtgccgcacaatatgtgcgaaatggccgaagatcccaggagagataatgaaaggatctccggccaagttatttcggaaaatgccgacgctacttcacctttttaatcatcagaatgaagacgcaggcgagcgccaccatcacgattgccgtcgggaacaccatggcataggagccggtggccaccacgatggcggaagtgacgatcgggccgaccatctgaccgagagtggttgcgatgttcagaatgcctagatccttaccagcctcttcctcgttcggcagcacgtcaacgttgagtgcctggtcaacagagccgtacatgccgtagccgaagccgccgatggcggagaagagaatcatacccagcgcattatgcatgagccacggcagagcataaccgatggcaagcagcacgcttgcagccacaaccggaatcttacggcggccgattttgtcggaaatcggacctgcggaaagcgcggaaatcagggagacaaccatcagcaccaagctcatggtggaaatggtgactgcggaatcttcaacgctttgaccgatataatcctgcagaatatacagctggtagttgaggatcatgtagtagctgaacagcagcagggaacgaccagcgaatgccagccagaagtcacgagcgcccttggtcggcggacggaagctcatgatgatgcccttgaaatcgaccttttccttaggcatgtccttactggacttttccttcggccagaagatcacggcaagcacaccggaaagcgccatggccgcaccagcgacgatgaagcccgggagctgcagggtgatgaactgcgcaccaacaatctggccgagtgcggaaccgaaaagcgtacctgcggagatgaatgcagacatggtgccgcgcatatcttccggaacacggtcggatagggatgcgatgaccggcgcgatcatcatgttcagaccgaccatggaaatgcagtagctgacaccgatgctcacaccgtccggcaaaatgccgatgaggaacagcgagataccagcgacaatgccgcccgatgcaatccacggcgtacgacggccgaagatcgagcgcgtacggtcagacatgttgccgaccacaaggttggaaatcagcgaggcgagtgccgttgccgaattaagcacaccaaagatggcgtctttgctgtcgggcgcgatatcggccaaacgctgcggaagcaacactgcagcaacgatctgcaatgccagcatccacgcgaatgagaacacgaagaacgctacgcagaaacgcgttttgtcaattttggaaagcgtgcgagtgctttccgcggactgtgcgccagtcatgcttatctccttatctttcttcttcgaaatcagccccacgtttttgccgaatcttcaacgatcgcgcaagcaagagaggcgttgattgaagtcgatgtccgtcggcttcgtcagttatcttatatcttataagtataagataacaaatcggcgtgtcgaacaactacccacttgcaaacacatcaatcaattacataaccgcaatatcgaaaccacacgaaaacacacgtgggcagcggcaatagtattcttcaaagcagtatggaatcacaggaaaaaacatcagcaaacagcatcaagagccgtccaatcaaccaaagaaaacgactctccccaacacaacgacgcaaacaggtcgcacaagaagcggtaaccctgatcacgcaatacggatcatatggcttccccatgcaagccttggcggacgcggtcggaatgacactgccaggactcaaccattacgtcaaaaaccgcgaagaactgctctcattggtcatcgaaacgttctacgactccgaagaaagcaatgcacccacgacattgggcgcaaccatcaaccactgcgaccaatcagattcagcaaccaaagaatgtcgacatttgcccagcgcactgcacgaaaccgtatgtttcaacgccaaacgtcctgaactcgtcgcactattcatgcgcctcgcaatcgaagcatccgacccgcaacacccggcacacgagttctaccaaaacaggcacggatcaatcctaaccgacatgaccagcgtggactgggaactaccggaagaataccgagatccagaacgcctgcacgacctcatcgtcaccgcattcttcgccatggacggcgtgcaaatccagtcgctgaccaacccaaacgaatccatgatgcaactttgggaacgcgccgaacgcattctgttcccctcccccacctgggacggctaccgctaaacagagcgcgacaagcaaaaacactgcaaaacaagagcacagcaaacaaaaaaggcgtctgtctgcggcgaccagtaaccaatcaccacaggcaaacgccctgcaacacagcaccggcttgcgaaggtggcaggaagagaagggaaaacccaccacccggcattcaacaaaccgttgccacaaccaagccgacgcgttacgcacacattcgcatcagccaagcagctcctgttagtccagcacaaacgtgttgaacgaacgcggagcaagcgtcactttgataccgcgatcggcattgcaaggatcggcaaattcaaacggacgctcctcttcgagagcgttctgggccaccaccacaatggtgccatccggattacggaacgcaatagccatcgaattgaaatgccccgtagtgccaagcacatgcgcacccggcttgacgaaatgcgagaaatgacgcatcacataatattccggattacgacgaacctcatgcgtatccgcagtaatggtgaacagtgaattctgccaccatccccacgtggaatcctgatcgtcaagaatcatattccaatacgtgtaggcagtcgcgccattacgcaaataatggttgatcaagtggaaaatatactccgcatattcccacgtattatcgcccataccacattcggattcggactgaatcagctcaatctccggccaagactcatgcgtacgtgcaatgcaattctggccagcccactggtaggcaatgcccttgatatacttgcgagcaccatcatcgaacagaatattatcgacgaaacggttgtaattattcagcttcatgccgtagccgccggtccacgccatatcttccggaccattgagcgtgcccagccaaatatcggtgtcaagaccagcctcctcaaaagcaggtccaagataatcgcggatgaacactttgagcgcttcggcatcccacaacgcactcgggaacttctgatcggcgaacacctcattctgcacatgcagctggttcacggtaatgccatgctcggcataagcctgaatgtacttgacgaaatacttcgcatacgccttcagattctcaggagtctgcaccaaacggccatagttgtaagccttcggacgcttcatccacgtcggcgggctccacgggctggagaacagctgcatgttcggctgccattcctgcgcgcgatgaatatacggaatcagcgtctgctcatcatgctcgacggagaaatgctccatctcgtaatcgccgtcggtctcgttatagctataccaatgatcggcgaaatcattggcgccgaccggcgcacgattgaaggtgaagttcatctcatccgggctgaacagttccttgatgatctgatcgcgttcttcctcgatgaccgtctgcagaggaagccagccaagctcgttgaagcagccgccgaagccgcgcaacgcctgatattcgttgccgtcaagctgcagatcggcagcggaagtggcatgcgtggattcgatttctgatgatttgtcggcaagcttgttgtcttgcgttgttgcgatccaagtagtcatggaaagtccttagtatcgtcgttgattctttggttttatttttattcgtttttgagttgttttttatttgattattgggatttagttatcgatattgagttttgagattgaattattgagattgaattatcggcaacgcaatttcatttcagtaagtgcaaaaaccgcaggatgccgcgataatctattcacggcacgctccaggccgctctggccaagtctttacggtcttaaacagattatcgcggcatcctgctcgtaacgctatgacgttacgtttgcactgttatttagttttggaaaaactccccattccctctctccctctcctctctcgaaattgagaggagagaggggagggaggtgtggttacttgaccttcttgatggccatgatgaagaagcagccgatgatggccagggcgatggcggtcgggaaggcgaagttatagccgagggacaccacgatggtggacatgacgaccgggccgcacatctggccaagggtggtgcccatgttcagaatgcccagatccttgccagcttcttccttgttcggcagcacgtcgacgagcagagcctggtcgactgcgtagtagacggcgtagccgaggccagcgatgcccgcgaacaggtacatgcccaaggtggacggaatcagccacggcatggcgatgccgatagcgaagagcacggaagctacgacaaccgggaccttacggcggccgatgagatcagaaaccggtccagagataaaggagccgaccagagacatgaccatcatgatcatggagacgacggacacggtgacggctgattccttaacggactggccgatgtagttctggatgatgtagagctggtagacgttgatcatctggtagctcatgagcatgcagaaacggccggcgaaagccttgtagaagtcgtgggcgccagcgaacttcggcgggcggaaggatacgaggatgtccttgaaagagccctcttccttcggcaggaagtcagcggaacgttccttgggcagaatgatcaccgcaacgatgccgccgaggaacatgagcacgcctgcaacagcaaagccgacagtcaggttctcgatgaagaatgcaccgatcatggtaccaatcggggcgccgatcgtggagcctgcaccatagaaggctgacatagtgccacggatgccggacggcacgcggtcagacagcacggcgaccagcggggcaatcatgcagttgaggccgaacatgcaggcgcagtagaagatggtgagcagcaccgcgttgtgcgtggtgccggtcaggaacagggtgacgccaccaagcaccgcaccgaaaacgatccacggagtacgacgaccgaacctggagcgggaacgatcggagaagttgccgaacatcaggttggcaactagggatgccactgcggtgaacgcattgacgatgccaacgagagcatccggatcggcgccttcgatggtcttgtaatgcatcggcagaagcacggcggagacgatgccgagacccgacatccacaacacgccgaacagcaggaagcccgcaccgaaacggatggtgttgaccttgctcagtggcttgccggtttcaggagacagctgcggatccttgtctgcagcggcgatgttggcgttataacgcaccaaacgctcctctttgcttgcgattgcttcactcatgaaactctctccttcgattcatgtttcagtagtgttttctgtgatattcctgttttccgatagggcttctctgcccaatcaactaactaccacttggtaactagctggttttcatcatagataccctttcgaaagaacgcaagtcagacgcgaatttttccaacggcagcgttttttcaaatagcaatccacaacgattcgccccatacggcaacttcagtttttattacttagtaactgcttagttaaagcatattacaatctcttgtatctgtcattttccggcgtgtcccaacgtttccaacacacttcctctcccccttcttgtaacttagtaagcacaagaaaggaaaacgcatgcgtcgccacatcgaaagcaaaaccaagaaacgaatgagcgcagaagaccgcaagaaagcgattctcgaaaccacggtctctttcatctcacaattcggattctggggatttaccattcgcgacgtggcacaagctcagaacatcaccgaagcaggcctcctttactacttcaaatccaaagaacaactccttgaagcgacactcaaatacgccgatcgcactaaccaaatcgccattgcagagcatcttggcgtcgaaggcgtgaccggcgaagtcttacaagacggcatcgcataccattgcgatctcggactcaaggccatctccacgggaaccgtggaaaccaacgcaggccgacccgaaatggttcgcctctacaccctgctcgaaagcgaggccctaagcaaagaccatccggtgcacgagtatttcgaacagcgcgaaatcaatctgctgaaggaatacacgttcgcagccaaacgagatggcgtcgtcgatccggaacgcaccgcactgcaggtgctatccgccatggaaggcttgcaattgcggtggctcaacgaatctcacgatatcgatttcgttggagaatggaaggccctgatcggccttctcattccctaaacgttctcttctcgagctctcttatcgcagatttcagccggcgatcaccgcaacattccagcggccgatcgtcaacggatcaccctgcttgacggctgcaccttccttcagcacgacttcagcatttgcaacctcatcaatactgccgtcggtggcgatgacgaccggagcgaccactacttcaccctcaatcgggcttgcaacagtaacttcgtcggcggaatagttgagcagatacgtcacgttctcgccacgggcattcacaccctggcgaaccgcgacctgtcccgcgagcgcggttccagcgccctcgacgccggcatgctccacggcctctcgcataaccgcacgaatggaatcggcgtcaagcagtgtggcgacccactcggcatcgcctttgccgaatgcgtgacgggtgactgcggcgtaatccttccaagcgtagtgtccataggatgcgagcacctcagtatcggcgtcggcgttcaacagttcgatcagcgactgagcatcggtggacgcggtttcggcgagcgcacctgcgaattccacggaaacgtggccgtttgggcgggtgaactggttgtacgtcatgccgaacacgtcggtgaggttgtgcggcgcgcggtcgtgccatacggtcacctcgtcgtcggtcacgaaggagcgcatggtggagacgaggtgtccgccgttttcaacgaacgcacgcaggcgatccgtagtttcctgagatgcgcagtagagcgccggggtcacgatcatctcgtatttggcgagacgttcggccggagcatcggacggcacgaaatcgcattcgacgttgagctcgaacagcgcgtcgtagacattgcgcaccacgtcgttgtatttgagggtgccgccgaatgggaagccggcttcgatgaggaaccagtcgagcgcggtcagcgattcgttgctgaccatgatggctactttgttgtgcttcttcaggtggacgagccgctcccccacttccggtttggcgatctcgcgaccgaatacgccggcttcgcagtacgtggggttcggttcgaggtcgtggctcagcaggcccttccaatatgtttcaaaggaattatggatggagtgccagtgccagtattccaccatgtcggcgccggaggcgaggtgggagtaggcctgcaggcgcagctggccggggaatggcacccagccgtgctggccttgggcctcggtttcgagcaccaggtagttctggccgttcttggtggagcgggtcatgtcgccgccgaaggcgatctccttgccggtcaggtcgtcttcggtcgggtggtagatgtccacgccggtgatgtccactgcggtcgcggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctgatcgcggcggaacttgtcgaattcgccgcccagggactcgttgatggtggcagtcacgtccgggaagtcctcccaggagtcgatgcggttggaccagtagtcgaggccgaagtggtggttgagctcgttcagatcgccgtggaacttctcatgcagatacttgacgaacagacgctgcatgtcgttggacacggaatcgtagtacttggtttcattatcgacttggtagccgatcaccgccggatggtcggcaacgtgggagatcagcttgcggatcacgcgctcaccgtagaaacggtaggtggcgttgacgatgtccatgatctggcgggcgccgtacttgccttcgccgttcggagtgaccgcgagcacgctcggatcgattttgacgagccagctcggcaccgcgtaggttggagtgccgacgatgacatcgataccgacacgctgtgccgcgtcgagagcacgatccacataggtgaagtcgaacgcacccggctgcggttcgcaggtgctccatgtggattcggcaatacggataacgttcagtcccgcttccttcatcatcctcatgtcttcatcgacacggtcgatgcctttcatcatgagatattcgtcgtaatatgcggcaccgaaaagaatgtgatctgcctcgtaacgacccatggatcctccatcgtcttcattgacttgttactgattgctactgtttctgcgtctaaggctgttcttctgcgatatccctgggatatatccttggatgcatcctcggaactctcatatctaacaaccattagatataagaaatataaatcttctagattcacttgtcaagaaccgcaaaatttcatggcgtgtcttacctaacaaccattagatacagcgtttccccttgaccaaaaccaaccaatcaccgcacgccacacaaaatgctatcccagcaggcaaatccatccagccactggaggaaccctcccgcaaacatgcctccaaaagtccagatccatccagccactggaggaatcaccccgcccaaaaccttccaaaagtcctgattcttccagcgagtggaagaattgggacgcgaaaggctatagaaacacagcccgcaagagagttgcacacggcttagcggtagctgtcccagacaggtgaggggaagatcatcttttcgaaggcgagccattcatcgtagaaatcgatgggcggcttacgcgtccaacgcagttgaatgccgtccatcgcttccaagctttgacgcacaatcgcacgcatattctcccaaccaccgatttcaggcggcaatttccatgtgtactgggaatagtgttcccacacgtatttcggacgattctcgaaatagtcgtgcaacggatggccctcgctgaaagactcggtttccagcaccatgtatagctgcagcaagctacgtcgactctcattgtaacgtaccaaaaaacgcaggtatgcgggaaacaacatgccttccggatcgctgcccggcaatccggattttgcaaaatcagccggagtgccttcctgatcataattgtcggtgactagcagcgacaacaaccgttccttattgccgatgtaatgcagcagtccaggctggctcatgccgatcgcatcagcaatgtctttcaatgacgttccgtaataccccttttccccgataagacggctcgccgcagcgatgatttccttcttacgttcctcaggtgatttacgaacacgtttcttcccctcattacccataaggaacagtgtactatctaccgttcattagacaggcaaaatcgtatcggaccgttgcatttccactcgccacacaaaaacgagccgatcttcaacagaccagctcgaaatcacattcagtcagcctcgaccaaccaaaaatattcgaaaagcaattttacttctggaacacgtcagggtgtttcggatcaccaggttcgtcggcgaggacgccctcgagcccgaggaactcctgccagaattccagcgaattgccgtacggagctgcctgatggccgcgcgcctgcaggttcgccttcgcctcgaacacatcctcctcgcggatgccatcgaaatacgattcgagacgctcacggttcgtcggatcatagaacagcgatccgatgatttccgtcagtcgttccgcgcgcgctaccggcagtgaatcccagtgacggaattcaatgaagttcttcagacggacatcgttgaaatgcgtggaaatcacatgattgatttcgtatgcgttgagttctcgatcaggatacacgtcgttcgcattctcatagaatgcaggatgatgcagatcagttccgggagtttccaacgcttccggagtgtgcgtcagatcagcgaacatcatcggcgtgctcaacacgtcgaccgcataatcttcccaaccgaagcgaggatcaaacaatcccggaataacgttcgtgcgctgcaaatccaaataatcccacatgcgttggcgcagcagcggatacggattctcctgtccctcgaaatacggggtgttacggaagaaccatgcgagaatcgggccgaccaccgtacccaaccgcagtttggaaatcgcgtcctgttcggaaacatagtcgatgctgacctgcgtcgaagcggagcaacgcatcatgcacggaccgaactggccgacgcgccccaaatacgcggtcatcgccttgtaacggtccttcggattgacaggaatgtcggcatagccggacttcggctgatacccgtaattaaccaagcggaagccgagatcgtcaagcacaggatcgacttcgcggcggaacgcaccatagatcgtgcatagatcttccggcttgtgcagaatgcccagcgagcattccagctgaccgcccggctcaagtgacacggaaataccttcgcggccaagaccaacaagcctgccgttctcccagtattccttgctttcgtcgtaatatgggcgaatgcggttcagcaacgcctcgataccgttctcctcgtaatagttcacggcggtatcatcgctgttatgcaccggcagatgctcgatttccacaccgaaaccaccggttccacgctcttggcagcctgattcgaagaatttgaccagactttccacatgcttcggattcggctcggtaagcaggtgcgcataagaaattcgtggcgttgtcatgttggcaatcctatcgaaactcgttgatgagcacggcgcgattgctatacgaaaaactgatagccaactcttgcgtatatcgaatcgaatacacattttcggttaaaacagacatgctctgcaaagccgaccaataataattaacagctattaataaagtcagaagcaattaccactattcgaagaattgtttgtacatatcgaataaaaataccgacgctgaagatgttgtcagcgtcggtattttagtcaattccggtcagtgcttattgatttatccgcctatgatcaggcagctttttcgctttgcgccgtctcaccctgttacgcagccttgtgggccttcttggcggctgcgatcatcagtttgatgcggttgagctggttcgcttcggatgcgccaggatcgtagtcgatggacacgatgttggcttccggatgcaggcggcgaatcttgccgaacatgcctcggccggtcacgtggttcggcaggcaggcgaacggctgcgcacaaatcacgttcgggcagccggattcgatgagctcaaggatttccgcagttagcagccagccttcaccagcctgcacacccacggaagtgacctcgtcggccttcttcacgagttccggcatcggcaggtcctgggagaacttgccgtgtgccaaatcgatcgccttgcgtacaggagcgttgtacaagtcaagcgccttgcgcatcagcgcgtagccaagcttgttgccgcccatgccgaggtaatgctcgttccagtcggaaatatacgggcgggtggtcatgaattccatgatgcccggcaccacagcctcgcaattctgcgattcgatcacgtcgaccacatggttgttggcgtccggctggtacttgacgagaatctcgcccaccacgccgacgcgcaccttgcgcggttcgtccttcaacggcagtgagtcgaacgatttgacgatttctttgacgagcgtcgaatatggcaggtatcccttgccaatgaacttacttgccgtcttcgagcgaccgtggttctcgagcgtttcacgcacgatggtgttccatgtcttatacagctgattcgcactgcccggcgtcacctcgtacgggcgcacgcggtacagacatttcatcagcaggtcgccgatgatgagcgccttgatgacgcgatgaagcaatgccggcgtcgctttgaagcccggattgtcttcaatgccctgcgtggaaatggcgatcactggaatttgcggataaccagcatcgatcagcgccttgcgaatcagaccgaaatagtttgtggctcggcacatgccgccggtctgcgtgatggcgagcgcggtgtgttccggatcgtatttgccatccagaatcgcgtccacgagctggccgataaccatgatggccgggtagcaggcgtcgttgttgacgtatttgaggccggtttccacgttttcgcggctggcgtgttcgagaatgtcgaacttgtagccgccggagcggatcacggattccactagggagaagtgaatcgggctcatctgcggagccacgatggtgtagtccttcatgtctttgccgaatggcacgcggttggcgtatttcgacatggtggcggaattgtgtgcggacttcttcgcttcgccgacgccgttttccgcggcacgcttggatgcggctttaacggcttcggtgagtttcggattggctttcatcacggtgtcaagcatgacttgacggcccggagtcggcgcctcagacccggtcttgcggaattcgccctgcttgttaggcgcactgtcttgtttgttaggcatgactgcggcgattccgcgctgcttgttgcgttcgcgttcttcgacggctgccttgagcgagcgcagtcggatttttgccgctcccaagttggagacttcgtcgatcttcagcatggtgtacacgtcggccttgtcggcgaggatttcgcccacctggtcggtggtgatggcgtcgagaccgcagccgaaggagttgagctgtacgagttcaagtcccggataggaggccacgaagtttgccgccgagtacaggcgtgcgtggtaggcccactgattggtgactcgcaacggcattttggtgaccttgcggtcttccacatgacggaagccgtccgcgttcttcttgcgcggatcgtcttcgtccgcggcgaggaaatcactcaggttgagcttctcccccggctgcagttcgcagatcgaatcttcagacaataccaccatgccgagcgagcagatggtttccggaatgccatggttgacttccggatcgatgtggtacgggcggcctgcgagcacgatgcctcggcagtcgtgttccttcatgtaggcgagtgccttgaggccttccatctgcacatcgtgcttgaagacttcgttttcggcataggccgctttgactgcggtttcggcttcttcacgggtcacgttggcccaagcgaattcttcgacgatacggtcgaccatgagttcatggttggccatgttgaagtatgggcgcatgtaacggatgccctcttcgcgcagttccggcatgtttgcgccgatgaccacgggatagttggctactaccgggcagttgtagtggttgtcggtgttgggtaccaggttctcttcgtagctgacgcacggatagaagatggttttcacacccttgctcagcagccatttgatgtgtccgtgcacaagtttggccggatagcagatgttttcggatgcgatggattcgatgcctgtttcgaacagttcatgcgagcttcgtccggaaatcatcactttgaagcccagcgaggtgagcagtgtgaaccagaacggatagttttcgtacatgttgagtacgcgcggaatgccgatttcgccgcgggttgcgtttttgtcggtgagtctgcggtaagcgaagcaacgcttgtacttgtaatcgtagaggttcgggcgatcggaacgcttctttttcgcgtctccgcctcgttcgcagcggttgccggtcacgtagcgggatccgtcttggaaggtggtgatggtgagcttgcagtggttttggcacagtttgcacacgtctcgttcggaggtcatcgacaggttgtcgagttcttcgccgctcaaaatgttcgatgcggtatggcatacgcctgcgatcaccgcctctttggtgtcggtggtatcgacgtcttcgtcttccgcttcgtcggcatagtgcatgcgtgcggtcagtgcggcaccgtatgcgcccatgagtcctgcgatgttcggtcgggtcacttcacggtctgtgagcagttcgaatgcgcgaagcacggcgtcgttgaggaacgtgccgccctgcactaccacggtgtcgccaagttcgccggaatcacgcagcttgattaccttgtagagggcgttgcgcactacggaatagcacaggcctgcggcgatgtcttcgatggacgcgccttccttttgcgcctgcttcacggacgagttcatgaacacggtgcatcgggagcccaaatcgaccggatgggtggagttgagcgccgcttgggtgaattcctgaatggtcagacccatggaaatggcgaacgtttgcaggaacgatccgcagccggacgagcatgcttcgttcactgcgatggagtcgatcacgccatcgttgatggcgagatatttcatgtcttggccgccgatatcgatgacggcggtaacgcccgggctgaccatttcggcaccgcgatagtgagccatggtttccactacgccttcgtcgaggtgcaggccggtggtgatgaggccttcgccgtagccggtcgcacaggatcgtgcgatccatgcgccttcaggtagttcggcttggatttttttgacgatttgcactgctgccgtcagcgggctgccttcgttggtcgcataagaggaccatacgatttctcgatcgtcgttcaccaacgtcgctttgatggtggtggaaccggcgtctatgcccaggaagtgcggtccttgggctccttcgagcgtgccttgatggatatgctcgcgatgatgccgttcgttgaatgcggtgcgatccgcctcggtagcgaacagcggaggcatggtcggagtgttggacggcaggttttccagttcgtccagtcgtgccagaaggtcggcgcaggttcgtgcttcgtaatgcttagtcaaggtcgtcaccatcctgatcggcctgcaatgcggcaccgtatgccacatacaggtgagcgtcggtcggaacaatgaattcgtccactttgccgtcgagcgcccgcttgaacgcggctctcagttcggacatgaagaacaacggaccacccaggaagatcacggttccgtgaatcgggcgtccggaggcaaggcctgcaatggtctgcgtggccactgcggtgaagatcgatgcagccagatccggcttggccgcaccatcgttgataagcggctgcaaatcggttttggcgaacacgccgcaacgtgatgcgatcggatatagggtttcgtattgcgtggccatttcgttcaggccagcggcgtcggtgtcgagcagtgttgccatctggtcgatgaatgcgccggtaccgcctgcgcaggaaccgttcatacgctgttccggagtcggcttgagatacgtgattttcgcatcctcgccaccaagttcgatgatcacgtcggcctgcggatattccttgtcgatggcttcggtttcggcgatgacttcctgaacgaagggcacgtcgaggctgtctgcgagggcaagaccgcctgaaccggtgatggccaggcgaatcggctcgtcacctcggccaagcttttccagctcctggtggatgtcggccaatagtccggccacggtggcgcgcacgttcgcgtggtgacgccgataatcggagaacagcgcgtccatgagcgcgtcggactgatcgagcaccaccgccttcacagtagtggaaccgatatcaagacctacacgcaacggctttgtgccgtgcgtttcggtcacggcttctgctgcttcaaccatgtctcaacctctatcgttctatccgccgggctgcattccatggcaggcatggaagcccctgccccgggttatccaatcatgtaatcgtagtctgtgcccacgcctaagtgctttgtaaatgctcgcaatcagcataaaatgcacgacacagcgcacaaattagacaactaatccagtcaacgtgcctaattatgtatctggacgctcgacgaatgtcgagatcgcaaacccttccaagcatttccatgtcaggatgcgctgccttcccctgcagaacggtctttgccgtatatttcgggaatgaatcgtgtttgatcatgtagtttcggccagatcaccacttgtccgctttccagtgatttcggcacgtcgatgatgcgttggttgctgcttccgcggaattgcagcagggaatcatgtaattctttgatataacggccatccacgagaatgtcgatcagttcgagcagctcgcgcttgtcggggctttcgccttcgcgcatgagctcttcccacgtgtagccggtccagcaccaaatatctttggtattaccgaaccgttcgcgtattttgcgcgcaaggggcaacagcacgcccgtgttgagcaatggttcgcctccgaggaaggtgatgccttgcacatacgattggcttaagtcatccatgatttgcgcttcgagcttgtcgttgtattcgtggccggcttggaaatcccagattgacgtgttgtagcattcctcgcaatggaacgggcagccggacacgtacagcgagcatcggatgccttctccatcggtcatgaggaaccgtttgtagtcggcgatcatattgcggctcatgcggttggtccattgccctgctttgggattgttggaacgagttgtggggatgaaaggtccgcgattggtttcgtccgccgcaaagtcacgacgttgaattgctggattcgcgctgctgatcatacgttgtcccttcacgttttgccgttacgtcgcgtttttgcgattgctgcttgcctcatgattgtcacagaatgaaagagggtggaaacccaccctctttcatatttcgtttatgtttgctaccgacgcggcccttacttggcttcctcgaaccattcacgttcggaaccgtcactcaaggtgacatgaccggtttcgccgctcatatgcttgacgcggtgcgcgatctcctcgtgacgtccatgcaccatcgggcgctgcaccgggttgcccaagtagccgcaggtgcgcttggtcacgttgcagtggtccgggtcggagttgccgcactccgggcacttgaaaccttcctcagtgggctcgaagtcgccttggaatccgcaatcgtagcagcggtcgatcggcgtgttcgtgcccaggtagccgatgccgatgttgtaggcgtaatcccacaccgcttcgagtgccttggggttggactgcaggcacgggaactcgcagtagttgatgaagccgccggacgcgtagtacgggaagtccttctcgtagttgagtttttccattggggttggctgcagccagaccgggtagtggaaggagttggtgtagaagtcgtggtcggtcacgccttccacttcgccgaacttctcgtggtccatacggttgaagcggtcggtgagggattcggccggcgtggagtacacggaatagtggtagccttccgcgtcgctccattccttgcacagctcgttcatgcgcttgacgatggacagtgcgaattccttgccttgcggatcccagccgtgatcgcgcatccagttcttgccgtagaacacgctggtcgcctcatacaggccaatgtagcccagggaaacggtggcacgttcgttgcggaacagctggtcgacgctgtcgttggcgccgagtcgaccgaaagctccgaaacggaacagggtcggcgcattgaccggcgcggcctgcttgcaacgcatgatacggaattgcaatgcctgatgagccacggccatacgctcgtcgaagatcttccagaagcgatccttgtcgccgtgggattccagtgcgatgcgcggaacgttcacggtgacgacgccaaggttcatgcgtccgtcttccacgtccttgccggtcgccggatcaatccaaccctgcaagaaggaacggcagcccatcggggctttgaaggagccggtgatcttcacgatgttctcgtagaagatcacgtccggatacatgcgcttggtggcgcattcgagggcgagctgcttcaaatcgtagttcggatcgcccggatcggcgttcacaccatgcttgatggtgaacacgagcttcgggaaaatggcggtgtgatgttcggaaccgaggccgcggatacggttcaggaagatggcacgctgaatctcgcgggcgaaccagtcagtgcccaaaccgaagccaacggtcacgaacggggtctggccattcgacacacgattggagttgatctggtattccatggtctgcatggcatcgtagatggccttgcgggtctggatcttcgcccacacctcacgcagctgctgcaaacggctggcatccttattgaacggctcgtccatcggcagggccggacggtccttttcgaaatgcagacgcttcggttcgacatccttggccaagcgcacctgacgttcggcgatttcgatcggcaggtcgtcaggcatgatctcgtgggcctgctcaaggaacttgtcgtaatccttgcgcgcgtattcaacgaagttctcatcggcacggttggcggtctggccaccatactggctggatgccacgtccttcatgatctgggtgatctgcgtggccgcaatggaaatgctgttcggcgagcccatcggagcgttgcccagagtgaaaccgttggcgagcatatcccaatagttcggcagcgagcagttggactgcgcggtgaacggcgagtagtcggcgtcgtggaagtggatgtcgcccttcatatgcgcgttggaaaccgcgtccggcatcatggagaaggccgcggccttggaaaccgcacccgccaacagatcgcgctgggtggagtagacgttggaatccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcgtacaggtggtcttcgatcaggccgtgttcaacgagattctggatgtcttcgatcttggcgggaccgttgtaacgatccttgatttcggcttcgacctgattggcgatatcacggatcagctgttcctcctgcggcccgatcttcttatcaaggtcggcgaaggcggacttcaccgcgctgatgatgttgatcggatcgaagtcgaccacacgaccgtcgcgcttctcgacgagtaccttaccggttcccgttttaacggttgcggagacggcatccagagcctgcgtttccattcatcgtcctttccgggtcggaccccatccgaccaggttttcatgcttcgttatgcatgccagattgttgctacgtccatgactgtacgccatagccagcactaaatgtagtagcggcacgccggcagtaaaactatatattccatttttcggcttgattccgccattccttaacttgtgtgacaaaggtaacgatttcgccacggagtgtcgcccgagtgtcgatttgacgcactcaccgaagagggactatacaaggcggggtaccctcacggaattcgaacatgtgtttcatttgtccgcaagatgatggaatcttgaactatgacttggaaccaggattacacacccccggcagcgcagccgaacagcaaaccgctgccacgactggccggcgaaaccaccgctgacaacccctggccggtaagtctgctcagcgagaaattccatatggccgtcgaacggtggccatcggtttgggtggccgggcagatcacgcagatcaacaccagacgtcagggcagcgcctatatcactctgcgcgatgattatcaggacattgcgttggaagtcaacggtttcgggcagttcgccgcagccgccacgcctttcgtgcagggcgaccgcgtcatcatccatggcaaaccgaatctgtggatgaagcgcacgtcactgtctttacgtggcgacgccattatcgcggccggcgcaggaggcagcctgaaggccatgatcgacgaattacgcaagaagctgaaaggcgaaggcctgttcgacgctgaccgcaagcagcctctgcccgagtttccgcattgcattggtctgatttgcgcgccgcaggctcgcgccgaaggcgatgtcatcaccaacgtgagattgcgttggcctgttgtcgatttcaaagtgacgcatgtgcatgtgcagggtgagcagtgcccttccgacgtgatcaaggcgatcgcgcagatggatgccgatcctgatgtcgacgtgatcatcgtggcccgtggcggcggcgctttcgaagatctgatcgggttctccgacgaaggcgtggtacgcgccgcggcagccgcccatacgccgctgatttccgcgatcggccatgaggatgattggacgctgcttgatctggttgccgatctgcgcgcatccacgccaacggacgcggcgaagaaagtcgtgccggacgtgcgcgagcagatgcaactgatcaacgtgaacatcgaacgcatgcgcatgcgcatcgacgccaccgtcaacaatgaaacaagactgattgaaggctatgcgaaccgtccaagcctcacacagccgctcaccatgctggaaccgcatcagcgtctcatcgatgatgcaagaacccgcatgagaatcggtctgacacgtattcttgacgacgcaagcctcaccatcgaaaaagcgcatgcctcactgaccgcgcttagcccgcaatccactctcaatcgaggttatgcggtagtgcagggagcggacggccatgtaatcgacgatgcgaacgccgtgaacaccggcgaccaactcaccatgacattgaagcacggcgtgatcgtgtccgaagtcaccaccgtaacgaaggagtagcaatgatcaacgaaaccacccccgcatccagcctgaccgacaaggaacgcgaagccatcgcacaaatgccttacgaagaggctcgagatcagctcattcaggccgtgcaggcacttgaggccggcggactcaaccttgaccagtccatgcgccagtgggagcttggcgaagccctcgccaagcgcgctcaaagtctgctcggcgaagtgcgtgccaagcttgacgcagcccaggcggaacaggccactgcggccaataccgctggaacgcaagacaatctggcctgaaaatctcaaaaaccgccaatatatcgtttctacatgactgtgcgccacgtacttcatgcagcgcacagtcatgtagaaatttcggatttcttcatttcggcaccacactcgtccggatggtgtgtagaatgaagattcgttgcctcagtagctcagtggatagagcacttctctcctaaagaaggtgtcgtaggttcgattcctatctggggcactttgttttatgcggatacgcagccgatacgtagttgcgccggcactcttctcacacgtcgaattgcacggttgccagcaacgccttgtgatcacttccgtcgattttcaacgatttgacccgacctgccaacatgccggaatccaatacgatatggtcaatgcccgcaaacgtcggcacataatcgatattcgcaggccacgtgaataccaatcccccggccgcttgtttggccgcatccgcgaaccgtgttcccaagaaattacggaacggtgcatgatcgtcggtcgcattgaaatcgcccatgaacacgtacctacgagacgtatcgtaccggagtcgaccaagctcatccaatgaacgcttccactgctgccaatatccatcggtcggagacgtggtatgcaccgaaacgaaacggatctgcgtctgaccatcattgaatgcaaccgtggctcctggcatgaacgacgcgctcgaatcaacatcatcatcagctggatcaacaagcggacccgccgaccacaaaccattgccatacacgccgtctgagcttgccacctgcgcatacggcagcaaatcgccaataccagccttgttcaactcgtccacgaaagcatcggtcgtttcttgcaatgccagcacttccacacgctcgctacgcaccacatcgacaatttcctgcgcgtcggcacgacccttaaacacattgcatgtcatcaaacgggcataatcatcctgcgtattggcggacgctcccgaaaccgctgcaatcgcggcacgcggaagcttcgtctcattgtagaaaaacggatactgccaccatacttgcaacgcgatcgccgcaatcgccagcaataccgacattgttcgtttcgagacaataccgcaaatcagcgcaatcaccgcaagaatcgcaaaccaaggcaccaacgaaacgataatgggaacatacggccacgcctgaatctcagcaggcagtatgtgcgaaacagtgcccagcaaagctgcaatcgacagaatgccagccagaaaaccgcatatgatattgcgcacgcgatgcgacttagctttcttcaacgtacgaacgggtttaacagccttcccctgcgctgtacgaggttttgcaccacccattgccaatcgccctccccaagttcctcacacacatcttatagacgcattgaaacagcatctattcctttggtggccttcatggcctaagcaccgccatcaattgccacccgttcaccttcgcgcatagtacagacttggcattgacttatgactcatacaacaaaaatcccgaggagcagtgctcgactcgggattcaaaaaagtttaagtgcggcaacgtgctactctcccacaccctctcgagtgcagtaccatcgccgtgctaggccttagcttccgggttcggaaagggaccgggcgtctcacctaggctatggtcaccgcaagagaaaagaatacgcgcatgcgcctcaatcaccaaatcacggcgtgtcgcactatgttgccgttcttaaattctcaagaacacaatatttctgcgctaaagtcgaaggcatgcaagcgtaacttccatgaaagaaggcaacaatgacgatagcctcctgcggatcggtttccgcaatcactcttggacttccgaattccaccgcaatctcctcagaaaaggcgacgttgcccaaagggctgtttgttgcgaaagttccggtttccgctaaaacgaagcagcgtctagccactgaagtcgaatcgatcacgatgctttctctgttgcgaccgcagaatacttcgctcgctgcaggcaatcgcattcctgaaatactggtgttgggattacgtttgcatggcaagaatgcttcagttcctacggatgtcgtcgaattgatcgccatgcaacgcaagtcaggcatgctgttcgcctgcgtacgcgatgccgaaattgacggtacggtacagaaggaatgcgcgtttgcagtgcgccgcgcgttgccgggacgcgccgggcatactccaacattcaaggtcttcgcctccgcatgggttcccgccgatgaagcattgctggatatttccgatccggctgtggattccatggatacgctttgggaatcattgtgcgcacaggtgattctcggtgattcatcccccgcagaagtggatgcccgtatggtacggaacgcgcaaatcgcgcagttgaaggccgatatcgacaagctgacgcgagatcaccagcgggtcaagaattcagcgcagcgcaacgaaatcttcgcaaaacttcacaaggcgaagaaacaactcgaggagctgcagggctgaaccaagcacccgctggcagttaggcgaataatcgtcagaaaccgaggcgagtgcgaccaaattggtcgagccagcgcagaatcgcgccctctcgcaatgcccacgggcagatttcgatttccttaacgtcgagcgccttcatgatttcgtcaaccaccagaccgccgccaacgatctgatatgtacgctcgggggttacacccggcagcgccacacgctggtcgggggaaatggccgcgagtcgcggaagccagtcttccagctggtcgagcgtcataatcgacgtgtccacacgacctggctggcgcatcaccgcgccggcgagacgagccaaggatcgaatggttttcgatgtgccgacggcatgcatcggatgcttcgacttcgggaaggcctcgaccatcgggtcgaggattttgcggatgttcctacgcgcgttttccagatccttttcgcttgcaataccgttctccggcaggaattcgcgggtgattctgccagcaccggcaggcacggacaacgccacggtcggatcttcgtcagaacccatggccacttcgagcgagccgccgccaatgtcgatcaccagcaggcgaccggcatcccagccgtaccatcggcgagccgccaggaaggtgaggcgtgcctcgtcaacaccggaaagcacggtgaccggctgtccgatggcgtcttcgatgcggcgcaggatcttgccgccattcggcgcttcacgcaatgcagacgtggcgagcaccagcagctgggtgatctcgtattccttagccagctccatggccttctccactgcggagatcacggcttcgactccggcttttttgatggtgccatcttctttgaggtactgcatcaggcgaacggtgcttttagcgctcgcctcaggctcaggtcgggctcctggagccgcatcgacgatgagcatgtgaacagtgttcgaaccgatatcaagcacgccgagtcgcgtggcatgcgaatgcaaactgaccataatccaacagcatacttactgaagcgcttaatatgttgcgcgacatgccattgacaacctttgcattttcttggcgcaaatcaggagaaaaagggtgtccgcccctcttatagagcgaaaaacaacgattgcaatcactgaaaagccatatgaaaaaaggcggctccaaccgatgtcgccatcgcgcaggaccgcctttatcacacaaacaacagtctcaacagaccccgtaagaatcagccacgcagcttgtcaacaaaatcgccaagacgacgcaacccctcacgcaacgcctcgcgcgaggccgcatacgacagtcgcacatgcgtgtccgcggtcgcctcgccgaaatcacgaccaggcgtcaacgcaacatgcgcttccttcagcgcacgctcacagaacgtccacgcgtcaagaccagtgctggaaatattgaaatacgcatagaacgcgccattcggctcaacctccaacggcagaccgatctcagccaatccgtcgaccacaatgcgacgacgctccagcaactcctgacgacgttcctcgcacacggccaacgtttccggagtgaagcacgcgagcgccgcatgctgggtgggagtatgcgcgcacaggaagaagttggtggcgagatcgtccatggcttcgagcgcgcattcaggcacgaccatccaacccagtcgccagccggtcatgccgaagaacttggagaagctggagcatacgatggcgtccgggtcgcaggcgagcacggatttcacgtcggagccgtccggttcgcggtcggccaggtcaaggtaggtttcgtcgacgatacgccatgcgccgcgttctttcgccaggtcgcacacggatttcagggtgtcgaaggcgatggtggtaccggtcgggttcgacggcgaggtgatcatcaccgctttggtgcgatccgaccagtattcgtggcacagttccggtgtgagatggaatcgggtggtcgcattcgtcggcacgtccacgactttgccgccgaacgcgcgaaccagttcgcgattgcacgggtacgacgggtcggcgatcagcacctcgtcaccctcgttcaccgtcaatgcggcggcaagcagcagtgccgtggaacctccggccgtaatcgcgatacgtttcggatcgacgtccacatggtggcgttccttgtagaaatcggaaatcgcctgacgcaattccggcaaacccattgcggcggtatatggcaatggacggccatcatactgttcgcgcatcgcatcacgcactgcgagcggagcgccgaaatccggctcccccaagctcaacttgaccacatcggtgcctgcggcgatcatctcgtcggccatcgcaccaaacaccatggcacggaacggattagcaatctgggcgcggtgcgacatctgcggcagcgcgctgttctcagcatttcccatagttcgtttgtattcttcagacacgacaaatcacgctgaatcacaagcatcgtctcaccgacgttacataccgtttcgaaatcaagaaaaacaagaaattaatcgagcatacatcacgtatgttcggcaagaatcacgcaattgcaagtagatcgcataaatgtcgatcaagcaggttgcgtgccgacgatttcatgataaagccgttccagccgttcctcacgtacttttttggcgagctcgcattcccacaccacgatcactttccagcccatcgtttcaagttcggcatgctgcctgacatctcgttcgtggttgcgcagcagtttcgcactccagaattccacattcgatttcggcacgcgcgtggctttcgggcagttttcatgcatatgccagaagcagccattgacgaacaccatcgtgcggtatttcggcaacaccacgtcgggatgtcccggataccgcttgtcgtttttgcggaatcgcagacctttcgaaaaaagaaaactgcgtaccatcatttcaatggatgtgtctttgcctcggatatgcgacatgatgtagcttctcgtgccacgctcgtatttctctttttttgcggatttccgaggttttccggtcttcttaacgtgttcctgcgctgccacagcacaccattatggcaagatccggcaaaatacggcaaatcagaaaagcatccggacgaacgcgtgcaagtgcgatatggatcaacgcgcgttgcgatcatgcatggcgtacgctggaacttgcaacgcagcaatataaatgaatcaacactattcatgcagtttacgaaagatggggtttgatatggctcgtattcgtgtcgcgattctcggcgcaggccggatcgcgcaacatatggctgacacgctggtgaaaatggccgaagacgttcgttatgcggatttggtggaaccgtatgctgtcgccgcacgaaatgcggtgcgtgcggccgatttcgccgcgaaatacggttttccagtttcatacggttcatatgaggaacttgtggccgatccgaacgtggacttggtgtacatcgctacgccgcacaatctgcatgcggaacaggcgatattgtgcatgaaagccggcaagggtgtgctggtggagaaagcattcggcgcgaatgcggcacagacccgtgagatgttagccgttgcaaaagaaaccggcatgctatgcgcggaagcgatttggacgcgatacatgccgtcccgcgccattatcgataagattctcgcctccggtgcgattggtgaaatacaggcgatcgatgcgaacctgtgttaccccaccaccgcgaaggcgcgaatcactgatcccgcgcttgccggtggcgcattgttggatgttggcgtatatccgatcaatttcatcgacatgatcatgcataatgcgccgatcgctcgcattgaatcgtcgatgcgagcgtacgaaaccggcgtggatgcgcataattccatgacgttctattacgagaacggtgtgatggcgaccgcgcaaagttcgattctgtgccatagcgaccgcacgggatccgtgtggggaaccgatggttatatggtgtgccagaacattaataatgttgaggcgattgacgtgtatgacggcaatcatacggttgttgcacattacgatgttcccgcccagctcaccggctacgaatacgaggtggcggccgccgcacaggccgtaatcgacggtcgcaccgaatgcgaggaaatgccccacgcagacaccctgcgcatcatggaactcatggactccctgcgccgcgactggaacctcacctaccccttcgaacgttaagctccaatattagtttcagcgtcggcgaattgcgattccgttcacacagccgacgctgaagcattcattggcagcacatataatttctccttgcactggttgaggaggaacattatgggattgctgagcaagttcatgaacgcgcttattggagaaccgcccgtctccaaaacggcgactcagcccgggcccaagcttgcgcggcaaaacgttcccaatcccacgcaacagcagacgacgcaacgcaagtccactgtacaatcacgtcaaacgcaacagcttacgcaaccatcccaatcatcacagttggcgcgatcgtcataccgcgcgcaaacacaaaccacagctcgcaatacttctgtcacaacgaatcgttcgcgagcgcaatctcatgccaattcacaaccggctcagaaacttatgccgcaaccaatgctccctgccgagcagatcgaacgggcgcgaaatatcatcggcaaaatcgaaaagcatgagttaagcgacgagcagatcagcgccatcgccggagcgggtcacaatacgctagtgctcgcaggtgcgggaaccggcaaaaccactaccatcgtcggctatatcgcatggctgctgaacacaggaaccgccactcccgaagagattctggtgctatcgttcaccaaagcttccgccgacgaaatgtcgagccgcatcacgcaaagcaccggcaaagtcattcgcgcatgcaccttccatagcctcggactggaaatctgccgttcctccaccattgccaatcgtccaattattgacgggcacacgtcaaacaatgtggtgcgtaacgcatttgaatacctgcttgaacacaatgtttcctatcgtcttctggcatttaaacttatgtcgcaacagttgcttgataaatattccacagctgcacgacttgagaatttccagcttccaacagacgattatgcattcaatcaatatcgtcagaatcttatcgataccacacaaactattattcagcacatgcgatcaaacaatattgacattgccggaatgcaaacccttaacgaacgttatggcggtaaaaacatcggtcgcaatcgtgagatgctgcagctcatagaaccgctttatcatgcctatatacagaatttcaaaaccaataatggcattgattttccgggaatgatcgttgacgccatcagttgcgtcaataatggctcgtaccggcacccatataaatatgtgctgattgacgaatatcaggacatgtcacgaccgcgctatgaattaattcgtgcgcttcgcttacaacatgatttctcactattctgcgttggcgatgattggcagtcgatttatcgttttgcaggcagcgacattcatctcattctcgatttcgaccgaatttggcgcgcctggggtccgaccttcatgttccagatcaccaccacacggcgcttccgtcaaagccttattgacgcaagcggagcattcgtgatgcgcgataccaatctgtatgtcaaacatctcaataatcccagcgataagaaggattattcgttgaaagcacttggcggacatactgaggaagaacgattcaatgtgattgtcgagcagttgcgcaaactaccgaaaaccgcgtccgtactactgctgggccggtatcgcagcgatatcaatctcatgattcgttgcgatcaagaaggtctgttctccatcgaccaaagcactggaaatattcgttttctcgaaaaaccggatatggatattcgtttcatgaccgctcatgcgtccaaaggattgcaacgcgacttcgtatttctgctctgctgttccggcggattgaaaggctttccaagcacgattcccgaagagccgctgcttggtctgctactgccggaagtggagcgatgcccgcatgcggaggaacggcgactgttttacgtggcgatgacccgatgcaagaagaaactgttcttcatcgtggatcagacccgtccgtcgcgattcatgtatgaactgcatagcaagatctgtccgaacattttccgaggagtcaagcttcctccgcaatgcccgaattgcggcgaagccctaagcttgcggcacaatcgcaacgatccgaaccgctcattctacgggtgcaccggcttcccaaactgccgctacacccaacaagcaaaataagcgtggcatacgtgatgtgaaagttttttcttccaaagatcatttccagctcttcgtcaatgtctgcatgccctatactgctattttgtttcaatcttttgggcctggcgcgatcgcccccgttgtatcctggatctgattttccgacaagagaggaagccgcgatgtcacgtaagatcatcaatgttgtgggcgcggccattatcaaagatggcgaagtattgtgcgcacgccgtggcgaaggcaagtcgctggctggatattgggagtttcccggaggcaaaatcgaacttcacgaaagcgcttcgttgcaccgatgatgagcttggattattttccggaacgagtaaaaagcatgatcgtaaatatgtgtttgccactgtgcaaaccatgtctcgtccggaaattcttgcacaattcagcaaagatgatttcgattatattttgatcgacgaagttcaccatgccgccgcagattcatataagagaattatcgattatttcactcctgatttcatgcttggcatgacggcaacgccggaacgtactgatggtgcgaatatttgtgacgtgctcccgccacctgaccgcttcgcggtctgagggggcttcctgctcaaggctcctagcggagtcagtgtctacaggctattcccgtgcgccccacggttctcgtaagttttttgttatcattcctgcacgagtcgtcgtgtttcgtgcatgatgttggtcgcggcgttcacgtccctgtcatgccagaccccgcaatcggggcatgtccattcgcggatatacaggttcttcgtatccttattgcggtagccgcaatcggagcatagttgactggacgggtagaacctgtctaccgtgaccagctgcttgccttgtcgttcgagcttgtatgcgagcatggtgcggaacatgccgtacccgttgtccatcgtgcttttgccgagtgcgagggattggctcatgtccttcatgtccaagtcctccacgccgacgcaatcatatcgggcggcgagccggttggccgtcttgtgcaggaagtcggctcgctggttcctgaccttggcggcgagcttggcgatgcgccgcttctgtttcacccaattaccggaccccttgaccatgtggctgagtctgcgttgctcgcgcatcagccgtggctccatctgccggtagaaacgcgggtagtcggcttgttcgccgtcgctggacacgtacaggccgtgggaggcgtaatccaatccgacgatatgcacgggtcggacgggttcgggtgcttgggtctcgtactcgaacagtatcgtcgccgtgtatccaccgctcttgagatgttccaccgtggcgcttttgagcttccagtcatcgggaatcgtcttgtgctggcgggcgcgcatcacgcccactttgggaagtttgaggtatctgcctccttcgatgagtcggatgttgcggttgttgttgttcgtcgtgtaccgccatgcgctgcgatgcttcgccttgtatttcgggaagcccacatgcttggggtcgcggaagaaattgttgtacgccttcgccacgttcaattgggcgttgcatagtgcgagactgtccacttcgcgtaggaacggatactcgtccttgtactgggcgggcgtggggttgcatgacttgccggtgcgattgtacgtgtcgatgcgggtttcgagcatgagattgtagacgagtcgcgcgcaccctatcgtccggtcgatgagaccggcctgggccttgtccgggtagatgcggtacgtgaccgcgcaatgccgtgtgacctgcatgacgcgcctcctacctgcgtccctgattctcgatgtagcgtcgtaccacttcgatgggagcgccgcccgtggtcagcaggcagaagctgcggctccagaaatactccttccacagtttctgccgaatctgcggaaactcctgcttgagcagacgactcgacgcgctcttgtaagcgttgatgaacttgctcaactcactcttcggctgggcgcggaacaatacatgcacgtggtccatgtcgtggttccattcctccacggttatcccatacttgggtgcgatgtactcgaatatctcacgcgcacgcgccgaaacgatatcgtcgaacaccttgcgacggtatttcacgacgagcacgagatgataatgcaacaggaacaccgaatgatgattcgactccaattccattgtcacctcctcgattacaacatgtacgactgaacatcattataacatgcgaacgcacgccaattcatctcccgcctacgctccgcttagagacgggagaatccttggcgaaatcagttgaattatttggcaataacgttgcgtatgagattcgcttgcagcaggcgcttgaagaggatatgctctgcccgtcccactattacggggttggcgaatacattagcaagtttatggggcagcaggtttccgctgattccatgacagacaaggatcgcactgagttttcccgttggctcgaacagctcaccgaccctaatcgcgtgcgctatatcatcgacaaaatccagatttacagcgaagccggaaccgatgtgcgcggtttggtgttctgctctcgccgtgatgaggcgaaacgtctgtccgccatgttcaacgagcaggtgaatcagcaggtggaacgaccgtatcgcacgaaagccattaccggcgaaaactcgcaagccgaacgtgacgaagctgtcaaacagctgaaaatggcgaacttgactatatcttcaccgttgatttattcaatgaaggtgtggatattcctcatatcaaccaaattgttatgcttcgtcaaacgcagtcgagcattattttcacacagcagctcggccgaggtttacgtaaggcaagcggtaaagattcggttgtagtgattgattttattggcaattacgccaataattatttgattccgatcgcattgtatggcaatactggcgatcgtgatgtggcccgtaagaatcttcaacgcgagtccatcggcatttcttcgatcagtttcgataaaatcgcccgcgagcgcgtgctcgcgtcactcgataccgctgatttgtcggatatgaagctgctgagcaagcagtatcagcagatgcgctatgagttgggtcgtattccgatgctgatggatttcgcgcatcgcgatgcgtctttagtgttcacgttggcttcgaagaataacgattatctgtcgttcgtggtctctcgtgagaagagtctgtcgcgcggcaagcatgcgtcggcttcgtatgtggagcagcttgaaccggtgtcaaacgcgcagtctggtgtgctgaaaatgttgactgcgactcagttgcgtggtttgcgcccgcatgagtcgctgattcttgcggtgttgtgcgatttggattggcgtcgcatcaatccggattgttccgacgatgatgcgtcactgtttgaacgtttttccacacagcacagcttgagtttgtttgatttgcaaacattattgtctacgctgtttccgtatgtcgataataatattcagcagtgcggttctgctttttccacattgaattattcgtatttcacaagtgcgaatcgcactcgtttcggcaatacttctttggtttgtatgtgcgacaatgaatcgtatgcattgacccaggaatgcgagtcaatgctgcatcacgcaacattccgaacgttctttacagataccatcgaagccagcttgttcaatgcgcttgcactgtcaagggaagctcgcaagcgtcgcatcatgccggatcatgggttcatatatggcgagaaatatagtcttgccgatgtcatgcgattgtgcgcgtggaaggatgagcagattccgcagaatgtgggcggatataagcttgacaccgacacgaattctttgccgatcttcattaaatatgaggcaagccagtatggcgatcgtttcttgaatcctggagaaattgaatggttcagcaaaaacaatcgttctttgcaatctctggaattcaaatggctgcttgatggaaccgagcatacgtcggaatggaagaatcgtcattttgttcccatttttattcgacgtaaggccgaggaaaaggagaaatcctactattatgtcggttcggcagtagctgtagacgatgcgcatgagtcagtgaatatcgcagatgacggaacccaatcaaaggtcgtgatttccacactgaaactcgcgaaaccggttgaccccgaactctaccgtcacctcaccggcaacccagcattctagttccagaaaattgctgacgtggcgaaaagtcattgttgaaccgacggccgccacgcctcagacatggaaaatgtcacctcatccgcaaaaagtgacacagtgcatcgtcgatgatcgctcaagccttttcaaaccaccttttcacacgtgcaatccaccctacaatcatatgcagatgttcgtttgaacagaaaagtaacatgtttttgcagaacaaaaagaacacgctcaatgttactttttacaatgtcattttcaagacctgcaatcattgcaacatcaacgattcccagcatcatcaattgcaaaaacagtattttccgcggtatcacagctaaaaaagcgtgctatcgttagtcacggatacagcaagcatccatcaacaacatgaaccagacttcaagaaatgatgttcgtttgcttatctaaacgaacattaaaacgaacactactgatgttcatgacattatgcgaacacatcgcaggaaaggaattcatcatggcagatgaaaagaccgtcatcaacgtggatctgaacatgttcggccaggacgcggacgccaagaccgccgcagccaacgaggttgccaagagcctcggcatcagcgacgaagccctcgctcaggtggaggaattcaaggcagccctcaccgcgcataacgcttgggacctgccgttcatgggctacgtgaacgaagacggttacggctacgcctatgtgccggacgcagccatcaccatgaacccgtattgggatgcgcacaaggaattcatgaacctgccggaagacgtgcagaccgctttcgccatccgtatgctgttcacccaccgccctgtcgaccgctacggcgccgacatgttcctgcactaccaccgcggcttccaggtcaacttcgtcggcagcggcgccaacaagtactgaccgccccagaggacgttgtatgagcgccccataggacatataacgattcccataccgccgcggcggtactctccagaaaaagaaaggcgcttggctcgagccagaaaaaccagctcaagtcaagcgcctttcgtatgcgctgaaacgaaactaccacgcgtctctacaaatcgcccatatcaggcgcatcgaatcccatgccaggtccttccggccccggaccgcccggacctccgaggaattcgcgcgctgacatgccattttccttacgggatgagtccacggcctcctgcatcacccggcgaacctcaaaaccatgcaccacgttcttcagtaccacaacaccgttgccggaagactggtcgcgcgtatcaagtaccagcgtgctcaaaccgaacaggcgctgcaggaacgtgcgctccacactaatatccacgatgcggaatagtttgatgagattgaatttctcgttaaggatgccggttttgatgctcatttcctgatcagtgagcatgtacacggtgaacgtgaacggcgtacgacaccaattacgcttgcgctgacgccacagaacattaccgcttgcaaccttcatatcattcccttttccttcgatggaaagccgccctgttgcggcaacactgccattctaccgggcgccgccgtacggccatgccgctcattccaaatcatgtttcacacatcgtttcacacagtatttcggcataatcttttcgctcaatcaaaaagaaatgcaacagcattcaagcgactattcaaaatcatcggcttttcgccgtgaaaagagcaaaaaaacatgcgcgacaacggcagcatgatataggctgaataaggatatgtcttgttccacgaagcacccgtcgtcaacgcggcacatgcaatccatgtttttaaaggaaaggcatgcaatgagcaacgaacacggtaggatcaaccgtctgcaggaagtcgaggatctcaccgagtacatcaacaatggatggctgcattccggcgaatccgacggcccgacgttcctatggaacgacatgatccgcgaggccagtcaggaagatgccgaaaaccgcaataatgtgcccgtagcacagctttccgacgcggacatggtaatcagtatgcccatgcaatggtatttcgattccatcgccgccatggtgcccacagccgaacgcaccgataccggcgtggagattccaagaatcgacatgccaacgttccatcttgattcgcaggcgctttccggcgtggacgcggtggtcggcaatgccatcgtaagcacacgttggctggatgctgtcggcaatctcgccaaggcagtggaaatgaccgcgcgattcgttggcaacgtcgcagatcgagacaatgagggcttcgactatttgaaagacctgattcagaccgtgcgcgtgtacatggacgccgtggcctgcaatgccgatcccatgaccggcgaacaggcgctgaatatcatcacgcaagtggcctgcaatgaggatttccgtcttaacgccatgcagatggttgaactgctttcgtgcggcctgtcgttcgcgcaatgggacgatacgcgcatgttcgcttacgatgcgttgaataagggcattgccacgatgagtgatttcgccacgtctgcttcgacgttggcaaactcggcagatgattccgacagccgcgacatgcaaactgattcgcagtctgttgcgcaagtgaaaaccgatttgggtttgtttgaagacgctgattccttatccgcagaagatttgaataatctcgcgatgcttgatcctgctttgctttcagaaaaggagattgcgcaggccgcgcagaatcagttcgatcatgccgtacagtttttgcgacatgacttgctgcggattagtggtgacattgatgaggctgatcgtttcctgcgtgacaatcatacttccgaaccgctcgccgatgcgtatgcggcacgtctgattgctgccgaacgttggcaggatctgctcgattttgtcgatctggtgttgcgggacaaacctaatcaggtcacgatgatgttccccgaagaagtggtgccctacgagtgggagacgattcgcgaggccgctttggaagcgctgggacgcagcgacgaactggttgccatgtatcaggaacgcttggatgatacgtatgatcccaataccgcgctcaatcatctgaaactccacgcctggttgaatcagcagtagtcccgattcctccactcactggaacaatcctcccgcccacgggccttccggcgtccgtttccctccaccgaatggaggaagacacccgtgcgcgggaataaaaaaggaccttccgggaaccccgatggggctcgaccggaaggtccataagttgaatgcggcggcgtgctactctcccacaccctctcgagtgcagtaccatcgccgcgaccaggccttagcttccgggttcggaaagggaccgggcgtctcacctgggccatgaccaccgcaaaaccaatataacggccaaccacaaggatcggccggcagaaccggaaccacgccacgattccgatcgtggcggtccgggaaccggacaacggacgcgagcaaaacgcttcaccggtatcgtttccgtgaccacaagaaacaatgctccttgccatccaacgaaagaaaccaccacaggacgagacccgacccaacaagcgggtcggaaagtgtgccgcgttcgcccgttagtaccggtcggctccacccctcgcggggcttccacctccggcctatcgaacacgtgttcaacatgcgggctacaggcaccgaagtgccaaggaatcctaatcttggagcaggcttcccgcttagatgctttcagcggttatccctcccgaacgtagccaaccggccatgccgctggcgcgacaaccggcataccagaggtccgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgcccgaaccgtcgttctcgcagtcaagcccgcttgtgcgattacactcgaaacccgattgccaaccgggctgagcggacctttgagcgcctccgttactctttgggaggcaaccgccccagttaaactacccgccaggcactgtccctgaacaggatgactgttcgaggttagacgtcaaacgagaacagagcggtatttcaccttgcggctccacacgggctggcgcccatgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcaccccaaaaggggctgacggatcctcttaaccttccggcaccgggcaggcgtcagtgcatatacagcggcttgcgccttcgcatgcacctgtgtttttggtaaacagtcgctaccccctggtctgtgccaccccccaacgctccgagggcaagcctcttcacgcccgggggtctcccttataccgaaggcacgggagtgatttgccgagttccttgaccaggattcgctcgatcgccttggtattctctacctgaccaccagtgtcggtttggggtacgggcggcgacgcccctcgcgccgaggcttttctcgacggcctggaccaccggatatcgcgccataaaagacgcccatcatcacacctcaccctatgcgtcccacggatttgcctatgggacgggctgcgtgcttgaccacggaaaaccacctccgcggccggctcccattccgtgtcacccctgtgcgctagcctaccaggactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccacaaggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctcccgcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaacccaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccaccaggggcatccggaaaaccgcacgcacccaaaacggatgcgggtggcggtccgggaacccaaaagcatatccgcaccactccccgcaaggccccaaggacccgcgaagccaacgatctcttccacaccagcacgcccacgccagaccggagacgatccccggcacgcgggccacacgacggacgccagaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaactttgcagaaagccaacatgtgactctcaaaaacaagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccacaccagcagaccgtcccgaacctcaggagcggaaccgccgtgctgagcagcgagatgtaaacttacacgtccttgccgatctacgcaaatcgaccttccgtaaacaccgtgtaaaccgttgaaaaataacgtatctctcggcgtgtcgaaatcgcaggaaaatcgagtgatgagcaccatttcacagcacaatcccgctggaaaaacctcaacatacctcgcggcaggtcaacatccgggcgtgtcgcacacgagacgaacgaatgacagaaaggtacaagacaaacagcgggcaaaacatccagcgggaacagacacaacacgactacgcctgacacacatccagcaacgtcaattcgtccgaccaacttacgccttgccacacaacctgcgagcgactccgtctaccagcgcttgccacagcgcttgccaccattgccgggcctgccaccggcgccccacggcccgcgcccctcggcatgcagcacacccagatgatgcttcatggcgaccagcatgatgtgcgtatcttccaagccaagatgtcgttcgcttttggatgcatccaacgcgccctgacgtttggcatacgcatccaacgtattgttgccgtgcggatgctcatcatcgggaatcgacccctcatcccaacgacggctcatcggcaatgtgtcgatgatcgtgatattgccggcacgatagctttccgcatatccggcgacgttcagcatgaaaaagctatgctcgaaccgggcgttatgcgcaacatatggctgctgttcgagtcgttgcagcaatccgatctgagcttcgggccattcgtcgaacagacgaaagtccgcgctggcgcgatcgcgcacgtcaataccggtaaggtcgagaatcagaggattgccaagcagcgcattctgcgtgggaacgccgaaggaaagacgtgcctggccatatgcatcgccggtctcgtaataatcctgttcgtagcggtagcccgcgggctcgccggcaggacgaggcgagatcatgttcatgaattcgaatccggcatcgatgatgtacacgcgagccggatccgtacccgtagtttcgatatcaatgcccatcaccgtgtcgacgtcacggccgggaaggtaggcgtcacgccaatccgactttttgtaatccgccaaacgtcggtcctgcgcggcttccgccgagtcagcggaaccgccagcggatccgagggaaccatagtcgaacaccttcgagcctcccggactcgtcaccccgctcaaattcgcgcgtgacatggcgtaatcgctggcacgcttctgttcacgttccgcggcacgacgttcggcacggccattgacgatctgcgcggtacgatcctgaatatcgttaagattcacgaggctttccgctccggcaacagactgcagcacgggcactatcacccgctcccgccgctcttcggcaatcgtccacaatcccatcgcagcaccaatgcgccgcaacacggcaatttcgtcgcacaacctacggttcgcataggcgagcgcgcgaggcaaacggtatgaagcgatcagacggtcgaaatccgtcatgaaggtggtattgcattgcgcgatgatggattcgagccggtcacggaccgctaaatcctttttcagcagattatgcaactgttggacggatagtaccgaatcctgcatgggatccgttttctccgaggtcgacgaaaacgtggtacccgcggcattcagaacggcgatcaggtcgatgccttggcttttggcggctccgatgccgcgttccaagtcgagagacatgacccaatgccagtcgatgcgctcattgtcggcgtttttcggcatcgatgccgaccattggctgatgtcttgtttggcttcggtaagccaggaacggcccgtctttgcttcgttcatactttgcatggtagccgagagggggcgcagtacacgtcggcgcgtacaaaaaaccatgatgcttctcggatagcgcaatcttaagttttttgagattcgaaaggttatcttgggttcgttttatttcgttgattttcggtaagagaaagaacaatgctacgaaaaacgattatgttcaccaagcattcgtcgtcaggatacgatcatgcgcgttgcagacggagcacgacgtcgcgtacgaaatcattccatcgcaacgcgaacgccgatattgtcgataatgccgcgaaatgcaaacatggttacgctcatacgtgcgtctgccgtggggagtgtgatgcgtgcgcgcgttgcactggttatgcgcatggtggtatgacgaaaaaatgacggtatgacaaaaagggagaggcctgtgggcctctccccctgcaggatattccgcggattgcgcaacgataggattccgtgacaatcggattccgcagcgtttttcgccgcgcatgtatgcgatttgcggcgtgcgctcctggtttacagttcgaatccgagttcggcggcggcttcggtgggaaccggatcgtcgcaccagaaatcctcaagattctcgttggtggcgaggctgcggatttccgccttgtcgatatacagttcgccgctcagatggtcggtttcgtgctggaagatgcgggccggccagccgtgcagatgttcctcatgctgtttgccatcttcatcctgccagcgggcgatgatgtcgagccagcgcttgcgtaccgcctgatagccgtcgaagctcaggcagccttcgtagaagctgcgggtttcggtgccgatcggctcatagctggggttgatgatgacgtggaatgggaattcggccgcttcgcgcgggtcatcgtcatcgtcgtcgcgcacatggtcttccaccacggcaagcgccagtccgaggccgatctgggttgcggcgagacctacgcccggcgcttcgatcatggtgacgcgcatggtttcgatgagcttgtcaagtgtcttgcggctcagttggccttcgtaggctgcggtctgctggcgcagtaccggttcacctgcctgcacgatgggaagcagctgttccttgccgccggttttgatgagtttttcgacctcgcggttgagctcgaggctgactttcgagttacgtccaaacatggggttccttcgcggattggttcgggattttggattgccaaatactgtgtatcggcggtgtgattacaaggcgagttcttcggccacgactttggcgagacggtcgcagacctcgtcggcctgctgctgggtttccgcttcagccatgacgcgcacgagcggttcggtgccggagggacgcaagagcacgcggccggtgtcgccgagcattttctcttcgcgttcgacggccgcctgcactttggcgttggttttggctgcgagcttgtcgacgtttggcacattgatgagggtttgcggcagttgcgggaagtcggatgcgagttctttgagactcttgccggagttgaccacttcgttgcacaaggtcagtgcggtgagtgtaccgtcgccggtggtggcgaattcgcggttgatcacgtggccggactgttcgccgccgagcgaatagtcgccgcgcagcatttcctcaagcacgtaacggtcgcccacgccggtttgcacggttttgatgcccatggaacgcagggcgagcttcaggccgaggttgctcatcacggttaccacgagggtgtcgtggttgagtttgcccgcgtttttcttggcacgtgcaagaatgcccatgatctgatcgccgttgaccatattgccttcgccgtctacggcaaggcaacggtcggcgtcaccgtcgaatgccacgcccaagtcggctccggaggctttgaccatggcctgcagctgttcggggtgtgtggatccggcgttcttgttgatgttgtagccgtctggcgaagcgttgatcacgatcacgtcggctcctgcgcggcgcaacgcttccggcgcgaccacggaggtggcgccgttggcgcagtcagccacgactttcaagcctttcaacggtgtcggctgggacttgtcaggcccgatgggggcgattgtggataccagatggtcgatatacaggttggttgcggttgccgtgtcgtggctgatacgtcccacgcctgcaccggtcgggcgttcccaatcctggccgagcacgttttcgatttcgtcttctttggtgtcaggcaatttgaatccgccgcgtgcgaagaatttgatgccgttgtcgggcatggggttatgggatgcggaaatcacggcacccatttccacgttcagcacggaagtcaggtatgcgacgccaggggttggaataatgcccgcgtcgatcacatcgaaaccacctgcggacatgcctgcggacagtgccgctgcaagaaaatcgccggaaacgcgagtatcgcggccgaccagtgcacggcgacgaccgtcgaattcgcttttgtctccatcatcgccaagcacgcgcaccgcagcatcgcccaaatccaacgcaagctgtgcggtcaaagccctattcgccaatcctcgaacaccgtctgttccgaacatacgtggcatgagtctcaagtcctcgctatctcaagttatattgccgtgcaccatcgtactcaacgggttcaccattcaacgaaacagtcgagagcatgttgcgatacctgcatactgcggtacgtaatgttgcgcaaaccgcagtatgcaacggcgcgggcttttccgcaatctcacgttttcgcaatatcgcgttattcgcgcaataccgcattcgacagttgcgccacgaacaggccttggtctcgagtgacgatttgggcgcgaccgggcgccgccttcttcggtttgactttgccgatcagctggccttcgttcgaatctccggacagcagaatgccggtcatgccgagatcatggaacgtctgcaataccggatcgtacatggctcggctcgcaccgccggttctgcgggccaccaccacatgcaatcccagatcggaggcctgcgccaaatatggcaccaacgcacgcagcgggttgcctcggctggtggagaccaaatcgtaatcgtcgaccagcacgtaaacttccgaacccgtccaccaggaacggtcgcgcaactgttcggcagtcacgtcctggcccggaatgcgggttttcaggaattccgcaagcgcgtcgagactttccgtagcctgttcgtcattggtcaggtacgctccaaaatgcgactgcggaatctgcgcaagattcgcacgacgataatccaacatgaaaatttttgcttttccatccggatagcttcgtacgatttcgttgattatcacgcgaaggaatgtagatttccccgaaccggcgtcaccgaataggtaacagtgcggttcggtgttgaagtcgaacaccactggagacagtgcgttctcgtcgataccgaccaccatgttgcctttggcgagctggttggatgccttttgacgcatgacggaagccatcatcgcctcgtacggcaggttttcgggcagcaaccgcagcttcggaccatgcggatggccttgccatgcggaacgtactttggcgatgagatcgttgatgccgtcggacaccgtcgccgcatcatgcccgccatcgatgcggggcagcgctgcgagcgtatgcagtttgttggcgctcaggccacggccaggcgcgcccttgggcacggtgtcggcaacgtggcggtcgatttgcgaatcgctcggatcgcccaaacgcagttcgagcttggtgccgataaggtcgctgatattggcacggatttccatccaacggttcgcgctgaacaacacgtgcacgccgaaggtgagaccacgggcaacgatctgctggactttggtttccaattcgtcatagtcgccgcggaatacgccccaaccgtcgatgacgaggaacacgtcgccatatccgtcgtcgaccttgccttcggcgcgacggcgacgatacgcgtccatgccgtcgatgcgctgttctttgaagaatcgttcgcgcgcgtcgatgatgccgctgacttcggcaagcgtacgacggactttttcatcctcattgcctgccgcaatgccgctgacatgttccaatccatccatggaggagaacgcgccgccaccgcagtcgatcacatagaactgcacttcgagcggcgaatgcgtgagcgccaacgatgcgacgatggaacgcaacatcatgcttttaccgctcaacgggccgcccaccactgccacatggcctcccgcaccggcaagattgagggccatgacgtctcgcctctgctcgcgtggcttgtcttccaacgcgcatggtacgacaagcgctccggcattgcgccaccttggcgaaatcaagccatactccttggtgacggtcaggtccggcatgaaatcgtcgagcgaattcggcgtgaccagcggaggcagccacaccacgtgcgcgggattgcctttgcctcgcatctgttccaccgcatactggaaggtggtggtttcgccgtccaaccccttcggcacgcccgacacgtaagacgcgcggaagcgggtgatggtgccgtcaggcgatttcagatagccgatgccagacaggcttggcagatcgtacgcgtccgtaatgcccagcacggcacgggattcggttgcggagaacgttttcagaccgatacggtatgacaggtgctcgtcaagaccacgcagcttgccttgttccaaacgctgcgatgcgatgagcagatgtatgcccagcgaacggccgaccgcgccaatgcgaacgaacgattgcacgatctcgggtttcgccttcaacagttcggagaattcgtcgaccacgaccaatagtgacggcaacggtttaagatcgctacgcccgccgttgacacgcatctcctcatattcggtgatgttggcaaggttgcccgcatctcgcagcagctcctgacgtcggttgacttcgccatccagcgcgtcttccatacggtcgacgagcgacgcttccttgccgagattcgtaatgatggatgaaatgtgaggcatgccgtccatacctgcgaaagtggcgccgcctttgaagtcgatgagtacgaaattcaactggtccggggaatggctcaacgccaacgacagtaccagggttcgcagcacttcggatttacccgaaccggtggcgccgacgagcacgccatgcgggcccatgccatgctggcccatctctttgatgtcaaggaacgcggtactggtgtcgtcgaataggccgatcggcacgcgcaaacgctccttgcccacacgatatgcccacagtttcgccagatcgatatgacgaatatcgctgatgccaagcagatcaggcaattcgggggatttcttgcgattgacggattgtgaggaatcgtctccggtttcgttaacatgcacgctcttcaagcgtttcgctatgcagagcgcctcttccacagtcaattcgtccggttggatttccacaggcttgagtgccgtggaaaacacttcaaccatattgatgtcgcgcttttcgagaacgttcagtccttcctcaaccacggtctgcgaatacagcacacgaagcacgtcatcttcctcgagctccccccaatcattcggcatgtcgaacacggtcactccaccgaggccgtcttcagcgaacaatcgggactctcgagacaatacagtccggtcgaatccatcattgatcaccaaaacatgaggagcaatctcattatctccggtacgcctgttgcggttcagcacttcctcgcctatcagcgcatcaacttcgcgcacgttgctcgtcagcataaatccatgaccgttatacgtgccttccaagtatttctcgttcagcacacggttatgaggcagcaaccgtacccattcccactgccccatgcgatcagcggatgccagtacgagcactctgcagcattcagccggatgccaaaccgccgcttgacagatcatggctcttgcgagcgcctgcgtctggctttcgtttccaagcaattccacacgcttgtatttcctcaggtcaatgccgtaaggcatattgtgcaacgttttatgtgcaagcatgaaacgatgcgccgccgatgccgaaaccgggtcgagctgcgcgagtggaggcaattcaggtgattcaagctgcaggcacaatggcacactatgcgtgccgcaacgtaatatcatgaaatcgtcgtctgcgggaacacgttcccagcaacgttccggttcctgggcgatcgccgtcaacgaggatggggatggagcgttccacaatgcggcattgcgttgtttccttcccgcggtgcgcacggttttgcgtatgccagccaaataagtgagatattcacgtcttgccgccgcgaggttcgccatgcgttgcgaacgttggcggaagccgttgaccgccacgaatcccaatgacgacaccatgaacatgccgccggtaagcatgccggtgagtcccgaattggtcatcagcatcatgaccatggcgctggcggtgcccaacaatggcaccaacgatgtgagcagcgtgttgacaccgtcgctgggttcaagctcgggtggtgcctgcaatacgatttttccttttggaggtttgggaccttcgagcctgctgttttgttgttccgcagtaatagccatcaacgcctcctgcttttcgatgtgatgatgctgcagcccatgtctcccagtccgatgcgggatccgacatgcatacgcgttcggacgttcggttcaagttccgtctcttcgccgctttcgtcaagcactcgcgtaccgttggtgctcgctaagtcagtgatccagatttggtcatccaccaattcgatccgagcatggtttcgtgagaccgtaccagtatggtcaggcacagccaacgcgatgtcccctgtctgctgcggagctggcttgcgcccgagaatcaatgaagaaggcacgctgagagttcgcttggagccatcttcaaagaagagaaaggtttggggtttctcaggaggcgtcactggcaccgaggccgtctgttgttcaaccgttgtccgaaccggatacatcggctttcccgaaggcatgggtacaggagaaacctgttttgccgttggcatgggaaccggtttggacacgtccgccactgttttgggaagaggcacgggaggagtgggctgcatccgaggcatgggaaccggaggaatttgcctcgatacgaccggttgttcctccaacgcctcaacacgttgatgaatatcgacgcatcccaaagatgccagtctgtctgcccatccctgatgcaaatcatccttggcgaacaacggtgagcaaatcaccgcaatcagacctatgaccaacgcaagcgtggatccgataagcacacaatacttcacaagaatccggcccattccggcgggcaaagttcccgccgtgacgtcacgcatgccttccacgcgaaccgtacgcaaaccgaacatcatattccccggagtcagaccgcgcgaaccttctccaatagccagcaccgcaaccgattcgagcatcaccaggaacgtgacgggaatattatgtccgagcaaagccgcaatcacgccgcaaagcaatacgaaaccgcaatcgacgaatgcggccgcacattgttttccggctcctgccggacgacatctcattacggaattcgaatccgacatcacaatccccttatatactgcaacgcgccagctgcgaagaaagccgccacaggcgtgaccatcatggacaggaagcacaacgcatcgccggcgcgagacaatacaagcgaatgaaaaccgcctttttgcacaggaatggcatataccagcagaacgccaatcaggccaatcgcgcatacgccgagcagcctcatgttttcggttgtcatgaagccccaggccctcacgcaggccatagccatcaccatcaccgcagacaaacgcatgcagtaccgttcgaaaggtctgcccgaccggcgcggcttaagggtgagaaagagaaacagggccgcggtaagcacgagaaagccgacagcatcatacatccgatggaaatcgcagaatgcgaccaatgccgcgtacggcaataccagcagcgccaagcaaagcacgaaaccggtcgcgtatcgggcctgaaacgtctgcatatcttcacgaatatcaacttgggtcaatacacgggcctcttcgggaatgccaccgcgcaccgtccaacgacgtgtcatgtaggcacgccattgcacaagataacggtccggcacatgcaccacgatgttcggcagcatttgcagacagcatatggcagcggcaagcaccaaaccggcaagcagccgtacgtccaacgaacacatcagcgttcccgtactgacgagcagcaacagcaacgatacggcaaagcatgcggatatcacgccattaagcaccggctgatcaatgcaaaccgtcattaacgacatattgaggcatacgcaagaagaagataggaaaaccgccgccgcgatcggctgagcgcaaggttcaacgcagctcgccgccacaccggcacacaccgacagcagcacagcgcaagccatggcaaccagcgcaacggtttgctcgtgtgagcgtatgctcaccacgcataaccgatcacaaaacagcatcagcaatatgaggcttgccacaagcagcacaggcaatcctcgcatccgctcgtcgccaccgggaagcaacacgctttcggacagcaccgtaacggcaataccagcaaaaagcactgcgcagacgagcgatacaatgcatatcgcctgtaagtcagctggcttggtttctttgtgccgcatattggctttcccactcacgcagacgagtcattcctttatcgagcgcaacacgagcctgggccgcttcattatcttcgtcgtccgcatcctccacgctatctcgcacataactcatattctgcgcgaggtaaccacgtacttcacgcgcttccggagacttgtcaatgccagcaaggatgtcttcctcacaggttttccccatgtcgatacgctgctgcaatacttgccaagcgcgcccacattcacctttacgccgcttattttcaagttctttcgttttttcggctattttttcatctatttgaactttctctttttcgaatttcgcccgctgcttgtcaagccgggcagacagtgaatccatttggttcatgaaagcttcgaattccgctgatgtcattccacttctcttttcttcgcacataaaattgtcgtaccgaggtcatcgtccgtttcgcaatgcaagtcataacgatgcggttggaaggacatgacgattatcttccatcggacgatccaccggatgccccggcaaacgctacgtcattcgacgtactgccagttccaccgttcgacgtgcctccgccaaaaacgctcagcatgccctctgtttttacggaaagccgttgcataaccatgaggcatacacacaatccgttaagggcttcatacagattgttaagatattccacgatatcggatgcccattgaatcgcctgggtgacttccgcagcgacagtgaccgtagcgagcaccggaccggctccaggaataatcagctcacccgcaataagcttcaacagcgaaatgatttcactcaacgtgtcgaatatcagattcaatgttttttccgcattgtccgccaaagcgttcaacgcctgggccatttccgaacatggctccggagcttccacaagcgcgtcggccaccgcctcattgcgaacaacatatatgtccgcggcctgcccagaccacactgtctcgtcgagactattggaaatttccaataacgccgtctgcacttcaggcagtgtttcagccagcgactgccattttcccgcagtatcgcgaagctcatcccaatcgccgaagaatggtttcctgacccactcatctataggactgacaccaaacaatgccttgcaaatgaagtcaacacctgagatggcaatgcgaagcgtagtaatcctgctatccagcgttttcgccaaatcatgcgcactttgacgagtcaaatccccttccaaagattctgtgaacctttttgacgcatcctcgaacttctggcttttccttccgatgtctttcttatcaagtcctgttttttccaggattctcccaaccactttgtcggctgacgtgtagccaaatttctgcccggaaaggagggctgaggcagcctttcccactttcctactgtcataggcctcaccgactttttgataaaacttcaagtcgcgtttaatgtcgcttaaatcgtctggaacatcgatggtaatcgggccgaaatgcaagtcgttggcagagccatcatcttcttttgcagccatactcttccccttgtgtatagtttgaatgtgatatttacccggttacggccggatatgctttgcacagcatcctgttttattgaatcgtcgtgcgttcaggtagctgaatggtttctctgtcttcgtacaaggcacgaagctcatccgccgttcttcccagaggatctttagctgcgatgctttgccaggcttcatcctcggcttgcttacgcatggcttcccttgccgcttcggaatctccgacgcggacggcgacatcgtaatcgccgtcattgtcgtagtcgagggcaacgtaccgcgaatcttcatcctcatatacgctgaaacgggcattcgcgcctgaatcggagttcatggacacgtcgtccacgccatcgttgtccacatccagatcaaacgaagcggatcctgttttgcttgcatcagaaggcatcggaatggtggaattgtcacgctttgtcagagtaacggaaccatccgccccaatcacggcatgcgtattgccatcagtgagattcagagagtagtcgtctttggcgtttccatccacatccaatccaatcgtggttggtcttgttggaagtggaacctcattgaaaatcggataagtgttcgattccgccgcatcacgcgcaccatcagatgttgtttttttctgatcatggccgaattcttgcgatcccgacgccattgcaccagaacctgtcgcagatgatgccggacttcctgccgcttcggaaccaccgtcggatcgaccattaaactgatccactggctgatattgcttgctttgcaaggaatcagctcttgagccaccaccattgccaaagctgccgccatagccggaattgccgcctattccgccatttccctcggaccgtgcgttatgaggatccgaggaatccaacttgtcatccacctgctgaagcagttgcagaatcttcttcagcgcttcaagtatctcctcttcagtggtggtggaatcttctacggtcccctgtatggccgaagcaatcaatttcagcattgcttcaacgttggccaagtattcttgcgtagactgcttcgccgcttcatacgccggttccaggcatttgagaatcagcccgaaattcggggttcccgcagacacaaactgcgcttttgccatagcgaactgttgtgcggcctgttcatagtttttcgccgacgtttccagatcggacgggtcaacgcatatgcatgaggaagacactgccttcgctcctttcctgttcaacaagagaacgttttgttcaacgacgtgcggtcatgcgcatagcgcattccgcccatgcctcattcaccgggacgcctgcggtgacctgccatggccgccaacggcttgggctggaattcttcttcctcttcaatggtcggagcaatgtagcccaaggagttgcgcctcttatccttgctctgagacgcaccgccacgccccatacccatcattcccggagtgtttgcacgagatgacgccgcagcttcggcacgcgcaatttctcccttgcgcaatcccgcagccataccggttgcacctttgatcgacgaggatgcaatggacgccttgaccggattgttcgcataatacgaaccgacgccggagccagaaaccgctgccatggaagcttcagacagcgctccggaacttgaaccagctccacctgcgagcttggatacggctaacgctccaccggcaccgatgccagcgccagcgccagccgccaccgcagtacgcccgattccggaacccgatcccgcagagcctccggacatgccgccatgggcggaaccggaaccgttatagctcatatcgctatccacggccatgtggttccgatacacgtagcggcctgttgccggatcgtatacgtataggttacggtcaagccaacgtccgcttgccggatcatacacgtatttgcttgtgtcgatccattcaccggtgttcgggtcaaacatccgaccattatggctattgttattgtcaccgcccgtatcggcagcgtccgtagggttgttacgtggaggaagaggcggcgtagggctcacgttggggcgagaaattgaggccgaacctgatttgggggtattggagaatttcgatgatgcgacagccgcaccgccagcggccgcgaggccagcgctacctgctacggcagctgagattccagcgtcgccaaacgaggcgggatacacatcttcgatttccgaagaattgttttcaccatcctgtgctggccacaggccgttgatgtcgacgactggagcttcattaactctgcgcctagggtagttttccttcctttctaattcaatccgttcaaattctgcttcagcctttttttctcgctcattagcaagcatatttgaaattatgttaacgcccgcttcgccgattatcccggttaatgttcccaatccaggaacgataatattcaatggcgtctcagcagacttaatggcttgttcaatatcgctagtcagtctagtgccgggcagctccacattccttgcatcgtcgatcgcctgattgcatgcgtcaacaatccgaaatagatcagacaaggctgttggtatgttcgcttcctcaatgcctttggaaatttctcgaacgcattccaaagctaccttttgggtttcgcccccaaaaacataaccttcttcaagttcctttttcatggttttgagtttcgcggcggcatcatctatgactcgttcaaaccgtttgaaatcgtcaaattcctcaatagaccacttggcggtattggcgatatctgacagtttttcctcatatgtttccatgaatcttcctctcgtgtcttcttacccgctatcgtttattgcctaggcggcaatggcggttgaggaacgtgctgaccgacctgcccgttcccagcctgcgttggagggtacgtgtacccggccggcgcaccggcgttcggatacgagccagtgacgggagcggaccgcgccgcgggcccaacatacggcggcgccacaccatacgggaccggcggaacaccagacccaccgacaggaccggccggcacaatacggcccgcatccctcgcacgccgcatcctgcggaccagcaccaccgccagaaccacgccagccaacaccaacacgccggcacccgccagcaccacgggaaccacccacgacggcaccacggacgaacccgaagcatccgacgccatatccccggcgaccttcccatcctcctcatcggccgtggccgtcgcggaatacttcatgcaatcgctcccgccgtccgcacggcacgactccaccttctcccacgcggcctgctgacgctgcagctcacgacccaccaaagccgtatcgggcgtgtacatgaccgtgtcgccatcaggcgagaactcccccgtatccgcaaccccatgctcgcccagcggggacggatactcgtacatgcccttggtctcctcatgctccccgctcgtcttcacggcccactccagaagcggattcacatccgggtactgggccggatcgaccgacagcaacttgcctggatccacgatcccgaaaccacgcttgtgttccggatccagtttcggcccgctcgacgcgttccccttcgtgttgcgaatcagggactgcaggatctggttgcccgtcgcatccggccaccgctgcatcacgagcgcgagatacgcgctcagattcgccgccgcggtcgacgtgccgccgccagtcaaatccatctcacgcgaatccgtgcttcggtaggacggcacgcccacgcccggactcagcaccgacacgttcccgtccatcacatccgacgactcctgcagattccccgccgaatccaccgcgttcaccgtcacctcaccggggaaatagttgttcatccccggctcgccgaccaggtcgtacatgccggccctgacagagttgtccctcgccgagaccaccaccacgccgtgacgcagcgcgtacaggatgtcgtcacgcaccccgctaggatcgccgatgtcatccacgtacgacatgttgatgatcctcgcgccggaactcaccgcgtcacggatgctcggcttgtccaagtcaacacccttaccggcatcatccacacatatatccgctccccctcccaatcgtccttcacgttggtaaaagaccatgtaggcggtcacggaagcgccgggcgcgatgccttggatgcccgcgccgccgtcccatccattgccattgcccacgatcaacgacaccacactcgtaccatgggttatcacgaacccgctggacgaatcaagagtgggatcgtccgcggacgtggtctgcgacggatcggacttcctatgacacggctggttgctctcggtcatgagcttgtacgacacgtccgcgcccgccagcgcgggatagtcggacacaatcggatcgtcaagcaccgcgaccttcacgcccttgcccgtgatcccctgggcccacgcgtcacgcacgcccatatcgtcgatacgccaatccacaccatccgaagccaccgccgacggcacacacaaccccacacaagccaacaccgccaccaacgccgacaccacgccgcgcacctttcgcacatgcgatgcacacaaatctcgcgtcatcaataaccccttctcgtatggaaataacaaacgcaacacgtcacttaatcagcaaattcaaagagtcttcggcggtagcggaggaatcgaaagcacattcaccacactatccactaatgacagcagcggctcaaacgcctcatcgctctcgttcttcttagaagtctcgtgtatgtcggatgctttaccctttgtttttccaacaacaggtgcagcctcctgaactgttacctcagccttattgatagaagccacctgctgttcttcggcctgttcaaatattttcgcagcgctgcaaacgcgctgcgaaaaaccgctcatggcttcgcctatatttgccccggttccctgcagcagccgggtatacgcggaagcgctcctcatgaattccttgccaaaagcagtatcgcggctatacgcttcctggccgcaacgccctgcagattcagaaaccgactcgccatatgaatccatgtcattcgctatcgcacgcgcattgtcaacatccgctttgatttcaactaccatgcccgatccgctcctcgtcaacacccatattcccaaccggaaagattccgtgtgcgccccacacctttcgtggaacacacacggaatcacacgacatcagaaacgacccgccgaacgcgcgtcagactccacgtactgctgtgcgatctgtgaggtggcttgggaaatctggccaagaatctgattcatttcctgcaacttgccatcccaattgcgttgcgcctgatgatatgcctcacgagcggaaccgtcccactgaccaatcaaagcgctcacctggctattgaggttttcaagctcctgagcaatgctcttggcatcggcagcgatatcgctcgccaaaacatccacctgctccggacgaaccgaaaaagaacttaccataatatgttttctccttgagctttctagttcaattcgatgatgtcagccaagcaacgcctgcaacttggacgtacgggactggttgtcttcctcattcgcagcctgatccttggctgtaccccgtaggttatccgaaagatcaatgagaatattgttcaaggacgtggccttctcctgccaactggacatcagcgcgttgaacgacacggccgcgtcaccactccagaaagagcccagctccgccatcttcgcttcgatatctttgattcggttctcgatacccgagcgcgcattgtcgaccgcagtggcacccttctcaattgccccttcttcggctctgatctgttccgccatcttgtttccttccttggaggcattctttcttagggaagccacaatgagacacgactcccccaaggaataacaataacagcaataacaaattcagtaaaatttaaattcattaagtatccaaaacccgagatgaactcacgtcaatcgtttgacgttaacttaaaagtcacttagtcatagcaattttactgaaaattaagcaattttttcagaaacaaatgacaatcactgcaaaaatgcaatcatttttctcaatgccttatagttgtattgtttatagacacgatacagcgccttacggcattctctaaggaagagcatgaacatctccctgccaccgctcccgcacggaagacaaaataccccatcttcaccccccatcaatacgacagatacactccaaatcaccgtctcctataaaacgcgcacaatcgcgctgcgggtgaacgacggccccatcatcgccgatcttctaccagacatagcccgacgactcggcatactcgatccgtcgatcgtgtacggagggtacaggctgctcaccagcgacggcgatccactctcccccgcaaagactcttcgcgaacaacacgttccaaaccactccacgctcacgcttgagcccggagcatcatcagacaccgacatcatttacgatgacgtcgtagaggcagtaggcgccagcgtacagcacgtataccgcccttggaccagcgaccacaccacattcacgtcacttgtcatcggcctcggcatgcttgttatcagcgccggatggatcgcgctttcccccgcatccatatgggcatcggttctcgcatttggattcagcgcaatacttctagcgctcacagccgcattatgcggcaaaaacctgctcgtgcaatcaaccgcaatcggactcatcgccagcatttttactgcgattggcggatatcaacttgtcaacctgctcgcaggcaaacagccactgcatgccctgccacttcttggagcgagcctgggactcgccgccgcaggcatactcatgagtctcgccgcatccaaaacacgcccatacagttatattcccattttgataggtgccatctgcgccataccaagcgtcctcagcacactcatgccgcagcagatggggcatatctggatcctcacatcagccgtaaccgcactcaccgcgagcgccctgccttggatgtgtctgtcttttgcgagaatcagcgtagacagtccgcatagcgaatcggaaatcttcgcgcttcctaacgacattgactaccaagacatcaaacgtagatatatagcaggctcgaccatgctcttcatcggacgaatctgcgtcgccgcgctgctgctcatagcggcaccgctcctcaacacgttggacacgccactcgggtcagcattatgcctcgccgcattcctcggcatgctgctcgattccaggcagatctatacgttccgcgaaatgtgcgtaactgtaggcgccgcaggcataggaatcatcgtgaccggatcgctcagcgtgcaaacgcatcaggaattcagcattccgctgattctactcatgctcgcatgcgccttcgcgaccatactgttcacctatgtcttacgcaagcatacgctattcgccacacgcgtggcggacgccgcagaaaccatatgcatcatgcttattttgccgctcgcatacctggcaatcacgctgtaaggacgctcatggccaacaagaaagaccttgccgaagctcaaagctactcgcgccgcagacttgtcaccgctttcagcagcggcattccagacggcgtggaactcactccgaagaaaaaccagtctcccgtaatagcgggtgtagggcttaccgtcatagcaatacttgtcagccttttctacggcatggtaagtccatcattgccagacggttgggagaacaacaagctcatcgtcgcaaaaaactcagcggcacgatatgtcagttcaaatggaacgttgcaccccgtcatcaatgccatcagcgcacgactgctcattccgtcatccgacttcaaagtgctcacggtagccgacgaccagctcaaaaacattcctatcggttccaccataggcatcctcggcgcgccagattcgctaccggaagaaaacaatctcatcgcaggatccatcaatagctgcgtctccgacagcaacatcacaaccacactcagcaacgcttcgtctcaagtcacagacacggcaacggcaattgtcgccaatgtggacggcatcagctacctcgtcaacggaagtcaccgataccagcttcctcaggaagcgaccttacgagacgcgttcctcagagcattcggcattcccgaaaccgcttccaccgacgcaaccgcacaatggatcaacctgttcgagcaaggaagcccgatcgaacaaatctcggtggacggagcaggcaacagcattaccgtccacggcgttgaagcgctggtcggcagcgtagtcatgcagcaaggcgatgccaagaaaaccaaatatgtggttcgttccgatggatcgctttccccactcaccgattttacctacggcctgtacatcacgggaaaaacggatgaattcacacagccgaacgttctcagcgcggccgacttccaattcttctcaaactccaccgaatccgcaattccggaagattggccctccgaagagctatcggcaacatccggaaacgtctccgcgtgcgcaatctacaatttggaaacggcaggaaggaaaaaagccgacacccatgtaaatttagcagtcaaacaaaacaactcagcacatagcggcacatccaaaacaaacccgtcaagcaataccagttcaacagtgaagctcaaaggcggcaccggagcattactgcaggcctccatcggcacatccgacaaaggctacattttcgccgtggattccacaggaaccgcgtatcccattgcgaatgccaacaaagaaaccctcaaacggcttggatacgccaaaaacgacgtgcaagccattccccgcgcatggatagacctatttagccaaggcgtcgaactatcagcccaagcagcaggatccgctccaggaagcaaccaatccagcgcatcgcaaacaaacgatggcggcaatgcgtcgtcatcaaccgccgatacgaccactgacgcagccactaacgcaacggatgatcctgaaacaggcgccgcatcggcagacgcgcaagcacaatgccaagccggcgtcgaaaactacatcaatgacactccttggaccaacacgctcttcgacttcgaaacactgcaccgtcaatccacgggcaaaggcgtaaccgtggcggtagtcgactccggggtagatgtggataatccacatttggcaaacgccgtaacacctggggtaagtcatatttcaggagacgccaccaacggcatgaccgacatatactcccacggaaccatcatcgcaggaatcatcgcggcgcgtgcagtagacgggtcgtccgtagaaggattcgccccagacgcgaccatactgccgatccgcatattcgaatcactccacgaagaaaacggaaagcaaaccggcggaccaagcatggaagacgtcagcaaagcggtaatcgaagccgtggaccaccatgcgcaaatcatcaatatttcattaagcgacatcaccgatcttcctcaaatgaggcgagccgtggattacgcagaatcacatggcagtctcatcatctccagcgcaggaaaccggctcacgtcagccagcaccaaggacggacgacgattccccgcagcctacagccaagtcgtaggagtcaccgccgtggatacggatttgaatatcaccgacgattccgtccacggcacccaagtggacatcgcggcccccggcgcatacgttgcctcaaccgtccccggcggcgtggactgcctttacgccaccgacgcagcctcaacaagcttcgcgaccgcatatgtaagcggcgcggcagccctcatcgcctcacaatatccgaatgaaacacccgcacaatggcggcaacgactgctcgtttcagcgaatcgaccaaattccgaccagcgagacaacaacattggatggggactggtggacccacaaaccgcgctgaacatagcgctttccgacagtcttcgaggcccgacttcaacaggtggcatgcacgcccagaataatgccgaaacgtccatgaaaccgcttgtattgcacaaaatccaagatcctgatacgaatttcaaacgattcgtggaagctgccagtatcgccgtgttttgcgcgtatatggtggcatggcttgtacggaccgcgcgaaagaccgcgcgaaagaacacttcgcaaagtatatcaacaaatgagcatagttttaactagaataattagatattttcagatagtcatttgaaattaatgccgatctgaacacttattcatagagaaacgaacggcatccgccttatgcagtccctcgcgaagtaatcactcgcccataggaaaggaagatcatattagcgtcccatggcgctgacgcccattcagctcgttttgccaccgtacgacagtccgccggaatacacccacatgccgtagtgtgcggcacgcggatcgttctccaacggaaaccgcgggtcgcactggtccggccagacgatgtcgcccatgcagggtgccgggatttcccgctgcagctgctcgtagtagacgcggtaggcgcggaacagctccagctccgtgtacggctccaaggcgcagtgcatggcgacatgcggttcgcggcccgcttgcagcattcggttgatccacgcgtacaggtaccccttgtagacgaagaatcccggcttgtgggggaacgtgttcatcaggtcgagcatacgtttcgaacatgaaccgttacgcaggtcggcgtatggcgtccatgccagctcgccgacgctgcatgcggcgtattggaacaggttcaggtcaacggtcaacgggaacggggcccttacggcgacccctcttagaccgaatcgtgaaatcatcggatccaccgatcggaaacgataccgtcccccatcggcgaactcgtcatagtacagaggctcgctgtccagaacgacgccatcccagccgtcgcgatgatgggcggaacgacagtagcagtgtttttcgtacagtccaccggtccagccgcgtatcggctcgttccagccgcccatgcacatgtagaccagccatctaggcaggggataataggagcccgtcgagccgacatcctccacccagccacgctcctcaagcgaatacgggtcgtccacctgacgccagccgaaaaaaccgtctcgttccgataccagagacatatttggctcccatctgcaaattagtgagaatggattcggcctgaccgttatggaaaccagcttttgtttgggatggcttgtttggaggcgaaccagcccggactggcagcgggataagccgcgccgccggtccggtcttgtaaggcaatatcacaagagtgatatcagatgcagttatcagaagtagctactaagaatagctaccggaagtggcatttagaaacggcatcagagggacgcgttgaaatcgcgcaccttgagcgtgcggtgcgacgattcgacattgccgcgcacaatacgctgcaacgcgttgtcggcgtccgcatgcgaagccagccaagcatcaccgagatccaccagcgtggccggatcggcatagctcggatacaggccttccagcagggcctcagccatgtggaaggtcttgttctgccaaatccagtcggcaacctcgaaatacttggccgcatacggttcagccaagtcgacgcgcggagtggaggcgaagcctcgagccacggattcaagctgcatgttggtcagctcatcgttgtgcaaagcctcgttccaagcccattccttggcctccgcagtgcctgcgaccgcgcgagcgcccaatgcgaactcacggttctcagtggtttcacgtttggcaagctccgcgtcgatatcgctctggccgatggcgttgattgcgctcagcgcgttgatgatggtccagcggaagttgttgtcgatttccaagccatcaagcttcacggaaccatcgagcagacccttcgcattcgcttcgaatgcggcgtcgcccggctcgccataacccaagtaggcggtgatcagctggaactgctcgtcggaaccggcttcggcagcctgagccagcttgaacagttcggcagccacatgctccaccacttcggcacggtcggccggagcggtgtaatgccatgcggtggtgctgacctgcgccagagcgtaacggaacgtggtggactcatgttccgtggcaagcgcagccaaagaggtttcgatgaactgctttgccggcaattcgccgtcacgggtcatatcccagaatgcaagccaaatcacggaacgagccaacgcatcgtcgaaacgatacaggttctccgcagcgaacttgaggctcttctcgtcgaagcgcagcttcgtgtatgtcaaatcgtcgtcattcaccaaaatcagcgccggacgtgccttgccggcagccgcttcgacaatcgtcagttcgccgtcaacatcaagttcgaactggtcggtacgcacgatcttgccggtttccggatcctcattgtagaagccgacagccagacgatgtgcgcgcagcaccggatgctcagtcgaagcggactggcgcaacgcaagctggcgaatcgtgccatcctcgttttcctcaacttcggtggcgatggtgttgatgccggactgttcaagccactgggcgctccacgccttgagatcgcggccggacgtcaactcgagttcagccagcagatcggcgagcgtagcgttggagtacgcatgcttgttcagataattgttgatgcccttgaagaacttctcacgacccacatagaacacgagctgcttcaacacggaagcgcccttggcataggtgatgccgtcgaagttgacgtacgtgtcgttcagatcgttgatcggcgcgacgatcgggtgggtggtgctcagctggtcctggcgcagtgcccagctcttctcgccggagctgaatgtggcccaagcgtccttccattccgtggcttcggcagtggcgagagtggacgtgaactcggcgaaggattcgttgagccacaggtcgttccaccacttcatggtcacgtagtcgccgaaccacatgtgtgcaagctcgtgcagcacggtgaccacgcggcgctcggcatacgcgtcggtgaccttcgattcgaacacgtactggtcgcggatggtgaccatgccgatgttctccatagcgccggcgttgtattccggcacgtaaatctggtcgtacttggcgtacggatacggcacgccccaagtcttcgcatagaaggcgaaacccttcttggtgatgtcgaacaggtagtcgacatccttggcgaacgcttcggcgagcgcctgacggcagtacatggacatcggcacggtgcgtccgtcttcgttggcgtattcggtgtgccattcggcgtacggtcctgcgcagatggcggtgaggtaggagctcatggtcggcgtggattcgaacacccacagcttggtggtttcggcttcgtgcgtgccgagcgtgccctcttcggtaacggtttcattgtcggtcacggatgcggcaggcatgttggaggtgacgatccacgacttggctgcaagcacggagaaatcgaacacggccttgatgtcgggctggtcgaacacggcatacacgcggcgggcatccggcacttcgaactgagagtacaggtagatgttgccgtcggaagggtcgacgctacggtgcaggccttcaccggtgttggaatactggcacagtgccttgacggtcacttcgttgtgcgcttcgaggttcttcagttcgatacggctgtcggcgaacgcttcggccggatcgagagtttcgccgttgagtacgatttcgctcacttcggtggcgatcaggtcaaggaagctggtagctcccggctcggcgtcgaacgtgatggtggtttcggaaccgaaattcttggctccacgggtcagatcaagtttgaccgtgtaatgaaccggtgctgcgataacgcttttgcgttcttccgcttcgattcgggtgagatttgctcctggcatgtcactccttatttgtgttgagattcctatttattgaataggagacggcgcaaccggttgtgccggttacgccgtccttcttttgattatgtaatcaacaattattgacgatctgtcgatatttcaatattattccaatattgatttcgctggaatcggcgatattgcgaaaaatattgactatctgtcgattcatcattgcgctgcgttcaatcccatcgcttcgtcaacatcctgtgcgatatcggcaacgaccggaacgatcatcggcttgcgatgcagctgacgtgcgacccagctacccaacgtacgacgcatgatctgctgcaacttgtatgtatcgtgcgtgccagccatcatcgcatcctgcaattgctcgacgatctgatgacgaaccttgtcgaattcgctttcgtcttcggccaccgcgttgagatagatcttcggacctgcgacaacgtcagccgtttccgtatcgacgacgacgaagctcgacacgaaaccttccgtgccaagaatacgacgcttctcaagctcgtcctcggtaagttcgccaacggaatcgccatcgacgtacacgtagccgcatggcacggaaccgacaacagcagcttggccgtggtacaaatcgaccacatcgccgtcttcggcaagcaccacattctgcggatcgacgcccgtcttgaccgcgatcatgccgttggccaccaagtgacggttctcgccgtggatcggcatggcgcacttcggcttgacgatgttgtacatgtacagcagttcgccctcattgcagtggccggacacatgcacggcggcattgtctcgattgaccacacgagcgccaagctgcaccagcttgttgatgatcttgtacacgccatgctcgttgcccggaatcagggagctcgcaagaatgaccgtgtcgaattcgttgatggtgatgtcgcgatgattgccgtcggcgatacggccaagcgcggccatcggctcgccttgggaaccggtgcacatgtagacgagcttgtcgtcctgcacgtcatgggccttcttcaggtcgatgaccgtgtcttccggaagtctcaagtagcccaaatccgcagcgatggacatgttgcgaaccatggaacggcccacgaacaccaccttgcgaccgtacttgtgggcggcgtcgacaacctgctgcacacggtgcacatggctggagaagctggccacgatgatcttgcgtgtggcctgggcgaacgcctgatcaagagctgggccaatggtggtttccggcttgacgaagcctggaacctcagcgttggtggaatccatcatcagcagatccacgcccttttcgccgagcttgccgaactccaccaaatcagtgatgcgatggtcgagcggcagctggtcaagcttgatatcgccggtatcgatgaggcttccggccggagtctgcacgaacacagccagagcgtccggaatggaatgcgtgacgttcacgaactcaagattgaacggaccgaccttcagcttgtcacgacccttgacctcaaccagtcgcggattgatgcgatgctccttgcacttggcttcaacgaaagccaacgtgagcttggaaccaatcagcggaatgtcggggcggagcttcagcagatacggcacgccgccgatatgatcctcgtggccgtgggtaagcaccagagcctcgaccttgtcgagacgatccttgatgtagtggaagtcaggcagaatcagatcgacacccggctgctcctcttcggggaaaagcacaccgcagtcgatgagcagcaggtgaccgttgtattcgatcacgttcatgttacggccgatttcgcccaggccaccaagcggcacgatgcgcatggagcccttacggtacttcggcggagcgatcaacacgtcatcctgctggggcgcggtggtctgcggagcaagacgggaattgcgacggcttccagcagaagagcttgccgcgctggagttcttgggacctctggagttcttcgtgttctttgcggccttcacgtttttcgtgctcttcgagcccttggaggagccgctgccgttgccgcgagaaccgccacgaacggaaccggacgcatcgcccgcacgattgccacggccaccgccacggccagaagacttcgccttcttggaagtcgtttcagccttgctgaccttctcagagctcacagacttcacggattgcacatccgcggtctgcgtgttttcagtgcgcttggcagctttgctgccgcgcttgtgcgtagttactgttttggtttcttctatagccatttcctagttggatttctattactaattgtctccgcctgtgcggaaacgaggaattcagttagtttgccgtattacggcaaacccagcaaacttgtgatcgcaacaatgcccggaatcagcgcaatcgccgacaatcaagcgcttcgcaatcacaagtttcgcaatcacaagttcttcaattacagcaagccggaagcgcgcatgccatcttccgcgcgcttgatctcagcctcgcccggaccgacgttcggcagacgcatcgtcgtggagtcgagaatgccacgcaccttcagcgaagccttggccataacagcctggaaaccgttgccgttcattgcttcgaccagtggagcaagctgcacggcaatgcgctgagccccatgaatgtcaccgcggtcgaatgcggcagccaaatcgcgcatcggaccggaagcagcatgtgcgatcacggaaataatgccgactgcaccaaccgaaaggaacggcaggaacagaccgtcatcgcccgaataccaagtcaaaccggtttccatacgcttacgcacggcacccgcgatatctccggtggcgtccttcaccgccttgacgtgaccaagctcagccaaacgacggtaggtttccaactgaatgtgcagaccggtgcggccaggcacatcgtaaacgataatcggcttgtccgcggaatcattgaccgccttgtagtgacggaacacgccttcctgcgacgggcgcgaatagtacggagcgaccacaagcaccgcatcggcgcccgcctcctgagtctgctccaccatgcgcacggtgtgggcggtatcgttggaacccgcaccggagataacgggcacgctcaccacatccttgacggcctgaaccagctcgaccttctcctccatgtgggtggtgggagactcgcccgtggtgccattgaccacaaggccatcggcgccatcggcgacaagctgcttcgcaagcttctgcgcggcctcgaaatcaacggaaccgtcggccttcatgggggtgaccatggccggaagaatacgtccgaaaggagcaggatcaagaagatgcatagtaccgtcagtcatagtgccaacggtacttcccgccacggacgccgaagcgcccgagttcgcgaccatatcgcaatatgaactgccttccagagaccaaaatcccccacccgctggaacaatcctcccgttgccgagcctcccagagtcccgaaacctccagtcactggaacaatcggtacgctaaacaacccctcacattcccaaaacctccacccgctggaacaatcctcccgtcaaccagcctcccagagacccaaaacctccagtcactggaacaatcctcccgctgccaagcctcccacagtccaaaatcccccagcaagtggaagaatcggtacgcttagccgcatactcagggggattcaagccaaatgacttcacgattttgatctggtgaccgcacgatttcggaatatcgcacgattttgctttcctgaccgcacaacactccaaaacagtgcgatcaccaagagggaaaagtgcgcccaccaaaacaaactcaggcaaggtattgggtggggttctgctcgaacttggcggcgcagcccgggttgcagaagtagtaggtggtgccgttgtattcgcgggttgctgcggcagtggccggatccacgctcatgccgcagaccggatctttggcgggcgcgctctgattgccgttggcagtgcggccgccacagcaggagtgcgcgccgcccatgccttccataccctcgtgcataccttccttcttggccttgtgatcactgaacagtcccatgatgaatcctttctgactatggttgttgtgattattatcgttcgggttcggctgacgaacctgatacgtcttacgaagcgccttgcctggatcgaacaggcgcagtcggctcgcgttcgtcaccacgcatagcgacgagaatgccatggccgcgcccgcgatcatcggattaagcatcatgccggtgaacgggtacagtacgcccgccgcaatggaaatgccgacgctgttatagccgagcgcaaatccaagattttgcgcgatattgcgcatggtggcgcgggtcaagtcgagcgcatgcaccaaacccatcagcgagccattcatcaatgtcacgtctgcggattggatcgccacatcagtgccggtaccgatggcgaatcccacattcgcgcgggcaagcgccggagcatcgttgataccatcgccgaccattgccaccgtatagccttgcgcctgcagtttcgcgatttcatccgccttgttttccgggcgcactcccgcgatcacattgccaacgccaacttgatcggccacggcacgcgccgtcgttccattatctccagtgagcatcaccacgttgacgccacgcgatttgagggacgcgatagcctgctgcgaatcggctttcaccgtatccgcaacggccacgattcccgcaagctcaccgtcgattgctgcgagcatcggcgttttcccttccgccgacagccgttccatagttgcgataatgtcgtcaagatcctcatcgccgacgctcggcatgcccacgtcaagatcgtcgatcagatcggtattgccgaccgcaacgttgtacattgcggtttcgggagaagatatggatgattcgaaggtcacggaagatgcagaggattcgtcagctgcaacagtcggattatttgcagatattaacggcaacgcgacttgcgcagtgacgccccgaccggaaatcgcacggaattgcgtggcctcgcctaacgtaagatgctcctcttgcgcgcccgcaacgatcgcggcggcaagaggatgttcggaatcccgttcggcactggcggtaattgccagcagatcatccggcattttgcgccattttccaagcggaaacacgtcggtcaacgatggctttccagcggtgatcgtgcctgttttgtcaagcacgacggcattgattttgccgcaggtttccaatgcttcggcggaacggatcagcacgcccatctgcgcggcacgaccagtcgaaaccgttacggaaagcggcgtggcaagacccaacgcgcacgggcatgcgatcagcagcaccgaaaccgcagccaccaacgcatgcaccacgcgtggttccggcccaaacgcaaaccacaacgcgcacgaccacacggcaatcagcaccacaatcggcacgaaaatgcctgaaatcttatccgccatgcgctgcaccggcgcttttgaactttgcgcggattgcaccaatccgataatctgcgcgagcaccgtgtctttgccgactttcgtggcacgataccgcagcgatccagtgccattgatggtggcgccggtcacggaaccgccggcctgcttcaccacaagcatggattcgccggtaatcatggattcgtcaacagccgacgaaccagcaataaccacaccgtcaacaggaagttgttcgccggggcgaatcgcaataatatctccgaccgccacctgctcgaccggaatttcctcttcaatttcacctcgtaccacgcgagcgtttttcggctgcaatcccgccaacgcgcgcatggcctctccagtaccgacacgagcgcgcgcttcaagcaattggccgaccagcatcagcgtaataaccacaccaaccgcttcaaaatacggttcgcgagcattctcaggcagaatctgcggaataaacgtgaccacgcacgagtgggcaaacgcacatacggtacccagactgaccagcgcattcatttccggcgaacggtgaataatcgccgcgaaaccactgcggaaaatcggtaatgcggcatagcacatcaccggcagcatcagcacaaattgcacccaattcggcatcggatacagcatcaacatcgtcgaaccgaatactggaatcgtaacgatggctgacacaataagacgcgcaatcagcgttcgcatctcacgagattcggaagaatcgtttgacgaatcagaagaatctgaagaaatattggaagattcagcggattcatacgatttttcatcaacaacagtttgttgcgattgcatatgaacgtgagattcagcaatattcgagttttcttccgattccgaatgttcttcctgcattgcggcatgatgttttcctggcaccacccgtaatgtgccatgcagcatgttcatgccgcatgcgaaaccgtactcccccggttcgttaggatgaagagtcaatgtcgtcgtacgaaaagcaggcaatgccaggtcgatgccaaaatcggagaacaccacatgcgacgagcattcgccatcttcttttcgatcgaagatcaatcgcaatggcaaaccggcctcagcttcgatgattgccggactatacccgcctttgacttcgacgaccgcctcttgcacgccgttgtcgacgcgggcgcggaacgctttgcgcggcgcgaaaaagaaccacaaaactgctaccgtcacagccaatgcgacgatgatggcgatcagagcctgcatgttttcaccggtttccatgttgcattcgttttcgattcggacagtcacactatataccccggtagggtatattagcaagaaataggagtacatttatgcggtaggtatatacgcaaccagcgaaagtcggcggaccgaaacgccgaattgacgcgaaccacgcacacgcagagaggcgaggaacatggcggagcaaatgcaaaacgatcaacattacgtaaccacgcagcatgggtatgccgacgatcaaaagaaaatcatcacacggctcaaccgcatcgaaggacaagtgcgaggaattcgccaaatgacggaaaaaggcgaatattgcatcgatattctgacacagatttcagcggtgaacagcgctctcaaatcggtggcgttgctgctggtcgacgaccatctcagtcactgcgtcaagcaggccgcagcacagggaggcccggtttccgacgaaaaaatcgccgaagcgagcgcagccatcgcacgacttgtcaaatcatgagaaagcgaatcataggaaaagaaatgccggttccgacgattcaatacaattgatgcacgttttgaaaatataaaaacgagcgcccaccatgcggtggaacgcccgaatagggaacaacaggccgagtctacccgaccttgccaacctgtttgccgaatcgcggattcaccgatttacaggtcgaggaagttgtcgaggccgacggtcacgcctgggtatgcgccggtggagaccttgcgtacggccagcagcacgcccggcatgaaggagatgcggtcgaagctgtcggcacgaatggtcagctgctcgccgtcattaccgaacagggcctcctcatgggcgttaagaccgcgcagacgtacggcgtgcacgtgaatgccgtcaaccacctggccacgggagccgccatcggtttcggtggcatccggcacagggccaagacctgcggccttgcgggctgcggcgatgccctgcgcggtgtggaatgcggtgccggacggagcatccaccttgttcgggtgatgcagctcgatcacttcagcggattcgaagtacggagccgcaaccttggcgaaatagtcggcgagcacggcggaaatggcgaaattcggcgcaatgaacacactctggccctcgcgaggcgcggcagcgagcgcggcacgcacctgatcgagcttctcgtcggtccagccggtggtacccaccaccacgtcgacaccttgcgccacgagtgcgagcacattgtcaagagacacgctcggcacggtgaactccaccaccacgtcagtgttgccgggggtgatttgggtgaggtcgtcgccggcgtcaagcgcgagcgccaattcggtgtcggccgcgttgttcacggcatcgaccacatgggaacccatacgtcctttggcgccaactacagaaaccttgatcattgcagctccttcaagcatgtcgcacgtacgagcgtacgaacagcatttcaaatcagtctcactcattctactgaggaatgttccatttacgaatgtaaagagacgcttcgacgcgtcaccgcccagccgatcaaggcgaacggaatcgaagcgagcacgaaaatccatggcagcatcaggcttatgtctgggctgaaatggtcgagcatgattcccgtggtcatcgaaccgaatgacgcgccgatggttcccgcggtgctcacccacgcgaggccttcggtcagcgattcttccggcacggtctccttcataacgagattgcccgaagcgaacaccgacgaaacggtaagacccgtaaggatttcaaacactcccatcataatcagattgccttggcacatgtgaatgatgaagaagcctaccgttatgatcgcgaggaacgtgatcatatggcgccagcgggagcccttcagctcgcgcgtgccgaaaaccagcgcgcctatgcacgagccgaccgccaacatcgcaagctgcacaccaagcagggaatcaagatgcaacgctttcataacggccgtcatcgacgtatcgaatgcggtgaaactcatgttgaacacgatgaataccatcaaaagcggaatcacgcccgcataggtgagcacattgcgtttcttgcgattgtcattcgacttcaactgcgcgacggtcagtttgtcttgttgtttgtcttgttgcacggaatttgcgccgccattatttccagtattgccgtcaaccgccaatcgcacgtccgcatcgtcggaagatgccgaaacaacagtgatttcacgtactaccggcggttgcgtgtcacgcaatgcgaagaacaccgtgccgccgatcgcgcacgcaatcgtcggcacaaacaactgcgaaacgggatgcacggaagccgccaggaacgcggccagaatcggtccgaaaatgaatacgatctcatcgatggcggattccaatgcatacgcagtgttcagcaatgagccgttgccggtacggtcaagcacatacgtccaacgggtacgcacaagcgcgccgaacgagaattgcgtgagccccatcaccacagccaaggcgaacagcagtggaatcggcacgcgcaccaatgccgcgaacgcaaagccaagcatggcgatgatttgcacgacaagcactaccgatccgaccttgcgctggccgaatcggtcgaacagtcgtgcgtacagtggcgtgaccgccgccgtggaaagcacatatgccgcgctcatcacgcctgcgatcgtccaattgtcatacaaatggttgagtgcgaggataatgccaaggctcatcatcgacatcggcagtcgcgccaaggctccggaagcacagaacgctttggttcccggaatggagaacagtacggaatatggcgacttcgggatttcggttgcgctggtggcagccatgattatcgctccttaactttcgttgcgtccggcacgtgtgcccgcccacacatgctgcacgagggtagcggcgctcctccacaacgctgcccatagtgcgttaccctacgggcaggctggaaagcgccgcacgttcggcgcaccagcactagtcgttgtcggattgttccggaattccgtagctcaactcggcaaggatctcttcttctgttttgtcggcggcattgagctgtcgatcgccctcaatgggttcactcagatagtagaggcaggcgtcgatagcggtgagcggtacgccctccattgccgacagcaagatacgatacatatccaactgtgctaattttttctgaatttcctcttttttgcgaggtttttttccagttttccaatcgacaatagtatattgtttcgaccgatccgccccatcgagacccccgaagaacaccgcgtcgagcttgccgttgacgatggtgcccaattgcggcacgttgacgacgatttgccgttccgcccacgcgggcttgcgccgtgcccatgtcgacgttgcgagacgctgttgccaatcgaatatcccgttattgtctgccccattatcgtcttgattgtcttgcgattgcgccgcattgttgcgtcgcagctcggcaagcatcgccaatcgcgattcagctacgcgagtaccgccattgccgctcgcgccaacgccaatgccggcatcattcgcatcggccatgatgaaccgttccgcccaagcatggaactgcgtgcccagttgcgcggccggagacgctacgttcggtatcggacgcaccagcccacgccagtaagtgcgggcgccacgctcgtccatcatgcctgcgcgcgcctgcagcgaggtgacgttctgacgaccggacgcaagaatcctctcgcccttcgcacgcaccgcgctgtcgaacgcatcctgcgacgcctctccaagcatgtcaggcatgagattgctgtcggccaccagcaattgcgcgcatcgcagcagcgaagcacccgtattttcgcaacgcccagcaccttcgccaccgacaggctcgccaacttgcccgccggcccgttcgccagcccgcccatcagtctgcccgccagcattgttcatcgccgaatccacctgcaacgcagacaaacgcaacgtctgcagggtctcatcgctcaactcgcacggccatggcaggaactggttgccttccgacggctcgagcggcgcattccaagcgtcgccgaccaccgcatcttcaaaatcgcgggcatgctcgcccacaaaaaatccatccggcaacggcgcatcgatcgaatgcagactggtcatgccgttttcggaggaatcgacatcctcaacttccgcaatatcggccaggttgctcggctcagccgctctggaaacgatattgagcatggaatcgcgcacttccactaggaaattcgacggtttggacacacgtttgcgatcgcccacggcacgcggatcacggctttccgcattcgttgcgctgcaggtgagcagcgcctcatgacgggcgcgagtcaacgccacatacgcgaggcgacgctcgtcggcatgcaaccgacggccatactcctcgatttgcgtcaaatacagtccgtccggatcaataccttccatgtcatcgacgctcatattccgcaaggtgccgaacacttcgtcgtcaatgatttccgcatcctccagcatttccaacgcttccaacggatttccacccacaagcgcgtcatgggggaatcgcggcagaatatcggcgtccacacgcaccggaaccggcaccgcagcaggatcggtcagccacgttttggcggtctcatgatattcgggcggcgtccacacgccatcctggaaaccgttgagatgctcttcatcaacgaccacacgcagatcgctgcccttgttggtggggaatccgccatcggtcatgccgaccacggccacggcatcccattcaaggcccttcgactggtgtacggtcatcagcaccacgtcgacaggcacatcgggagccaccgcgtgctcctcgcgtgcgtcgcgcagcgaatccgcccatgagatgaacgcgcgcaggctcggcgttccctgcgacgcgatctcctgcatatacgtgtcgacgagcttcagcaacgcatcgatcggcgatttggcgagcgccacccgggatgcggcgagcgtggcatcggcctgaccgccgcgcatatgctcggccagctgcatgtcgatatcgagattcaatgcgacgatggcctcacgaaccacttccggcaacgggtggccaagcatgcgctgcacctgacggatcgcatccgcggcgcgaagcacttccttcgtcccctcacgactcaccctgccgtcaatgagttccgcgagatcgtcacgcaacatgaggtccacaaggaaaaccgcattcggcacttgatctcgatattcacgtacgatggcacggatttcagcatcggaaggacccgacttgggagttactccataaattcccagattttccggtttttcttccttgttggattgctcctgcacgattccagctgaaacaagcgcacgataccggcacatcgtgttcacctgttccgcggtatcggcgagcgcctgcagatcgttggcgctgatggagaatcgcggcgtggccagcaatcgcataagcgccgcactgtcggtatgatcgctgacgacgcgtagcaaagcgaacacgtcctgcaccgccgggcgttccagcaacgccgaccgccccactaccagcgtggtcaggcctgcgcgttcgagcgcttccgcgaattgcgacatgattcctttggaacggaacagcaccgccacgtgcggacgattgtctttcatgccattgtcgaggtcgcgcgaggaaggcgtgtgcagggcgatcgcatgtttggcgaagcgcacgaccgcgtcgacctcctgcccgaacgtgtcgaacgcaagcacgcccaccgttccttcgggggcttcgtcggtattgacgagcgccggaacgtcgacttcgcgcatcagcgagctgctgaggcgtctggcaggcaagcggagcggtttggtgagattgttcgccgcttcgagcaccatgcgtgagttgcgccgcgtcacggtcaatgcgaatggcctgctggtggcgtccatgccgaaatcgtgttgcagcatgcggaatgcgccaggactcgcccctcgccatgcgtagatcgattggaaggggtcgccgaccgcgctgaccgcgctgcgatgcgtgtcgtcagcgtggaacagcgcgctcagcagtgccgcctgcgtggtggacgtgtcttggtattcgtcgaggagcacatgcgaatagcgtttgcggtaggccgctccgatggacgggaatcgggagacaagctggaatgccgcgatggtgaaatcgctgaattccgccatattgcaggcgcgtttttcggcatgatagtcaagcacaagatcgagcagcaggtcgcgttgcttggcgacgaatgcgagttgcgcgctgttgaacacgcacatgtcgtgcccgagttcgcggtatttctccagtttcttttcgtagtccgcgtcggaatcctttttcagtcgtttcggcagctttggcgatttcggctcttccgttggcacggtttcgccgtcaagcgccttggcgatctgttcgacgaacgcctcatcccagtcgcgcacgcgttgcacggcttcgtcgaagctggtgcagtcgccgccgatcatggcgccggaaatggcgttggacagggcgaacacgttgcccgctatggtgttgaacgatttcagatcgccgtcgaacgccataagatcatccatatgcctgtcaagcacggtgtggatgagctgcatggcacctgcttcgctcaatggctgcgtgttctggtcaaagccgacaagcagtccatattggcgcacgatggattggaagaaagcgtcgtacgtggagacttccggtttgaggaacgtcatgttcgctgatttcaggccgcgttcgcgctggtcgcgagtcacggccgcagacactcgagacaatagttccgaggccgctttgcgcgtgaaggtcagtccgaggatcttttcggggctcaccccctgttcgatcagcgtgatgatgcgtctggtcatcgtgtaggttttgccggatccagcgccggccaccaccaccacatccgcatacgagggcgcttggacgacggcagcctgctcaggactgtcggtgaacttcatggttccgctcatgccgttctcctttcgaatacggtgttctgttcgcccgcacaggccgggcagatcgtagtgtttctgcagtatctcacatgttccgtcgtcggtcttgcggtgatttcgttcgccctgctggccgcggccgcatagaagaccctcgcgatcatggtgagggaccataccgccatcgtgccgcgtaagccaaggaactcattccaatgctcgtcgctcacttccaacggaggaagcatgtcatcgagtccgtcgtggaaatccttgtcgagttttttgacgtaatagcgcggtatgaattcgccggtattgagacttccattggcgaacagcgcctgctgcatatgcgattcggcggcggtgtcgccatacggcgcagggtatgcgtgcttggctacatggaatagcgcgctttgcgtgatgttcggcgcgttcgccaccgcctgcgccccgcgcatgccgctttcctcggggaatacgagtcccagctgatagcagacgagctgcagatcgttgaacaggccttcgccggtcggactgacaccggttttgtagtcgatcagacgcacctgctgcgtgccatccgccatttcacgccgttccaaacggtcgatcctgccggtcaaacgcacggtgagatactcgctcatgccggtttccggccatcctccgaccaacgctcccataatggcgatcaattcgttccgtgaaatcgcgtgaacgccgtccatcgcattgtaggcgtcgagaatatcgtcgaaatcgaattttgcggtaaatttcagctcaggttcggctttcgtaagttttccaacgctgaatgcatcattatttttaatcggataatcaccatgattcgattgcacgaaatacgtggcgatgttacgcaacgcctcctgcgcctgctcatctttcttcaacgcctgataccgttgcgcgggatcggcaatggcgttgaaatcgccgcatagacgcttgtattcggcatacatccattcggtgatcgcattgatattgtccacgtcgctgatggcggtatggtgttccggcatatcaagtccggcttcggtggcctgttgcgccaccttgtggatcagcgagccgaaactcgtggcgacgctgcccatgcgcgggccggagaagcggttttccaacatccaacacaccgggcacgcccacagattgtctaccgcagaaggagacaaagtcaccacgtcggatcgccgcgatttaccgtttcggcccgacgtcgagctttccgacgtgtcgctcatgcccgtccgcatgacggccgcgatcttccgcatggtggcctcgaccgtctcccccataaacggccaacggtcagggtcggccgccgtaacaccatgcgaagccagcaatgccaacgcttccgcggcatcacgcgccttcgggctgtcctcaggttccgacgcaagcacgcttcgggcggccgcgaccagaccacggggatcggtttccagccccgcgtaatcgccttggccgccgaccgacgcatattctcgccgttccatatcggcgtcgcgatcgcggtcgaagcactccggcatatatccgtatagaaaatccgaaggcacattgtcgtcattcagcacggcgctcaccaccacacgctcgctggcacgggtcaacgccaccaacaggctcttctgctcggaggcgagcaccgacgccagttgcgcgtcctgcctgcccgccggagtgacgatcgtgtcggacaatacgccgtgcagcatcacatcggccagttcctcaccgccgaacaacgtgttgcgtggtgtgagattcggccactgcccctgctgcaaagccggcagaaaaaccagattccagcgctttcccgccgctcctgcgggagtcgtcagggtcaccgcctgatcaatgggcgcggtatgcgccagcgaatccgcctcaatggtcagcaaacgcacctgttcgatgaacgcctcgatggtgtgtaccgcgaattccccgcttgactcgccgcctgaagcatagttgaacaaacgcatcgccgcgtcaagccgatcattcgcggcacggccggcagccgaatgctccagcgccacacgctgccagacttccgccttgccgcaggccctccatgcgcaatccaacacatattgcggttcacgcgaaaccagtttggcttccgactcgcatgttttgtcaagaaccttccacaatgatgcgaacgccttgatctgcggatccgcgcccagcacggaggcgatcgcatcgaccacgcgatcggtattgccctccataagaagcacgtacagcgcttccatactcagcgcgaaatcgccttcatgctcgtcttcatgctcactatcatgctcgccatcggcgcgaatcgcatgatagtccgtcatataatcgcgccagtcttccatcaaacgagggagcaacgcctgttgttcgacggcagcgtccgccgcatcctcatcatcttcgaaatcatcttcaaagtaatcttcgaaatcatcttcgtcgtattcttcggcagcatcctcatcatggttcgcagccttgctttccacaatcgaagcgagcgaaaccaacgcgttcatcgcggattcgatggatgcgagacgggccggacgcccctcatgccgttgatcaccaccgaccgtaatcagcggagatcccataatcagcgccacgcgcgaacgaatataggatccggcggtctgcaggtccatggtcgaagccgcgatcgtctggtttttcaattcggccaactcgatcaacgcgaacagaccctgcacgaacggctcatccttcaacggccgggtcacgctggaatagcgcacgggaacgccgtcagcgcgcaaccgctcgccgaatgcgcgcacggtggcattgtcgtgcgcgatcacggccatgtcgttccatacacgggaacgttgcaaatgctcagttttgatcttccacaccacgtcgtcgagctcttcggaagaggaacggtacaaggccgtttccacactgccgtcggccggcgtgacacgagcgcccgtatcgtcggccggcaacgtttcgatgggcatcgcgcctggcatatcgctcattttgccgggacgatcgggcagaggcacgtccgtcgactccgtgcttgcgatcgacaggctcactcgcgtcgcgacaagcgtgcgatagtcgccatgcacgccttgctggttcgacacggtttgcgcggtatcgccttcgtgcgccgtttgcagaccttcgatgcgttcaagcctcgctcccatgcgcgtctgcgcctggttgaacagatattccggatatgatcctcggaacgtctgcacggcttcgtcgggattgccaaccaacagcaggcgcaccccgcgttcatgcagggcttcaagcagtgcgaaaccagccaacgtcgtatcttgaaaatcgtcgacgatcagcatgttcgcaatatcggcttcctgtatgccagacacggcttcggtggcgtcgatcatcagctgcgacgcgtcgagacgatattcgccaggataagacgaacggatcgcctcattgtattcctcacgcaaggcgaaggcgagacgccattgagtgcgcaggcgttcgcgacgttcgtcaagcatgccgtccctgctggccgcacgggcgatcagcatgtcttcgaactgcggtttcgcgccaatctcgttcatgcgtgcgagcatgtcgcgcaattggttggcgaatgcgtcggtggaatcgtcggccaccagtcctgaccattcggaaaccgcgaaataggtgcgcagcagatcgcaggtggcgcaatcgtcgccatgttgcctatgctccacatgcgaagctagtaccttgcggatgatcacatcctgttccgcaccgttcaacagtttcggcaacggttcgccttgacttgatctcacggccgtcagcagacggaatgcgacggcaggcaacgtagtgaccggtcgcgcctgcgacacggccgacaattcgcggatcgcccgatcgcccaacgcatcggcgatctgcctgccagacaccgtcatcacggcattcccgtcaccataccgcctcattgcggcaaccagcatgcccagcgcaaactcggtttttccactgctcggcgcgcccgcaaccaacgtgacgcggtcaaggtcttccaaattcatcatgcctcccaacactactagtctcgccctcctttacctgacaaatccggaacctgcaaagttgtctcgaagccaacctttatccaacacgatctgcggtgcaaccactccttcgtggcatctgcagcaacgccgacaacacatcaatggtcatttccatttgagccagatgcccgtcatccagcaactgaatgtatgtaccctcatcgtcgccacgaaggccgtctcttaaggttcgcacgttctttctatcactacgacttctattattcagccacaacatgtctcagatgcccgtctttgtatatggacattttgaccccttgctgataggtttctgggttggtcttcagttaggataggatccagagagagcggccgaaaagcatacgcaccacgaggaaagagagcatatggaagccatgaacggcattccccctcaaatccctgggtatacattcgcccaaaagttgggttcaggttccgaagcgaacgtgtatttgtaccagcagctttcccccagccgacaagtggccatcaaggtcagcaagggaacgctcgatccgcgcgcggcgtcgcggttccgttccgaagcgaacttcatgggcaggatctcctcgcatccctacattctttcggtgtacgaaagcggcatcaccgccacaggcaacggctacaccgtattcgaatacgctccgggaggcaattacaagaccttcctggaatccaacaggctcaacgcagaccagatgctcaccgtcggcatcaatctggcgagcgccctttccacagcgcaccgcgaaggcatcatccaccgcgacatcaagcccagcaatattctcatcaacacgcatggcatgcccatgcttgccgatttcggcatcgcgggaacgatttacgggcgtcccggcatcggctacaccatcgcgtgggctccgccggaagtgcttgcgaagaacggcggaggcaacgaatcctccgatatttattcgctgggggcgacgctgttcgccatgctgacgggccagtcgccatatgaatacggctattccgcggccctcggctcgaccaggggcaaagaacgcggtgctctgctgagaaacatcattctcaccgatccgctccctaagctcaataggccggatattcccccgcaagtggagcggattttacgcaaggcgttgaataaagcgccggaagaccggtattattccgcatatgatttcgcgcgtgacatgcagcgtgcgcagcaggaattgtatggccatgccacgccgaccacggtcgaaggcgaaccgccgttcccgcaaaatctgtacgcacagtcccaggcgaacattcaggtttcaccgaccgtcccaaagcagcgcagcacttgggccaagcctcttgcgatcgttgtttcggcggtcgccgcgattgcagccgtcgaactggcgttcgcgtatgtgatcttgccgaatatggattcggcttccgacaatagcagcgtgcagatcaagactccgggaacgcacgatcaggacaacgattcgcctgattcggccatcaccacaagtagcgtgcccagtgtcgagaatctggccggctcatattccgccgatggcagcagcgtgcagttcacatgggtgaaccccgaccctcaggacggcgattcgtacgcatggtcgctggtaggcgatgcaggagtagacccgaacgcccaaggaaccaccaccaccgacacgcgcatcagcatcaaacccgccgacggctcgcagacctgcatccaggtgagcctcatccgagcggaccggcagatgtcgcagaatcctgcgatcgcgtgcgcggccaaaccataagcatcacagcacttcccaacagggtcggccgacggcattattccatcgcaggcgatgtccggaacgaacacaacgaccatcggaacactcaaggaagaaccgaaaatggacaaacgcaagaacgcagccgatcagccggcacaatcgcacgaacgtcaattgcgcttcggatcgatgatgcgcaaactgctgttgccgtcgggaagcagacggtggatcacgccgatcgtcatgctgcttctgctgctgggtatcatcgcaggcgcgttcatcgtcagttcggtgacgcaacggcatgtgcaacttgacgacggcaccgtgtggatcacgtcgctgaaggaccgcaaagccgcacgattcaatgcgaagaacaaggatgtggacgccggagtctcatccgcagcctcccgtttcgacgtggcacagcatgatggcgacacagtgatctccgaaggcaccaaagccagcaatatcgcggcttccaccattagcgaaaccggcaacaccgccatcaaaacggatatcgaaaccattatcggaggcaataccgcagcgttcatcaacaccaaaaccggcaatgtgtgggtgggatccgctgccgatgtgaaatccgtcaaccccaccaccgacaagccgaacatgaaactgggatccggcggaaaaatcgcggtgacgcatgacggaaccgtatacggataccgaacttccgatggcgcggtgctgagcatcaaagggccgcaagacacgcgcgagcaagttggcacgataggaggcgcaccgcatgccgaatcgttcaccgtcatcggcgaaaccccggtcgtggcggcaaaaggcaccgtgtattggccgcagggaagcgcagccatcaatctgcagggcagcatgaccttgcaggccccttccacggacggcaaacagaacggatgggtggccgtggcgacaccacgcgggctcgcaacggtgaacctcagcaccaagaaaacctctgaaacaccgaattccggcaagggcgaggccgcccaaccggtgtccacaggcggatgcgtgttcgccgcatgggcgcagaaagccaacaattacgccaaagtgtgctccgtagacggttcggatacggcattcgacaccctgaccaacatcaacgccacttcggaactgatattccgcaccaaccatcgtctggtcatactcaacgacgtggtcaacggcaacgtttggaatccgcaggaatccaccaaggtcatcaaaatccaatggaacaaggtggaaaccaaacagtcgaagcaacaggaacagaacaacgacagcgccaacaaccagcataatttcagcaagacctgctcgtcgcaatccggccagatcaaagccgaagatgattcgttcggcgcgagaacaggatcgcagcagatcctcgacgtgctccgcaacgacgaacagaccgactgctccgtactgcgcatcacctcggtaagcgcccccgacggcgccaacatcagcgtttcccccgtatacgacggacgatatctgcagctcgacgcttccgcggcatccgaaggatccgtatcgttcagctatgaaatctccgacggacgcgggcaaacctccaacgccaacgtaagcctcacactggtaggcggggacgacaacgcgccccagcaaaccgatacgccaccggaaatcgacgtggaacaaggagcggcctacaccaccaacgcgctgggcagcttctccgatcccgacggcgacccgctcaccctcgtatccgcaaccccgcaaaacaccgaccaggtgaccgtttccacacgcgccgacgggcagctcgtgttcaacgcgggatccatgtcttccggacgcgccggcatcgaagtgaccgtttccgacggccagcagaccggcaccggcatggtgtatttctcagtgaaaccggccaacacgctggccgcggtgatcgatccggccgtcaagcagaccacgccagacacccgcaccaccatcgcgctcaaacaatacgtgcatggcacctcggccgaacccgcgcagctgaccgccgtggaaaccccatccggcgcatccaccaccatgaacgccaccgatatgtcgttcaccttcagcgcatccaaccccggcacctactacgtgccctacaccatcacacaaggatccatcccctcgaccggcctggcccgcatcgaagtgcaggcggtgaccggagactccgccaagcccatcgcagccaacgacgtggcactgctcggcgccgacaacaccgcaatcgtggaaccactgtctaacgacgtcgacccgatgggtggtgtgctatccgtgaccagcgtgaccgccgatgcggcgagcggcatcaaaaccggcgtcgtaagcaacaagcgcgtctacatcaccgcacgacaggtaccgaccgagcccgtgcagatcaaatacagcgtcgccaacgcggcaggcacgtcaaccggcgtgatcgtactgcagccaccggcactgaccacctccaactccgtgccgaaagccgacaacatcaccacgcaggtacgcactgacggcatcgtctccatcgacgtgctcgaccacgtgacctactccgacggcaccacggtaagcctgcaaaacgacctgcaatacgacaaaaacacgttcaaaggactcgtattcgtatcaggcaacaccgtacgataccaagcatccgaccaaaccggatccttccccgtaacgtacaccgtcaaagacaatctcggcaacgcggcatccgccacaatcaccatcaacgtgcatcaaaaagacgcttccaacaaggctgcgccaacaccatccgacgtcgaggcgcaagtcgcggccggccaaaaagtccagatcccgatcaccttgaccggcatcgacgccgacggcgacgacgtgcagctgctcggtctcggcaacaaggcgccgacactcggacgcatcagcgaagtcggcgccacctacctggtatacgaagcctatgccgactccacaggaacggacaccttctcatacgccgtcgaagactggaccggccaacgatcccaagcgcaaatccgcgtaggcgtattcacatccggcaccgactcgggcgtatacgcgcgcgacgacgaaatcacattgcgccccaacaccgcagcaaccgtgcccgtggcgcaaaacgacatctccggagacaacaccgacctggccgtcagcgaaaacgtcgaatcgcaagacatcagcaatgtgaccgtggcggacaatgcgctcgccttcaccactcctcagcaggcgggcacctattacgtggtgtatacggtcaaagacaaggcaggattgtccgacaccgcgacattgacggtgaacgtggacgacaacgccaccatcgaaccgccgacagcatacgactaccgtgtgccatcttccgcgacgatcgataagaaatccatcgacgtggacgtttcgcaatggatcgcgaatccttccggcagcgccgacgaactgcaggtggccgtggatgattccgccaccgaccatgcgcatgtcaagggcggtgacaagtccacgaccattagcgtggaattgacggacgaggcacgagccgtgccgtacaccgtgaccaacacgacatacaacatcacgtccactgcgttcatccaagtgcccgcgtacggcgtgttcccgccgacccttcgaccgaaggcgccggcattgaaggtgaacgcacgcgagacgatcaccatcaatatcgccgattatgtgcgcgtgggcgcaggcaagatcgcgtatgtggacggcgccgattcggtgagcgccacgaaggccgcggacggcgacctgtatgtgaacgaccagacgttgaagttcaccgcatcaaaggattattccggtccagcgtccatcaccttcaccgcggtggatggcaaacgcgacaagaacgataatgtgaaaatcatcaattcggcggtgttgacgttgccgatcaccgtgatcggacgtgacatgcccgcgccgacgttctcctcgtccaccattgacgtggtcgcaggagaaagcgccaccaccatcgatctgaccgcgttgacccattcggcgtccgacctgtatgacgatgagaagcagtacacgtattcgggtggcaccgattccgaccaggtgagcgccaaggtgagttcgaacggcaagctgaccgtgtccgccgacaagaccgcttcgccgggaacaacggtgagcgtgccgatttcgattcaatattcgaagggcacggtgagtgcgggcgtcacggttcgtgtgacggcctccaacaggcctttggcacgcatcaacgcgaaaaccgtgaaggtcaaggcaggatccagtgaggaagtgaacctgctgtccgatgcgtataatccgttccccgattccgcattgaccgtgaccggatgcacgtccgatggcgcgtcgaagctgaccgtggactgcccgtccaacggtgtggtgtcgatcagcgcctcgtccgatatcggcgcgagcaccaacaaggtgatcgtcaacgtgcgcgatgccaccaatacgaaggaacgtgaggtgacgggcaccatcaacgttttggtgatggacaagccggatgcgccgctgctctcccccatcgccggagacccgcaggatggcgcggtgaatctgagttggacggccggctcttcgaacggcagtccgatcagcgaatacaaggtgtcgtggggcggcgacggttccggcgagaaatcgtgcggatccgtgacctcctgccaaatcaccggcttgaagaacggcaagacgtactcgttcaaggtgcaggccaagaatgaggtcggctggtcgaaggagtcgaatggcgtggaaggcacgcctgacaagcttccggacgcgccgaccgatgtgaaggccgaagctagcaagaacaccatcactgtcacatggaaggctttggagggtaatttctccgccgtcgacaagtatcaggtgacgttgagcggtccgaatgtggcgaatccggcccaggaagtcactggcaccagcatcacgttcaaattcgacgacaatgcgatcaccgacggcgcatcctataccgccacggtcaaggcgcataacaaagtgaactggagccagccctccacggcatccaatgccgtttcgccttggggtacgcctgacaatccgactatttccgccgatcaatcaggcgacaagatcgtggtgagaggacggatcaatgacgcacgtaactcgaaataccagtcgattacggtaagcatcgagggcgaagacaaatccgtggagacaagcgccaaggattattccgtcgaattcgacattaagaacgagtggtactacagaaaacttaagccgacgattaccgtggttacggaacgcagtggctcattgcgcaacgaagcgtccgtttcgactttcacagcagtcgatcctccaaccaatgtgaagctggaactcaacaacaacacatgtgtggcgacctggtccagaaaaggtggacgcgtcacaggtttcgttgtaaaggccaagggttattacgatgatgatgttcatgagagcagagccgaatggccgctttccggtgattggagcacctgcgatacggtaagcgtgcaacagtacttcatcgacacctcacatctcagcgacccagcaatcgctaccgataataccgtcggcaacaaaaagccagcggaaatcacactgccatcctcattgacgtgggatacacagaacgccaacatcattcatgtcaatggcggtagttgggaggcccacgggcgaagtgtcaaaggccagatcgtcatcactccggcaggggaaagctcgcatacctacgattggccagctaacggcacactggatgtttccgacatcaccagtccttccggtaccagatgcgattgggaggttcgcgtgatcaccactgccggggaaccagaaatcaatgcgaccaagaaaagctctgatcccgtgaccggagtccgatacgaggagaaaacccccgatccggaaccgggaccaacccctgataatggagagacgcaatcctcgatagacaccaatgcttcagccatctcattacgaacagggttggcaggaaaacaggcgcgaggcatctcattcaccgtcaaataagcaaattcaacatcacaaccaatcatcaatacgatcaatagaagcaaccaaggagtacctatgagcaacgaaaacgacgacgccacccagctgggttccattgggcgccatatgagcaagccgcaacagcccggcaatccgcaggcacgccccgcattccaagctccaagcctgccgacgcatccgcaggaacaggacggagacgaagagggcacggtactcagcacgcataacgcaactccttccaggccgacgaggcctacggttccaatggcgcagcccatgcaggcgcaaccgacgcaatccgctccaacacaacagccgctaccacaatcgcaatcggctcccgtaatggcaacgcgccaattcccgcagactacggcaccaagcgtcaagcccgcgcagccggccatggcttcttccatgatgtccgcgccgcaggccgacatcaccgaattccatgaactgttcgcccaactggtcggcaacgtctcccaagtcgtggtcggcaaggaacagccgatccgccaatgcgccaccgccatgatcgtcggtggccacattctgctcgaagacaatccggggaccggcaaaacgcagctggcccgcggcctcgccaactccatcgacatgtcgttcaaacgtatccagttcactccggatctgctgccgtccgacgtggtcggcgtaacctactacgaccagaagaacggcgaattcgaataccgcgaaggtccgattttcgcatccatcgtgctcgccgacgaaatcaaccgagcctcgccaaaaacgcagtccgcactgctcgaggtcatggaagagcagaaagtcaccgtcgacggcgaaacccatgcggtaccgcagccgttcatggtcatcgccactcagaaccccatcgaacaactcggcacctacaaactgcctgaggcgcagatggaccgtttcctcatcaaaacaaccatcggctatccgagccatgacgtaagcgtgaacatcctcaagcaggtcaacgtcaccgaccgtgcctccaccgtacatgcggtgctcaccggcaacgacgtgctgcgcatgcgcgccatcagcgaaaccgtgcgtctcgacgacgcgatcatcgaatacatcgtgcgcttggtggaagcgacgcgccacaacgaacgcatccaagtcggatcgtccatgcgaggcgcgctcgcactgacccgatgcgcccgcgtgtgggccgcgtccagcaatcgcggatacgtggtgcccgacgatgtgaagcaactggccgtcgccgtgctcgcacaccgcatcacgctcaccgcggaggccacattcgcgggatccacccccgaacagatgatcgaacagatcctcaatgaagtgccttcaccgaccgtgggcgccaccgcctgaaacgcacggcgcagccagccgcgtacgacacggcacacgcgaagcgcacaccccacacgaaacgttcgtaaacccccgaaaggtcaagcatgcgacaatccaaaaccatgcagcgcaggagaaccatgcaacgatccctgcgacgcatcaagcatcgcatcaaacgactggtcacctcatacgtgtcgccgctcggatgggccgtgaccggactcgccatcgcctcactcatagcgttcacaatcctcagctggcatgaactgctgaccatggcgatcgtgttcgcatgcatgatggtcgccgccatcatgctgtcgctcggcaacacgtcgttcaccgccaccatagacgtgtccagcaggcgcgtcaccgtgtcagacacggtgaaagtcgatgtgtgcgtcgacaatccagggcgcacgccaaccacatcagcacgcggcgacctgcccatcggagacagccacgaacgattcgccatccccatgctcgccgccggccaatcacgccaaaccaccgtggaattcaccgccgtctcccgcgcggtactgccggtcggtcccctgtccatacgcaaaggcgacccattcggactcgtacgacacgaaaagaaacttgtcgaccaaatcaacgtgttcatccacccgaaaaccgttatgctgaacacactcaacgccggaattccgcgagatctcgaaggccagccaagcggcgaaatcgtcgacgacgacctcgatttctacggactgcgtgaatacgagccaggcgacgacgtacgcaacgtgcactggctcagctccgcaaaaacaggcgcactgatgatccgtcaatacgaggcgacccgacgcaccgacaccgcattgaccatcagcgtgaaccccgacgactatgtgagctccgacgaattcgaactggcggtatccgtccatgcctccatcggcgtgcaatgcctgctccaaaaccgaccggtgacctcacacgcgggaaccgaacacatcatgccacgcaactccacggaattccttgacggctgcagcgccatctcccccgatatcagcgacaatccgaatctggcgcaaaccaccctcgcccatgcccccgactcatcgttctactacatcaccgtcggcaggctcaaaaacatcgacgaaatcaaacacatggcgctcgcactcccccgatccgcaacctgcgtggtactgcaaaccgccatcggacagccacgcgccatcaaacgatacgccgatttcaccctggcgaccgtaggaaacctagacgatctcccaatgatcatgggggtactggaatgagcaccacaggactttccacccacaacaccaacaccggcgacaccggccgcaccaccggattcggcaacaccttcaccggaaccggcaccggctcatgggccgactccacacactccgtcatctggatgtcacgagacggcaaatcacaggcactcccctacctacgccggacacgcgcctcgcaatacgcaagcctgctcgtcgcagccctactcaccctcgccgccgccagcaacctcatcgacgtctacggatcggccacatcctgggcgctcgccgccattccggccaccatcatcggatctctcgtggcgctcgcaggcacggttccggcacttcgtctctggtggcagatgctgttcatggccgtcgcccagctggttgtcggccctgtactgttcctcaacgacaccaccatcgcccatattgttccgaccttgcgcacgcttacacaaggctggatgaacatgctcggatcgttcaaattcattctgtcggtcgaacctcctaccggtaccgccgatggctgtttgctggccgtatggaccatctgcctgtggttcgcgctactgaccggcattttcgcagtgactgaagatgggcgattcaccatgatcgccattattcccgttaccgccaatcttgcgatttgcgcgctgctcggctcatcttccggctattaccgcatgttcgtaggcaccataatggcgctcatattggtgatttggatcagcgcacgttggaaattactggaattgggacgttggctcagttccgtcgtgatcgtggtgctttccgtcgcattggctattggaggatgcctcgtcgtcgatcaggaccgcaccattctgcgcgaccattatgatccgccgcttagcccgtacaattacaccagtccgttaagcggcatgcgctcgtacattacaaacagtaaggacgatgtgctcctcaccgtcgaaaacctgcccgctggatcaagcgtgcgactagcggtcatggaccgtttcgacggcaacgtatggaatctgtccgactccaccatgtcatcggactcctccaattaccgacgtgtcggcacctccatcaccaacaatgccgaaggcaagaaattcaccgccacattcaccgtggacaaaggactcagcgactactggctgcccatggccggagccgcatccagcgtgacattcgacaacagcgaaaactccgactcgttctactacaacagcgacaccatgtcggccatctacccctcacgcacctccgaaggtctcacctacacggaaaccggcatcatgccaacggttcccaccgacaaacagatcgccaaaacagacgcggccgccatcagccagccaaaagccgaagatgtgcccgactgcgtggacaaactcgccacagccatcgccggaggccaatccaaaggcggcgaagcggcccaggccttagccgaaaagctcaaagaatccggttggttctcacacggattaagcggcgactacccgtcaaccgcaggccacggcaactaccgcatcgaccaactgctcgccggaacggccatggtcggagacagtgaacaatacgcctccgccatggcattgatggcacgcagcctaggtcttcccagccgtgtggtactcggattcctgccaaaagacgacgaaggtgaaatcagcgaaagccgcaccgaagaacaaggaacaaccaccatcacgaaattcaccggcaacgacgtgaccgcatgggtggaaatcaaactggacggctacggttgggtggcattctatccaacgccaaaggaaaccaaagtccccgacgaaaaccagaacctcaccccaccgaatccgcaaaccctggtacgccagcccccggtaccactcaccgacccgctacgtgacgacacccaggccaaaggcaagtcctcaatcggcggaagcatggccgacgaaacctcagccaacctgttctggcagcatttcggcagaatcgcaagaaaagtagccatctacggaagccctctatggacgctgctcatcatatgcggtctcctgctcgccatcaaagcgatcgcactggcacgatcaagaaaacacggcagcacgcagcagcgtgtggcagccggctggcaatcggtcgccgcgctcgcacggcaaagcggactcgacattcgaggcacacgcagcgaacaggcggtttcgatcgcgaatcagatggatatttcccgcgagaccttgctcgctttgggcgcgcaagccgattacgcggccttctccggtaatttcgtcaacgaagagcatgtgcagcagtattggcgcgatattgcacaggaacgcaagtacatgctcaagtcattgccgacgttacgccgatggcgtgccaaactttcgcttgccgacgttttccacttccgcagcaaccgcagcgggcggaacaacggcagcgatcggaagcacaatcgtaagaaaggacgggactcatgatcttccgtagcatcgaggccggcctgaatagcaatgtcgggtgcaaaagaaaaaacaaccaagacaacgctctcgccagccgtggcgtatatgtcgtatgcgatggcatgggcggcggcaaaggcggcgagcgggccagcgcacaggtggcggcatgtttctcgcagcttgccgaacagccgtcgcgcaaccgtacgtccatcgaacatgcgttgagccaatcgcagcaacaggtgctcgaacttggccaggagcttggcggcatcgccggaaccaccatcaccggcgtggtgctgccgactcgcgttgaagatagcgtgcatgaacaagccatcgatgagtactgctacgtcatcaatgtcggagattcacgcacctaccatatgcgcgccgatgcggaaggccattggatggcggagtcgctgacccggatcacacgtgaccattccgaacggcagaacgccatcgacaccggcgaaatgctaccggacgaggcgaaccgatgcataccgcgcaatatcatcacccaatgcgtcggcgctcctgacggcattcagccggactggtatgcggcgcgctccacgggacgtttcatcatctgctcggatggcctgcacgcgcagatcgatcgggaactgctcgccgatgtggcagcctcatatggcgatccgcaagtcgccgcggatatgctggtgcagtccgcgctcgacgcgggcggcaacgacaacgtcaccgtgattgtgcttgatatatgcggcaaatcatcggattattcggcaaatgacgattggaacgtcagcaaaatcgacgatcacgaggatatcggcgatttacaggaaagcacattgcaaacgttacgtgccgtccaataatgcgcatgttctcgcaatgacaatcgtcaataatcggatttgtcacgttatatcagcgtattcaatacaatatttacagaacacgagataaggagatcatgatggtcgatttcgatgccgcggtggcggccgtgcaggatccgaacgcagatcccgtgtttctggcgaaaatcgcttacgaaaatccggaattcggcgcgaatgtggttgccaatccgcgtgcgtacccaggcctgaagcgttgggtcgcccaattcggcgatgagcgcgcacgacagcagctggtcgcgatggggtggccggttccgcaggacggaatcatgcagcaggaggccgagacggcttctgaacaggcgcaataccagatgccaagcgagcaggcgcaataccagatgccaagcgagcaggtgcaataccagcagccgcagcaatcatcggaagtgcaatatcaggcgcagcaccagccgccggcaacccagcaatgccagcctgaaccgtttgcggcaacacctgcatcgaatatggcgaacgatgcttcgacggaatacgtcgacccatataccaaccccgcagacctgtctgaagtggctgatttttcgccgattcagccgcaagagccagtcgcgtcgaatgctggtttcaccgcggaattggccatgaccacggaagatcagatgctgatggctgaaatcgcaagcaaagctccggagctgcaccccttccttgcgcgcaatccgcatatctacccggatctgctcaactggcttgccagtctcaatgattccgccatcaacgcagccatccgtctgcgacggtaacccttggtagaacttggcaaaagcccgacgaaagccgccaaacaaggcctaataaggcctaataaaagccgcttgcattggtaagctttcgtaccataatatgttcgttgcgccgtcatcctcatttatggattgacgacgcaacatgtatcgcggcgcgaaggaaatcagcgctgttcgaaagtgaagaactggtctccgatacgcaccgtgcaaggcgcgtcaagcttcatcggcttgcgttcgaccttgatctcctcattgccttgaatgatgtacgtgccgttgagcgaaccgtaatcctcgatccacaatacgccatcctgatcgaagctgatcgccgcatgattgcgtgagatggtgcgcgtcggatcctccaacttcacgaatttcgcaccttccggcacttcagcggaaggcttgcgccccagcagcacacccatatcgacgatcacttcctggccggtctgctcgttgtaaagcacatactccagcttcggctgcttcatggtgaacgccgaagacagcaccgtgccatcccagtcgatgtcatcatcgtcattgaccggttcgacgtcggacggttccagcgctgcggcagcctgttccaccggctgtatgttcgccgcatacgattccgcggattcctgcacattttccaatgcttggaatgcttgggattccggtgattcgtatgttggctgcgatgttggctgcgactgcgcagcctccgccatggcgggctcaacgagagaagacattactgtggcatcatcgtcataccaacctggttcaggtggaggcggatatggaagaaagctcataccttcattgtaatttgccatgcgattttgcgatgaagatatccgctctgcaatacgtacggttccgcaataggctgactgttgtcgtagggatcgcagcaactgcagttccgcattaaaaatagttccgcattaaaaaatggggatcagctgtttccagccaatccccattcatgtattgagatgatttcagacgttatgccattccatcatcgcttttcggatcacagggtgtcgcccaaatccatctgaccgccattgtcgtccaggaagtcatccggattgaagtcgtcgccgagcttcagatctccgaagtcgatgttcgagaagtcgacttcggacagatcggcgtcgccgaaggcggcatcggactcgtcgccacccaaaccgaagttcgggtagatggtgtcgcgaatggccttgtcaggctcgaccacggcgttacggtaacgggcaaggccggtacctgccgggatgagcttaccgatgatgacgttctccttgaggcccttgaggtcatcgaccttctggctcagagcggcttcggtaagcacgcgggtggtctcctggaaggaagccgcggacagccaggaatcggttgccagcgaggccttggtgatgcccatcagctccggacgaccggcagcaggcttgccaccttccttcacggccttcatattggcggccttgaagcgggcctgatccaccagttcacccggaagaaggtcggtatcgccggaatcgatcaccgtgatacgacgcagcatctggtgcacgatgacctcgatgtgcttatcgtggatatccacgccctgggagcggtacacggtgtgcacttcctccacaatgttcacctgggcagcacgcgggccgaggatgcgcaggatcttcttaggatcgacggagccttcgatcagctgggtgccggcttcgacatgatcgccgtccttgaccatcatcggggcgcgacgggtcaccgggtaggcgatcggctcgacggaatcgtcgtccggcttcaggatgacctgacggccgcgctcggtgtcttccaccttgaccacgccagcgaactctgcgatcggggcctcacccttcggagtacgggcttcgaaaagctcggtaacacgagggagaccctgggtgatatcggatgcggaagcaacgccaccggagtggaaggaacgcaacgtcagctgggtaccaggctcgccgatggactgtgcggccacgatgccaacggcctcgccgacatccaccagcttgttggtggccagcgaccagccatagcacttggcgcacacgccgcgcttggattcgcaggtaagcacggaacgggccttgacctcttccacgtcgtgggcaacaagatcgttgagcacgtccatggacagcgcgtcaccggccttgtacagcacggtctcgccgtcggcgggatcgatcacgtcggttgcgagcagacgggagtacggaccgccatcggcggccttgaccagatgcaggttgccttcagcatcacgctcgccgaccttcatcgtcaggccacgcttggtgccgcaatcctcttcgcgcacgattacgtcctgggaaacgtccaccagacgacgggtcaggtagccagactctgcggtacgcagtgcggtatcggccagacccttacgtgcaccgtgctgggagatgaagtattccagcacggacaggccgtcacggtagttggacttcaccggtcgaggaatgatctcgcccttcgggttagccacgaggcctcgcatgcctgcgatctggttgatctgcatcatgtttcctcgtgcaccggactgcacgatgatagccaggttgttcttggagtcgaagtgttcctcgaccgcctcagaaacctcgctggtgcacttggtccacaggtcgatgagttcctgacggcgctcctcttcggtgagcataccgatttcgtagttctcgttgaccttgtcggcttcggcttcgtacttctcgatgtactcgtcgcgctcggacggctggataacgtcggagaacgcgaaggacacaccggaccacggtgcgcgggtgaagcccatatccttcagcgcgtccagcgttgccgccacctgtgcggtggagtaacgggttgcgatgtcgtcgacgatcttgctcagacgcttcttcggagcctgatcgttcacgaacgggtaatccaccggcagcgtgctgttgaacagaatacggccataggaggttgcgaaaagcacggaaccatcatggaagcgctcttccttcaccacggccgggctgcccggttccggatcgacgacttcgatttcgctcggctcccagcccttcggcagcacaaagtcttccggaaggcggataagcaccttggcctgcatgtcgatctcatgcttgtcgagggccatttcggcctcttccagcgaggagaacacgcggccctggcccttggcaccgtcgatgacggtggtcaggtagtacagaccgaggatcatatcttggctcggcatggtcacggtgtggccgtcagccggcttcagaatattgtcggaagccatcatcagggagcgtgcttcagcctgggcttcagcggacagcggcaggtggactgccatctgatcgccatcgaagtcggcgttgaatgcggcacaggcaagcggcggcaggtggatggccttgccttccaccagaatcggctcgaatgcctgaatacccagacggtgcaacgtaggtgcacggttcaggagcaccggatgctcggcgatgacctcttcgagcacgccccacacttcggagtcgccgcggtccacgagacgcttggcgctcttcatgttctgggcatagttgaggtcgacaaggcgcttgatgacgaacggcttgaacagctcgagggccatcggcttcggcagaccgcactggtgcatgcgcagggacggaccgaccacgatcacggaacggccggaataatccacacgcttaccgagcaggttctgacggaaacgaccctgcttacccttgagcatgtcgctcagggacttcagcggacggttggaggcgccggtgaccgggcggccacgacgaccgttgtcgaacagggaatcgacggcttcctgcagcatgcgcttctcgttgttgagcatgatttcaggagcgccgagctcgatcagtcgcttcagacggttgttacggttgatcacacgacggtagaggtcgttgagatcggaagtggcgaaacggccaccgtcgagctgcaccatcgggcgcagatccggcggaatgaccggaatcacgtcgagcaccatggcctccggcttgttgccggtggtcaggaaggcgttgacgaccttcagacgcttcagggcgcgggccttgcgttggccggtaccggtgtcgatctcttcgcgcagctgcttggaagcggcttcaagatcgaagtcctgcaggcgcttcttaatggcttcggcgcccatgcagccttcgaagtaatcgccgtagcggtcttccatctcacgccacaggtcgacgtcgccttccatgtcgcccggcttcaggttcttgaagcggtcgaacacggcgctcagacgctggatctgctcgtcgaaacgaacgcggatggcggccatttcacgctcggcgctgttgcgcagcttggcgcgtgcggagcccttggcttcgccttcggcctcaagttcagccagatcggcttcgaccttcttggcacgctcttcgatttccgcgttgcggcgcttctccaagttggcgatatcgttgtcgaactcgtcctgcagacccggaagatcctcatgacgctgttcctcatcgacgctggtgaccatgtaggcggcgaagtagatgaccttttccagatccttcggagcgatgtccagcaggtagcccaaacgggacggaacacccttgaagaaccagatgtgggtcaccggagcggcaagctcgatatggcccatgcgctcacgacgaacacggctcttggtgacttccacaccgcagcgttcgcagacgatgcccttgaagcgcacgcgcttgtacttgccgcaggcgcattcccagtcgcgggtaggtccgaagatctgctcgccgaacaggccgtctttctccggtttcagggtacggtagttgatggtttcaggcttcttgacctcaccgtggctccagttacggatgtcgtcggcggtggccaggccaatcctcagtttgtcaaatgcgttgacgtccagcactctattgtcctgtctatcgattcttaatgcttaatcacgtttcatcaggctggtcgcgccgcgctgtcaggcaacgcgaccagccttgggatcactggaattcaggttcttccacaacctggtcttccttggcggccgcgtcaggacgtgcgccaatgttgaagcccaaatcgtcggaggaagtagacggatcgtcgtcctcgtccttcatgtcgatggccacgccttcggcgttgagcacttcgacgttcagcgacagggactgcatttccttaagcagcaccttgaaggattccggaatgcctgccggcggcaggttgtcgcccttcacgatggcaccgtagacacgcacgcggccgtcgacgtcatcggacttggtggtcatcatttcatgcagcgtgtaggcggcgccataggcctcgagggcccacacttccatctcgccgaaacgctggccaccgaactgagccttaccgcccaacggctgctgggtgatcatggagtacgggccagtggaacgcgcgtggatcttgtcgtcgaccaggtggtgcagcttcagcatgtacatgtagccaacggagatcggcttcggatacggttcgccggtacggccgtcgaacagcacagccttgccgtcgtcgccgaccagcttgttgccgtcgcgatccggaagggtgcaggacagcaggcccttgatggtttccggacgaacgccgtcgaacaccggagttgccaccggagtgcccggctcgcccttttcggcgccctgcggaatgtacttcttccaagcggcttcggtatccggatcaagggagatgtcccagccggcgtgcgcgatccagcccaagtgcagttccagcacctggccaaggttcattcgagaaggcacgcccagcgggttcagcatgatgtcgaccggagtaccgtcggcaaggaacggcatatcctcttccggcagaatgcgggagataacacccttgttgccgtggcggccagacagcttgtcgccctgggtgatcttacgatgctgcgcgatgtagacgcggatcatctggttcacgccgttcggcagctcgtcgccgtcttcctcggcatcctcgcgagtgatctccttgacggcgatcaccgtaccggtttcgccgtgaggcacgcgcagcgaggtgtcacgcacctcgcggctcttctcgccgaagatggcgcggagcagacgctcttccggagtcagctcggtctcgcccttcggggtgaccttgcccaccagaatgtcgccggcttcgacctcggcaccgatgcgaatgatgccacgctcgtcgaggttggccaccgcgtcctcgccgacgttcggcagatcgcgggtgatctcttcggcacccagcttggtttcgcgggcgtcgatctcatattcctcgatgtggatggagctcagggtgtcgtcctgcacgagacgctgggagatgatcacagcatcctcgtagttgtagccgttccacggcatgaaggcgatgagcaggttcttgcccagtgccatttcgcccttctgggtggccggaccatcggcaagcacggtaccggcttccacacgttcgccgtcgtggatcagcggaacctggttgtagcaggtggtctggttggaacgcaggaacttggccagcttgtaggagctggtggtgccgtcgtcgttcatcacacggatgatgtcggcggaaacatacgtcaccacacccggcttctcagccagaatgacatcgccggaatcgacggccgcacgccattcggcaccggtgcccaccagcgggcgctcggattcgatcagcggcactgcctgacgctgcatgttggtacccatcagcgctcggtggccctcatcgtgctccaggaacggaatcagggaggcgccgacggaaaccatctgacgcggggaaacgtccatgtagtcaacggagctgacgggcacatcgactgcttcttcttcgccgactcgggcaagagcctgcttcttgacgaagttgccgttctcgtcgagttcctggttggcctgtgcgatcacgtgctcggcatcgcggtctgcggtcatgtattcgacctcgtcggtcacatggccgttgatgaccttacggtacggggtctcgatgaagccgaacggattgatgcggccgaaggttgccagagaaccgataagaccgatgttcggaccttcaggagattcgatcgggcacatacggccgaagtgggacgggtgcacgtctcgcacttccatggatgcgcggtcacgagacagaccgccagggcccagagcggacagacgacgcttgttggtgacgcctgccaacgggttgttctgatccatgaactgcgacagctgggaagttccgaagaactccttgatggtggcgttcaccggacgaatgttgatcagggactgcggggtgatggcctccggatcctgggtggtcatacgttcgcggaccacacgctccatacggctcagaccggtacgcagctggttctggatcagttcgccgacctggcggatacgacggttgccgaaatgatcgatatcgtcgacgtccacgcgcagatccacatcctggccgtcacgcttgcccgggaacttggtgtcgccggcatgcagggtgaccaggtacttgatggtggagatgatgtcttcgcgagacaggctgcgatcgttgacatccttttccagaccaagcttgcggttgatcttgtaacggccaacgcgggccagatcgtaacgcttggtgttgaagtagaaggaatccagcaggttgcggccagcttccggcgtcggggtgtcggccgggcggatcttgcggtacagatcggtcagagcctcgtcctgggtctgcacggtctccttggcaagcgcgtccataaccagcgggtaatccctgaacgcatcggcgatctcatccttggtcatgccgatggccatgaggaacacgatggcggactgcttgcgcttgcgatccacgcgcacgccaagcacgtcacgcttgtcgatctcgaactcaagccatgcgccacggctcgggatgatcttcgcgccgaagacttccttgtcggaagtgcgatcctggctgcggtcgaagtacacgcccggagaacgcaccagctgagacacgatcactcgctcggtaccaccgatgatgaaggtgccgtgcggggtctgcagcgggaaatcgcccatgaacacggtctgggacttgatttcgccggtgtcgccgttttcgaattcagcgttcacatacagcggcgcggagtaggtgtaatccttctccttgcactcctgcacggtgtggcgcggttcttcgaaatacggatcggagaaggtcaggctcatggtctgagcgaagttctcgatcggggagatctcctggaagacctcatcaagaccggaggtgtggggcacggtgttggtgccgttcgccagatcctcctcgacacgcttctgccagcgctcgttgccgatgagccagtcgaagctgtcagtctgtacacccaacaggtagggtacatcaatgggctcgcggatggagccgaagttcacacggtccgacgccttgtgcagatcaatatcgtgctggtcggcgcgtgcgatgatggtggtggtgttcgtcgtagcctcagccaatggacgttccttatcgctcgctaaatcgtttcgatatgtttccccggaagcgctcccattggccaccatatgcctagtacgcgggcgcttcttccttgtcagcgtgcccgctatatgacacgcatgtacgcaaagtcatgagaataacatatcctatagatttttattcaatagtgacgccgaccggatcggacttcgctttgggatgcccttcaatcgaaagctgcgccgaatacacgccacgatccaccttcggcagggtggattgatcctccacgcattcgctgccagtacgcgttcccggccaggtgatcgtctgtctgacctcgtcgcccttcgccaacagacgatagtcggtgtcaacggggcacacattcgacttccaaaccacatcatcgcccgatttgatcgtcaacaccacgctggaagccgacacatcaaccaagcaaccaaccttgctggaaccgtcatatttgacgtccgtagtgaaatccatcgaatcgcccacaccgaaacttgacgccgcaggagtcaacgaaagcgcgacattggacgcatcgcaatccggcaccccgcttttcttctccttagtcggggacggcacttccttacgggaaatcgcatacacgtccgcatgatgaatctcacgattcaccgcgacaatccccctcgacagggagtacaggcaaaacaccagaaaagaaatcagcactatcgcagcgatgccgacgacgatgcgacggcgacgaaatatcgcctgctgttttttcgaacgtttcttgccggatttcgaggacgtcttctgtgccatgatttcacagtctagcgtgcgcacatccaaagaacgtcggcattcttcctttcataccggaagacgcacatccgcattcggcaggatttcgataagaccatcctcatccaacgatgcgatgcaccgatcaagctggatatggtcatcccacagtcgttcaagcgacttgcgattaagggcggtcgcaccttccggcagattgcgcagcgcattcagcaccagcccacgcacctgacgatccgtaccttggaaacgttgacgcggccgcgtgcgacgttcccccaatcccggacgaccattatgcaaaaacacgcaatgtcccgaaacagggcacgcctcgcacaacggagcctttgccgtgcagacggtcgcgcccaattccataacggactgattccacaccactgaaggacggtcgaaccgtctgcattttgaggcatcatcctgcggcaacatctgcttcgccaacgcacgttccgcaggtcttgcggcgccgccaagcgactcctcgccaagaaaaaccctcgaaagcaccctgcgaatattcgtatccaccaccgcgatgcgctcaccaaacgcgaaactcatcaccgcgctggccgtataatcgccgatacccggcaatgccagcaactcatcgtacgtacgcggcagcttgttatcgtaatcggaagcgaccacgcgggcgcattcctgcaatcgcaaggcgcgtctcggatagccgagcctgccccaagccgtgatcacatccgctttcgcggcatcggcaagcgcgaccgcatcaggccagcgttccatccaatcgttccaatacggtaccacacggctcatctgcgtctgctggctcatcacttcggagacaagcacgccccacgtagtagtgcggccgaaacgccatggcaggtcacgcgccgaagcatgccaccattcggcaagcgcgtccgccacagcttcagcattttcaatttcggtattaggctcgttcgtgtcgttcatcgtacctattcttgcattcatgacgaacgaagagcataccaatgacgcgcaaggcgcaaccgcagaggaagccaaagtcgagaaaatgttcgaatacggctaccgcaagtcgaattatgggccggacgaactcgtgaccgacgcgcacggcaatccgatttccgtggtcgacgcgatgctgtcagccgaagacgcggccaaagccgaaacctccacgccccacttgtgctactactccccccgcattccgggcaataccggttcggcaatccgcctgtgcgcggtgaccggcacgatcctgcatttggtggagccgctcggattcaatctgcgcgatacgaaactgcgccgtgccggactggactaccacgacatggcccacgtggtattgcacccgaattttgagaatctggtggaatccatgccgaattcgcgcatcatcgcgttcaccgcgcacgccaccaaactgtataccgacatcgaatacaagccgactgacattctgctgttcggcccggagccgggcaatattcccgatccgatggatattatggccggtccgcacgtggccgaacaggtgcgattgccaatgcgcccgagcctgcgttccctgaacctcaccaattgcgcatccatcgccatctacgaagcctggcgccaactaggcttcgccggcggccagtgatccctcccccgcctgccaactttcgtttcaattcattaccttatggatattggggacgcagtagggcgggatattccattcgtgacacactcaaggccgttcggccaagcctacggtcccgaacggaatatcccgccctactgcttgctatggcacacaaaccaacgtgttgcaaacaaaaagcaagcgtcaacctaatctgatgtgaagcgcaacataagcggggagccggcatgttctgtttcagaccgtaaagacttggcctgagcggcccggagcgtgtcgggaatagaatatgccggctccccgcgaccttccgcaaccaacgcaaccactgcgaaagatgcgtagggaagagaggggctagtttttgaagctgtggattggggcggggatgcgaccgcctcgggtcacgaaagcttcgcagctggtctggttgactggaatgatcggcgcatagcccatcaggccgccgaagttggccatctcccctacgcctttgccttcaaccggaatcacgcgcacagccgtggtcttctggttgaccatgccgatcgcggcctcatcggcaatgatgccggaaatggtggatgcggtggtgtctcccggaatggcgatcatgtcaagtccgacggagcacacgcaggtcatggcttcaagcttttcgatcttcaggcaaccattggttgccgcatcgatcatgttcttgtcttcggagacagggatgaacgcgccggacagtccgccgacgtaggaggacgccatgatgccgcccttcttcacctgatcgttgagcatggcgagcgccgcggtggtgcccggtgcaccaacctgttcgaggccgatcttctcaagcacttcgccgacggagtcgcctacggccggggtcggtgcgagggaaaggtcgatgatgccgaatggaatgccgaggcgacgggatgcctcctgtgccaccagctggccgacgcgcgtaatcttgaacgcagtgcgcttgatggtttcgcacaggaattcgaagtccttgcccttggcctcgtccaatgcacgggagaccacacccgggccggaaacgccgacgttgatgaccgcgtcgccttcggttacgccatggaagccacctgccatgaacgggttgtcgtcgggggcattgcagaatgccacgaatttcacgcatccgtaagaatcgttatctgcggtggcatgtgcgatgtctttgatgatgtggccgagcagttcgacggagttcatgtcgatgccggtcttagtggatcccacgttgacggacgagcagacaatgtcggtttcgctcagcgccttcggcagggagcggatgagcagctcttcggcgggggtcatggacttggatacgagagcggagtagccgccgatcagatcgacgccgaccttcttcgccgccttgtcaagcgcatgcgcgattttcacgaaatcatccgacgttttgcacgagcttgcgccgaccaaggaaattggggtgacagtgatgcgcttgttgacgatcggaatgccgtagtcgcgttcgatggctttgccggtggatacgagatccttggcgtacgtggtgattttgttgtagatgttgtcgcagacttcgtcgacgctgtcggccgcgcagtccagcaggctgatgcccatggtgatggtgcgtacgtcgagcttctcctgctcgatcatcttgttggtctcgtggacctccatgatattcagcatgatgtgttccttcgctccttaccgatgaaccctgatggatcagacgcggtgcatcttggtgaagatctcttcacgctggcagcggatgcgcacgccgatctcttcgccgagcttgtcgagatcgtccacgacctcgccgaattccttgtcggtgttggaatagtccacaatcatcatcatgttgaagaaaccgtcgatgatggtctgggaaatgtcaagcacgttgacctgatgctcggaaaggtatgtgcagacgcgtgcgatgatgccgacagtatcctgaccgacgacggtgatgattgccttgttcatggaactccctaaacgttaggtgcgaatatccagttaccgtctcggcaaaatgccggacgtgccttaagtatagaaaaggcagatgtcaaaaaagtcgttttttcggcaatcgcattacattgtgagacgatttcttccgtcaaaccggtttcaaaagttgcggaaagtcgttttttggaatatctgttttcgacgtgaaatcggatttcataaaagaaaagcgcctgccgatcgtttggaaatacgatttcggcaagcgctttttacaatatgtcatgcgattcacttttcgctgatcttgtcttctttcaggaagaaggagaagaccagcacgatgacgatcagcaccaagccgaacacatagccgtagcgggatcccgcaacgaagccttccgcatcggtggcgccggagcccatcgacagcaggcaggtggcgatggacgtgccaatcgcgccgaacacctgctgcatggtgttaagaatggtggagccgcagcttcggcatctcatcaagctagccgtatctggtctacggcatcgtgcctgctggccatcgtcgtgagatagctgtgcacccatctggcccacaagtgaatcatgaaaaacgcgcgttggcgcacgtccttttcatggacgtgcgccaacgcgcgtttttgcatcagcgtctgcgatcaggcctcgcggctcgcggaagccgcagcgaacgccggcaaggcgcgaggtgcgttgaaaccttccttttcgaagcggtcagcaatcttctgtgcgatctcgtgcccctggcccttatccaccagggcgatgatggagccaccaaagccgccgccggtcatacgcgcaccatacgcaccgttggcacgggccacgtccacggcaatatccaactcgggcacagtcacttcataatccgcagcgagcgaatcatgagacgcgttgaacagtcggccggcctcgtcgatcttgccgttggcgaaggcacgcacgaaggagttgacacgggcgatttcggtgatgacgtggcgcacgcgcttcttcatcgtgtcgtcttccagcttgtcgagcgtttccttgagcgcctggaacggatcgtcggacttggcgatgctgtcggcgaccacacgcaggttggccacgccgaggatttcggcggccttctcgcaagtggcgcgacgctgggcatactgtccgtcgttgagctggtgcggagcctgagtgtcaagcaccagcagttccagaccgtacttgtcgagatcgaattcctgctgggagacgttctccagcgggctcagctctggacggcaatcaagacgcaacgcatggccgaaagtgcagcgcatggatgcgttctgatcgagcccaccggtggacgcgcccgccatgtcgttttccgacttgatggcggcgttgatcagcgtcacacgaccggcatcggatgcgccataacccaaaccgtacacgtcatccaacgccaaggcggtggagcaggtcatggctgcggaggagctcagaccggatccgagcggcacgcaggaggagaatgccgcatcgaagccctgcaccgcatcgaagccggcttcgcgcaatgcccaggcaacgcctaccgggtaggcggcccagccttccacgccaccggcctgcaggccgtcgaggtcggcttcggtgacgttttcggagtcaacgtcggaaaccacgcgcaccttggtgtcttcacgcggcttgagcgcgatgaacgtgcggtgcggcagtgcgatcggcaggcacaggcccgcgttgtagtcggtgtgttcgccgatcaggttcacacggcccggtgcggcccatacgccagccggctcctcaccgtaggtggcacggaacagatcggtcgcgttcttcacaccctcgtcgtgcgagagcggctcaatgaattcaacagcagtcattggtgttttgtcctttgggttttattggctttcagccttcgatatcgattggtccgagctcgtggaagcgcttggcgatgagttccggcgtggtgtcggaaacccatgcggccatgccggattcggatccggccagatacttgatcttgttggctgcgcggcggaacgagaagaactgcaggttcaggcggtagttttcacggcgtgcgtcgtggatcggagcctgatgccatgctgcgatgtacggcaggtccatgcccttgccgtcacccttgtcgaagaacgcgttgccgcgcttgagcagggtggagtacatgacggccaaatcccaacgttcctggtcgttgagctcgtcgagggtgagcacgtcgcgcaccggggccacatgcacctcgaggggccagcgggctgcggctggcacgtaggccacccagctgtggttgcgcatgacgacacgctccccggcctcgatttcggagttcatgagatccttgagcaggttgccgccggtcttctcatggtaggcttcggtctgcttgagttcggcttccatcttcggcgcgatgaacgggtagcagtagacctgtccgtgagggtgcgccagggagacgccgatttcctgtccgtggttttcgaacgggaagatctgttcgaggccttccatcttggagatttcggcggtacggaacgcccacgcttccacgacggtgcgcagacgggagaccggcaggtctgccggcagaccgtcttcatccgggtcgaagcagatcacttcgcagcggcctgcagcaagcttcttctcccacagcgggttgccgttgacgtattccacggcttcggaacggcccggcacgcgaaccatcgacgggaagcggttttcgaacacgaccacgttgtagtcggtgtccggcacttcgccgtcttggtacgggtcgcccggcttgcgtgcggccagcgggttgcctttggcggtggcgccagggcccgcggtgatcggacggttcatgcgtgcggtcgccataggaatccagtcgccggtcagtggatcgcgacgcatttccggagcagcgtacggcacttcctcaccggccgcgttgagctgattggagaaacggtatgccagctgacgaggatcgttcagttcgcgcgtcttcgcgccggaaacgtattccggatcatcgtcgaggtagaagaaagcgcggccatcggcgagcgtggtcggcgtgatgcgaatgtgctccttcgcgtactctccgggagtgtagtttgcgaattcactcattatggttattcaccttcctgaataggctcgctctggtgtgccagcacgagctctttaaccaaatcccttgttttcccaaccgaatcggggtctagtccatcatcggtaatgaccgtgtccacctggtcgaagcgtgcgaaaagcgacaatgatgtgcagctccacttggtgtgatcggtcaaaattatggtgcgatcggcaatgtccatcattgccatatcggttgcggcctcaagcgagttcggcatgaggaagccgcgcggaatggacacggaatgcgtgcccaggaagactgtgttgacgcgcagggaggccaccactttgtctgcgatcgggcctacgagcgagttggatcgggtggtcacgccgccggtcacgatgacttccacgtctttcgattccagcgcctgcaccagttccgccaccggaatggagttggtgaggatggtgatccccgacgactgctgtgattccaacagatgttgcgcgaatacgtatgcggtggtgccgccgccgatggcgatcacgtcgccgggtgccacatatttgatggcttcctgtgcgatggcgtccttcaatccgatgtccatctgcgactttacggagaacagcggctcactcagcagcgtgctggtggtgacggcgccgccgtgcacacgcttcagcagacccttgtcggccagatcggcgatatcgcgtcggatggtcatggcggaaacgcccaattccttggacaatgcggtgatacgcaccgcaccgcgggtacgcaacctgctcaaaatcaaatgctgacgttgtgacgatatcattcgaacattatcgcacatgttcactcaaaataaaaactgagatgagcgtttcgcgcgttttcctcacgaaaaaatatacttggcactcctgtaatcgttcaaatcgaacaaaaacgaacgtcgacatcccgtcagcgaaatcaatcgacgtgttgctttcctgcgacaaacggtgcgagaatagtgaaccatgacgtatgtttctgagaatttctggcacgatgcggtgaacaaagccaccacagatctcttcaccttcggctacaagcacatcatcaagccgcatttcgtgttcaatcagacgcccgatgtggcgcacgaccagatgattcagttctgcaagatcaccaagaacattccgccgctgatgtgggcgtgccgtgaaatgctcaactattccgaccccgtgctggaaaccagcgtgatgggcgtcgacttcgtcaatccgttcggcctttccgccggcctcgacaagaactgcgagatgccggtgctgctcgacaacgccggcttcggcttcgaaacggtcggatccaccacgtctcgtccgtgccccggcaatccgaagccgtggttccaccgtctgcccgaatatgattcgatgatggtgcatgtcggtcttgccaatgagggttcggaaatcgttgttccgcgcgcggaacaggcttggacgaaggcgcgcgacatgcagatttccgtgtcgatcgcgcgtacgaatgatgataagaccggcgatttggacgaaggcatcgaggattactgcatttcgatgcgccgcacggccggtcgcaccgccatggtcgaagtgaacatctcctgcccgaacacgatggccggcgaaccgttcaatcagagccctgaagcgctcgacaagctgttcaccgaactcgacaagatcgaacgtccacagcccacgctggtgaagatgccgttgaataagtcctgggaagagttcaaggatctgcttgacgtgcttgccgaacacaatgtgcagggcttgtcgattgcgaatctgcagaaggaccgcgccggcatggagattcctcgcgattgggagggcggactgtcaggttcgccatgctatgaggccagcaacgaacgcatcaagcaggtgtaccgcgagtatggcgaccgttttgcgattgccggcatcggcggcgtgttcactccgcagcaggcgtatgcgaagattcgttccggctcgtcgttggtcatgttcatcagctcgctgatgtatcgcggaccgcagcagatcaccgtgttgaagcgcggccttgccgaactgctcaagcgcgacggattcgaccatgtgagccaggctgtcggcatcgacgcctgataccgattatttcaatcggcagcgagcaccaaataataatgcgccctgcgaccgccaacgcggtgcagggcgcattattgttgttcgattgttgttcgatattaccttggtttattggttgcgtttagtatgcgccacgcacatactgcggctggtagggcgcatcttcggtcggaataccgagcttgtgggcggcgcgaagaggccaattcggatcacgaagcgccgcacgtccgatttcgatggcgtcggcggcaccggatttcaaaatcttcttggcctgcttcggcttggtgatcaatccgacggccgtggttggaatttcggcacgcgagcgcacctgttcggcgaatggaacctgataatcgggtttgacgggaatggtcacgcccggaatcatgcctccggtggagacgtccatcagatcgacaccgtgcttcttcaggactttggcaaggttgacggtctgatcgagatcccagcctccggcggcccaatcggtcgcggaaacgcgcaccagcaccggcatggtgtcggggatgacggaacgcacggcgtccacgacttcgaccagtatgcggatacggttgtcgaacgatccgccgtattcatcctcgcgctcgttgatcagcggatcgaggaattgcgacagcagatagccgtgggccgcatgaatttccaccgcgtcgaagccgatatcataagcacgccaagcggcgtcgcggaactggtcgacgatggcatggatttcgtcaacggtgagttcgcgaggcttgtccaacggcccgaacgcgttggcgcttggccccacggtctgccatccgccctgctcttccggcacgctctcatgctcgtatccgatggagaagcagccggtggaagccttgcgtccggcatggttgagctgcaccgccatcgtcgcgccggcggccttcgcatcggcaacgatccaacgccatgcgtccatctgctcgtcggcccacaatcccaagtcgcacggcgaaatacgaccctccggcgtcactgcggtggcttccacgataaccatgccgaaaccgcccatggcacgtgacacataatgctggtagtggaatggcgtgggcaggccatcctgggccaacgcggaatacgtatccattggcggcagccagatgcggttgcgcacggtcatgccacgcaaagtcataggatcgaacaggccaaccgtgccattggttgtagccttcttcgaccgcttcgccttcttttcgtcttcgctcatcgtagtagctcccctccggtcgcacctactggctccttgccgatcggctgaaccttcttcttgtattccccttgagcttctctggagatttcgtgccataaaaccggcactatttgcattctacgcagaacgcccgccgagcgtggcgggcgttcattgattgttcacttccattcgctgaattgcggaagcgtcactcatcttcggtctgctgctgatcctgatcatcctgctggtcgttctgctggctttgctgctgaagcgactggttctgctgctgaatgattgtgctttgctgctgggtggcattctgctttccaccgccgatcttggtgaccgtgctggatgttgcggaatacttggccgcaggctgcccataatcgttgtcaatcggcagctgtttgcgttccgcataagcattcataaagtcacgccatgccggggccgcgatggtggaaccatcccagtagctgtggtactggccgttgatagcgatattcgcaatcgggtggccaaccgggttctgcacgtcaccgacgagcacgaatgtggcgatctggttcggaatgaaaccacctgtcgtaactagctgatcctcgtgggtaccggtcttggcgaaggtcttacgtccattggctagctgtgccacaccgcctgcgccgtcaggacggacaacgccttgattcatggcccaagcaagcgtttggatgatttccggatcgaccgcctgatggcagttcgcggaaggcaccttaatatcattgccgtccacatcagtcacctgcttcagcgcgatcggatcgcactgcacgccattggacgcatatacagcgaagatgcttgccatcgtcagcggggacacgttgacgttgccgaccatcatggcaggcacgaatgatgaggtcttgtcgagcgtctcaccggtattcgcatcatgatagccaagttcagttgcggtatcggcaatcttgcacaagccgatgatggatcccatggaagcctgcgtggtgttatgagaccttgccaaagccaatgccggcgtttccgggttcaccgttccattggttattgcgttggtgacgttccacgtatcagtgccgccggtataacgatcgcatgcgaacaacgaggtcgaatacctcgtggacgtctgcaggttctcgttgacggaatgtcccgcttccatccatgccaccagattgacaggcttccacgacgagccgatggagaagcccatgccgccgccgtcttctcgatccacggcatagttcatggaatccctggtctggtcgttctgcgccgcttcggtggcatcatacgttcgattcagaccgaagcccagcacttctccggtacccggtttgacggacgccatcacgatttccatgccggaggaatcttccggtgggatggtgttgcgcgcggtttcgttcaacaaggtgttggcatcgatatccaacgtggtgacgatcttcagaccaccctctttcagcagtctttccctgtcctcgctggtcttgccgaattccttggaattcaaaatcttatgcaccacgtaatcgcagaaatagcccgcatcatagtccgcggccatgcaaccggtggaaataggctggacatcaagcgtatctgcgagcggagtattgaccgcctcttgatattccgcatccgaaatatagccctgctcgttcatcagctgcagcacgatattgcgttgcttctcggattccggctggttcgattcgacggaaggatcgtaagcgttcggattcttggtgattgccgcgatggtggcggactgcacgatgttcagctgatctgcggtggtgttgaaataccgcttcgcagccgcctgcacgccatagaggctattgccgccaaactgtgcgatattgagatatccctgcaaaatttcaggcttggaatactgcttttccatttgcacggaaatcagcatttccctcatttttcgtgcgatggtatcttccgacgcatggtattgtgcgatcggatcgtcatcctgctgcgcctgcaggatcagcacgtttttgacatactgctgggtaagggaggaaccgccctgatggtcgcccttcatatatgtttggacgaacgcgcggaacacaccctgcacatcaacgccgccgtgagtgaagaatcgtctgtcttcacgcgctaccacggcctgctgcatgtatttggaaatcttcttcaacggcacgacttcacgattctgatcccagaattcggtgattttcgtggtgccatcggaagcgtacatggtcgacttctgcggcaggctggtcacatcaaaatcaataccttcgaccgacagcgacggaataaccgccttggcgacgctgttcgcgccgaaaaccgccggtaggaggaacaaactggcggccacgccgccacccacactcagcgtgatgtaggcaatcacgagtgcgagcacacgttgaacggtcaaagtcttcttttcgggcatggtgcccattctaaagtggtgggtctactaatcaaccggccgatcgcagccatcacgggtttctcacaaacaaccgtaaaacttgaaaaacactggaaaacagtcgaaaattatcgtctcgatcgtcgaataagcatgccaggctggtagatgatgatggaacggccctcacgcgcaatccatccacggttggcgaaatccatcagcgccttgttcaccgtctcgcgcgacgaaccgaccagctgcgccatttcctcctgcgtcagatcgtgcggcaccttcaaccccgcctcgaccggctcgccgaagcgtgacgccagattcagcagcgttttcgccaaacgtcccggcacgtccatgaacacaagctccgaaatgcgctcgttgttgtcacgcatgcgatgcgcgagcacctgaagcatgtcgacggccacgcgcggatgctcgtcaagccatgcgaacagggcgtcatgctcaagccatacgactttcgtgtcactggtcatggccacggcggacgcggtgcgcggtccaccatgcggatcgaacaccggaatctcacccagcacttcgccgtacgcatgaatgctcaacaactgcacacgtctgtcggacgattgccggatcagtttgacgcgcccgcgttccagcagatacatgcggtgatcggtgtcgccttcgcggaaaatatagtcgcccttgctgtattcggcatgctgcagatgcggcagcagttcctccgcctcttcggaagaaacctgcttgaacaacgcggtgtgcagcaacgtcgcgctttcgccactgggtccactattggtctcgtttggcgtagccatttgtcacacctccgttcataggcacatcctctgggcacgccgccaggcgtgttgccgggcgcgctgccgcggcttcgaaagcttgttgcgattccacatgccctcacggaacaccaagctttcgtaacgttctcattgcccttgatatcaggggcggcttcgaccatcgggctacattgtaactcgcctggcggcgtcgagcagccgttcaaccacgtcttcacgactcatgcccgtctgcgagcgcattggatcgactcgttttaccgctgatttcaccgctttgtccgacattttctcacgtgaggtgttcaatacccgccccattttttccgcgtcgatatcgtaggcgagggtcacgtggtgcagtatggcgccaggccctccctctactggtgtgaatcggcgttgtgcggctccgccgagtttgccgtattgcgtggcgatgtcgttgagtccggcgaatcgtacgtcgagcccgagttccttaagcgcgcgcaccagccagaaatcgcagagccggtatgattcctcgatgcttatgccttgggtgaaatcgaacggcgcgtacaacgagtaggtgatggtattgcccggttcgatgaacatcgccccgccgccggtgcaacgtcggaccacggtgaatccttccttctgcgcgaccgccgtattgacttcgtcttcgagcgactggaatttgccgatgaccacggccggagcggcccattcccagatacgcagcgtgggttcgcgtttgcctgccgccacttcgcgcgcccatgcgatgtcggtttccatttgttcgttcgggtcgcgcggcttgtcgtggatgacggtcggtttcaggtcccgccagcgttccagatattcctcttgtgtcagcgcattatgcattcccggttgttccccggaatattgtttcgtggacctcgcgatatttccgttgcccgttgcatcttccgcattacgcgattcactgcctgtgattgcgcggagaaaagcgatggcaatgccttctgccgtcatacccaccaatcgcacgttcggatagttcgcggtaatcgcttgcaatcgtcgcgtaatgtcgcgtgtgggcgcgcctcgctggctttgcagcaagttttcccaatcctgcaatagtcggcgggaatccttgtcatcgccgtcaagaaagaaatcgccgtcgatccgacattgttccacggattggatggaacttgcacattcgcggaaatatgctggaatgtcatcagaaagccggacggaaacccctacgagtttgccgcccggctgcttatacagccctctgcccatcaatcttgaagttcttggccgcgcccatcgcggtgccagttggacccgtagctggagcacaggatgaggactgcttcgatcagagcccagattccggaaatgatcggtccgatgaggatgatccatccgatcagggtcagcaacagctgggccacggccttgccggtgtatcccagatagaagttgtgcacgccgagggtgccgaggaacaggccgagcaggccggcgacgatcttcgacttctgcgcgtagccatagccgggctgctgttgggtcgcctgatagtaggtctgctgcgcgtaggttggtggctgattgtatgcggactgcgtgtattggggctgagtcggctcctgataatagggggtctgcgccgattgtgcgtaatccgtaggtccgtacgtcggctggccgtagatgggctgtgcaggttgcgcaggctgagtcggctgcccgtaagcgggagcggccgagccatatgcggggacggacgaaccgtaggcagccgactgaccatatggctgaccattgccgtacgtaccgccggggatgttgttgccctgcgtacccggggcatatccctgcacgggctgctgcgatgcgtacgggtcgggattgtgcggctgtgatgcaggctgattgtagccatcctgcgactgcctgtaatcggcttgagttgaatcgttcgtcgcgaaatactcgtcttggccggaaccgttgtaatcggcattgttgtcactcatggtttcaacaatatcccataatttgccttgttgctttcatccaccctgaaagcaatccctgaaatccccctgaatatgcgagacgcctgtcgaattcaagcatgaactcgatttcgacaggcgtctcaacaggcgaacatatccggcgcaatcatgcgttccggatcatatgtcacatgcgtgccagaatgtcgcgtccgacctcgtcggtggagcgggtagcggatcccagctcttcgatgtccgcttcgacggccgcatcgatcttggccgcggcgtcgtcgaaaccgaggtggcgcagcagcatggccgcggaaaggatcgcggcggtcggattggccttgttctggcctgcgatatccggtgcggaaccgtgaatcggctcgaacatggacgggtattcgttggaagcgttgatgcatccggaagcggagtatccgacaccgccgaccacggcacctgcctcgtcggtgatgatgtcgccgaacaggttgtcagtgaggatcacgtcgaagcgggacggattcgacaccatgaaaatggtggtcgcgtcgatatgcagatagtcgtgggaaacttccggatattcctcggcgaccttatcgacgatgcgctgccacatgtctccggcgttgacgagcacgttcttcttgtgcacgagggtcacatgcttcctgcgcttcatggccagctggaaggcgtaacgcaccacacgttccacgccgtaggcggtgttgatggaaacttcggtggccacctcgttcggggtgccgcggcgaaccgctccgccggcgccgcagtacaggccttcggtgccttcacgcaccacgacgaagtcgatatcacccgggttggcgagcggggaggtcacgcccttgtacagcttggacggacgcaggttgacgtactggtcgagatcgaaacggagcttgagcagcaggccacgttcgagaatgccggccttgatacgcggatcgccgactgcgcccaacaggatcgcgtcggtcttcttgatgcgttcctcttcctcttccggaagaatcgcaccgtcacgcaggtaacgttcggcgccaagatcgaaattctcgtaatcgaattcggcaacgccctcggccgccttctccagagccttctgagcccacggagtcacttccttgccaatgccatcgcccggaatgacggcgatggtgtacttctttgcagaatcactcatagcacgcgactctagtcaacgaatcagcacgtggacttaaaacgctcaactaatggacactccatgccgctttcctgtacgaaacacacgaaaagcatgaatcatacgaatctcacaaatcgcacagcctaatcagctggtaatacccatcacgccaagacaccaagcattctcataggagatctcctcccactgcttgtaccttccagacgtacccccatgaccagcctcaacctcaatcttcgccacggcatccacgcctgcacgctgcagtcgggccaaccatttcatcggctccacatacagcacacgagtgtcattcatcgacgtggtaatgaaaatcttgggaaaaaccgcaacccgcgcatcatttgcatcagacggcgcattctcatacggcgtatattccttcatataccgatacacgtccgcattatgcagcggatcgccccactcatcccactccgtaaccgtcaacggcaacgacggatcaagaatcgacgtcaacgcatccacaaaaggcacatccgcctcaacgcccgcgaaacattcgggagccatattcgccacggcacccatcaacaggccaccggcggaaccgccatcggccaccgtgcgagcaggcgacgccaaaccggcacactgcaacgcacgcacggcatcaacgaaatcctcaaacgaatgcttcttattgagcaaatgcccctgctcataccaagcacgacccatctcaccgccgccgcgaatgtgcggcaccgcataaagcacaccacgatcaagcatgctgatgcgagacaccgagaatcccggatccgaactgatctcatacgcgccatacccggtaacgaacatcgccgaatcacacgcaggcacatccctgcgccacaccaaggaaacaggaatgcgctcgccatcgcgggcggtgacccacaccctgcgctccatgtattcgcgcggttcaaatccaccaagcaccgtggcacgcctcaacaggcgatcctcgccggtcgccggatcgatatcatgcagttcgccgggacgcgtgtaactggagaacgagtagcgcatgcggggcgcatcatacgaaggattgcctcccacaccaatcgaatacaagcgccgggtctcccccggcatcgcatcggcggtcgcaccatccgatgaggtcatcgccttgcgggaaaccccatgcacggccgacccctcgccttgcgcggcggccaattggtcgagcgcgccccacacttcggcacgttcctcgttgatctcgtccaccgactcgtcgacatcccaatcgtcttccaacgcgtggggaaccagctcggtgaacttccatggacgccccgcaagaaaatcctccgcagcggcatccttcgtcatcaccgcaatatgcgtcaggctttccgcccggtactgcagcgccacataatgccggtgaatcgagatcccctcaatgccaagaccatgcgcgccctgcaaaatggctggattgcagggattggaatacggtgtgccgatcggcatctcagaagcgcccggttcgacctcgtcgccgtgctcgcatccgtacggcgaaccgacggccacacgcacgccctcacccaaacggtacgggggctcatgggagcgcatgtcgatcacatcgatttcgaaattcgggttcaacgcattgtgatagaccacggcgagcggaatatcctcaccgcgttcgccggcaccttcgaaacggctgaaactcacgtcgtattccacgtcctgctcgcgcggaatgaacgcgcggaattcgccttccggatcgtcggtggaaagcagcagcacttcggtggtagtcttcgacccggtgccgatcaccagattgcgttcgtcgaacgacaggccgatgccaacccagaatcgttcgtcctgttcgcggtacacctccacatcgtcgacgatgggagtgccgacgcggtgcctcatcaccgcgtatggacgccacgcgtcgtcgagcttcacatagaacacccattgcgcgtccggtgtgaagcaggcgccaccgatgcccttgaacacttccggcagttccttgccggtttccaagctgcggatgcggaaatcgtaacgttcgtcgccgctggtgtcggtgccgtacagcatccaacgtccgtctttggaaatatccatgccgccgatacggaagaaatcatggccttgcgcttcggcattggtgtcgaacaccacttgttcgccgtcgatgggcacgccgatttcaatggttggcggatcccaatcgtctgcgcctcgaataggcacacggcattgcaccgcatactgctggccctcctgggtgcgtacgaaataccagtagccatccatgcgtgtcggcacggacatgtcgttttcctgaacgtgcgacttgagctcgtcgaacagtgtggagcgtagggttttcaacggttccatgcgctgctcgcaataccggttctgcgcggcgacgtaatcctgcacgtcatgcgattccttgtcgcgcagccattcgtactcgtcgatgaaggtgtcgccgtggaatacgcgctccttcggcacacgcttcgcgatcggcatcccgcatttgtcttgcacgctttcgtcgctttctcgcgcgcccgttgcgccctgttcaccccgaaaatcagtcatgcacgcgattataccggcattgcattcccaatcccacgcggcacgcaccccctgctccgggcgtacgaaaaagtcagacgcccatctgttgtttcaggaacggcagcatggttttcatcagattcgaaccggtcgttcccgtgaataccgggacatcggtgaccgggatcggctgcgtgaccgcacgccccgcaacggtgccgagattgccggcgacttcgcgtggagacaactgccggatgccgatcgccagcacacgccctgggtatcggcgtgcgatcgtggcgtacgtggtcggatccctctgcccgtcatcgccgatcagaatgaacttcatatcaggaaaatcagccatcaattgttcggcatactcgagtttgtgctgcactccggaaggaatgaacgttttcgggcgaggatcgaggtcgcgcaatagcagcggaccttccggaaaaccatggttggcgatgaaatgccggatcgagctttccacattccatggcgatgtcgacaggtagaagaacggcgcgtccgggaacatgtccgcaatgcggttgaacagcaggttcatgcccgcaaccggcattttcttctttggatcgagcagcagcagattgtaggcggctttcatcaggcttggcgcctgcgtgaccatgatggtgtcgtccacgtcggagatcacgccgactttcgtaccgctggggatggtgaacaggttggctgtgaccggtttgcggctgcgtaccttgtatgacacgtcgtgcacgcccggttcgagcgaatgttcggccacgagatcgagatatcctgcggaatcggaggctgcgaattcactggagacattgcgctgcgcgtccacttcgtcgtgcacttcggacgcgcccacctgcacggtttcgaggggcacgccgtcgatggcgatgcgcaccttcgtatgcggcgaggggatggtgagcatggcacggatgccacgggtcagacggcccgcctgacgtttgaagggcccgtacacggttcggcagatcagtcgagagtaatgttcggtgccgtagccgacatatggttccacgcgcggataccagttgagattgagcaccatgcttgttgagaacgtcacccacttgttgaacgctctggtaatggtgcggcggaacagtcgtgtcagcggaggcttgacttcgatgcgttcgtgtttcgaagccgcgtcgaaggtggtgaccaccttgcgtgcgggaatgggcacggtcggcatgtcatcttcggatatggaatccggttcacgctggggcaacggctgcggttcggtcataaccccactataaaggcgattattgaattacctggtaccccagcgtgaaaatcagggatttttcagggaataccgatgatttcccatccaatttcccgaatcgtgccgttcactgagccacgatgttggcgtattcctcggaggaaagcagtcccggctcgtcatcctcaagttcgattttgaaaatccagccttcgccatacgggtcacccgttacgatgcttggatcgtcggcggcctcgttgttcacatagcgaatcacgccggccaccggagtgaccagcggcgtgaccgccttggaggattccagttccgccacctcgtcgcccgcctgcacttcggtgccgacttccggcagatcgatgtacacgagttcgccaagctggtcggccgcatattcggtgatacccaccatggccggctcggtggaagcatccacccacacatgctcgtcggaatattcaagatgctcaggcacatccagattcggcttgttatcgttttcttcgctcatgaaagctcattctacgtcaatcgtatgtatttccctagagcagtgccgaaacttgttacgggaggtcgtggccgagccattcttcgatcatgtagcgggcgatggtggcctttccgggagcttccatacgccctgccaccaactcgttcatgtattcgtcgcgggtcacccaacgcgcctgcagggtctcgtcgccgtccacgcgcacgtcggtggtgttggccacgcctttgaacgccatcatgagcgatgcggggaacggccatggctgcgatcccaagtatttgagttcgccgatgtctatgccgacttcctctttggcttcgcgccggcaggcatgctccaggttttctccggcttccacgaagccggccgatacggagtacagtccggtgttgcgccatgcgctgttgtgttgcagcagcagacggtcctcatggtccacgatcgccgtgatgacggccggttccactctggggaacagcagtcgcttgccgtccgcttcgctggtgcagcgttgcgcccatcctcccaacgccggttcggtcggagcgccgcatgtggggcaatgacgttggcgcgcatgccatacgcccagcgagatcgccgtcgtggcctggcctgcctcgcgcgcgctggcatgcggtgcgaatccgcgcagatcgacccagtcgaatcgttccgcagcgctttccagcaacgatttcgacgttttcgcttccggttcgtgctgttcgccgaacgcatcgtccgcgcccatatgctcgctgcttgcggccaccgtctccgcggctttcacgcgagacacgtcaacggcgaccacgtgttcgtcgcgtttgccgccatacgatccaaggaatatggcgagcgccgtcggatgcgtgtgcagttccgccgccacgtaggcgccgggcaattgcgcgagacgcatatgcacgttggcgtagtccgcgatggctccctgtccgcgcggcaccgccaccatgccgtctttgacgagaacgaccttcgtggccggctccagcagcgccgtgtcgaacaggtcgggttcgccgcgtctcgaaacctcatagtcgatgtcaccttgcgcaagtggcaggaacggcagtgcctgagtcagcgccaatggtgagaacacgctcatcgcttgcttctttccttgaatacgattgatagagcggatattttttctctattccgtattttcttttctatttttttatatcttttttgtatttctgattgcgatattgacggcagcggcggaaaataccggctactgcaccctgcgcaccagcgcgagcagcgcgtcggcaaccgcctgcggatgctcgtatgcgctgaaatgcccgcaatcgaatatcaccgtcatatccgcgctcgtgcctgtcatcgcatcggcgatcggcgtcatcacgctcggagggctcgacggatccttgtcgccgcagatcaccgcaaccggtgctgtaatcgcaggcaacacatcgttcagatccgggcgcccagccgccatgcgctcacgccatgcgatgccttcggcaggctgttcgttgatccacgtcgtgaactgttcacggtaggcggccgactgtttgatggtggaatcctcaggtgtggatgccgcaaatcccatcaccggctcatgcgtgcccgtcgattcacatgcttcggcgatcgcgatgcgcttcgcgcgcatctgcgcggaatccgccgcggccttcgtgtcgcacaatgccaacgcggcaacagcttcggggtgcagacgctgaatgtcgagaaccagatagccgcccatcgaaaggcccgcccaaatcgccttgtcgtaaccggccgcatgcaacatcgcgacataggcgtcggccatatggtccaaaccgttcgggaaagcgccgtccgcgtctttgccgccactgatctcatcggaaggaatcggcccttctcccgcaccgggcatgtcgggaccccagatcgggaaccgtttcacaccatgttccacagcggccgcctccaacgcctccgcacattcgtcccacatgcggtggtccacggggaacccgtgcaccagcaccacgggaagcccctcgccctcgcaatacacgttattatgtaattcgatcgtcatcgtctcactccgttcctctcccctatattgcctatgtatctatcgcttgcgctgcctgcattcgcaagctgccacgcgctttcctggcgcccacggccgaccggtttcgacgtcaaccataagcctgtcggctacctgccggcccaagcgatcgcctgacgcacaatcgtgccatatccgttgctcatctggtttatgaaagtgtcgaggatctcgctgttcgtgttgacccattccacgtcaagcgtctcatcctgcggcttgcagtcgcccgcgatcggcaccacgtagcacaatgcgatcgcatgctggcgggaatcgaaataatcggatagtcccggcgtcgggaaaaactcggccacggtgaacggctgcagactcaccggcagctgcggcaacgcgatatcgcccaaatccttggcgacattacgcgccacggcctcacgcaacgattcgtgatagagcacgcgcccggcaatcagcgttcgctcgatactgccgtcgtcagacacgcgaagcaacgatccgacctgtgaaacacgccccagatcatcggtgcgcaccggcaccacaagcacgtatggaatcggcatttcgccgcgcatacggttgatttcgccggaagcaagccatcctggaggattacctattccgcgaatgaaatcctccggcgtaatgtcgtcgaattctccgcgacgacggcctgcatcgaaatcgccctcgtcgggcacttcatcattcatcactggcatagtcccattatcacgcatcttgtgtgaattggctggaaaagaatgcgccgaaagacgattcttctgacagcggatattgcatatgccgggaatgcggcgggttgggacgcggttatatactccaaagcaatcgcatacgaggggcgtagcccgtcacgcgcgtcgatggaacgaacagcaaggagcaatcatggcaacgcatgcggtcacttcgcaggatttcaatcaggtcgtcgaatccaacgatctggtattcgtggatttctgggcaacctggtgcggtccgtgccgtgcgttcggcccgacgttcgaaaaggcaagcgaagcgaatcctgacatttatttcgcgaaggtcgatatcgaccagaatccggatctcgcctccgccgccaaagtgcaggccgtgccgaccttgatggtgatcaagaaccagcagatcgtattccagcaggctggcgcgttgcgcgcgtcggatctggacgatctgatcgcccaggccaaggagctggacgtcaatgcggccgctgccgaagaggctacggaacaggcgcaataaggcgaatatcaaaggatcgcaaaggtgccgttcgatggcgaaacatcaacggcacctttttgctttgcacgcttgttttgcatgcccgctttgcctgcctgttacatatgcgctcgcccggattccatggcatggagtagaatgtcgcgttggatatgcgctttccggcgaagcctgaagtggcggcgcaccgcatgccgtgcatgtgtgaattcgtcgaggatctgaacgcgcgtttaggagcagaatggctaaccacagcaagcacgcccgatcgtctaccttcgccatgccgagcaagtcctcgctggtgaagatcgccgcaacggtcgcggcggtgggcctgttggctaccggcggcattgtgtcgcgcaatctttacacctccgcggagcagaacacggccaatcaggtcacggccttctccgtcaccgattccgccgaagcatcccgtggcaacgcccgtgagctgctcaatggagacacctcgtacgtcaccgtgaagatcaacggcaagtcgcgcgtggtgcccggtaccaatttcaccgacgtgaagtccgtgctcgacgcgggagacatcacgctcgaaccggaagacacggtctccccttcgctcaccaccaaggtggatgagaagaccgtaatcaccattcagcgtgccggcgcaagcgttgaggtttccgacaccgccatcggtttcaatgtcgtcaagaaggaaacctcaagcctgccggaaggccaggagaaggttgagacggaaggcgaagagggcgtgatggaaaccacgaacctcgtaaccaagtccggcgacaccgtggtctcctccaatatgatcagctcgtatgtgaagaaggctccggtcgacaaggtcattctcgtcggcaccggctccacttcgtcgtcgtcctccagcgcttccgcgtcgatcggcaccactgtgccggcgggcgaaatgcagcagtgggctcacgattatctgctgtcgaacggctacaccgaagccgatttcaccgccaccgtatacatcatcacccacgagtccggctggagcgtcaccgcaacgaatccgagttcgggcgcctatggtctgccccaggcgttgcctggcagcaagatggtgagcgcgggcgccgattgggccaccaattatcagactcagctcaagtggttctggggttattgcgcgcagcgttatggttccattcagggagcctacacgtactggctggccaatcactgctattaaatcgcgattgatcatcattgattgattcgatgatgatatagtttgagctccgtaatattcgaagatattacggagctcaaactatattacgatcttaaatatcactgggatatcgccgatttcacagggcattgttggaaccgatcaccgtggcttccttgacgtcatcgatcttcctgcgcctgcggccgccgtgaccggccttcggaccacgcttgccgacggtgccgctgcggaccccgttcttggcatcgaagatgatcacgcgctcatcgctgtgatattcgccgtccagagcgaagaaggcgatcttgtctgcaggcacttccgggaaggtgaagaacttctgcgtcgcaacgagcaggtcaaggttgcgggtggtgacggaagacggcgtatcggcgttcggagcattgaactgaagagcgaaatcgtcattctcatcgcatacctggattgcgaacttgccgcgctcgtaattcaccagcagcttgacgtattcaggacgtccgagaacttcggaaacacccttggaaaaacgaacggattcaagcatgaccgtcatggtcaacttgccaccagttctttcgccaacttctttgaaaccatcaagaacggacatgtaaatccttcctttattgtaaataactacgtgaaatactgtacctcattgttaagaataaaacgaatcgaatttcggggaatatattcatattttcaagaacacaacgtaatacgaaaaaacataccgcagaccatgcttgtctcaatgagaaattcgatacggttcagccagcgcgcttcctaagccaactcgatgggcacaccaccccttgtcaccccgacggttttccgctaaaaacagatgtggcaacccctacctcacccccgcactacgggttgcgcaaattgcaaatactttgcagcacagttttccaatttcatataggaagcgctgaaatatcgtgctttatgcacgcatatcatttgcaaaacggttcatataggggctatcttgcgcaactatcttttgcaatcattttcatttttacaatgattttctcagtaacgattttcattgaaaatccgccatttttcagcatcttttacactccaatcgggatagaatatacactacacggttgcagtactgcaaacgctatcaaagaagatgggacccccgtcgcaaagcagcggccacgataacggagccacaagccccgataccggcccaaacacaagaaaaagaaggatcaggaaggtcaatgaaacatcggaaaccaactcccgcctggcagaagctgggtctgcgcgtcagcaagaagctggcggtgggcgccacagcccttgccacagttttcggcggactggcagtcgccagcgtctccgcacaggcgagcaccgaccgtaacagttatgcggacaccgtaggcaacccgactttcgaagcagcacgcaaaaagtacggtctgaccaaggagatgaagaacggcgccattctgcacgcgtggatgtggtcgttcaacaccatcaccgaacatatggatgagatcgccgaagccggttacacctccattcagaccgagccgatgagcaaaatcaaggtgaacgacgccaacggcaagaaattcaccgaaaattggtattacgtgtatcagccgacgaacacctccatcggcaacttcgtggtcggcagcgaagacgacctgaaagccatgaccgtggcagcccacgcgcatggcatccgcatcatcgtcgacgttgtggccaaccacttcaccgccgactggaacgccatcgactccgactggcagaagagcgaatatttccatgcgcgcaactcctgcagcggctccggcggcgacaacatcgattattccaaccgttggcaggtgacgcactgccacctgctgggcctatgggatctgaacaccgccaatccggaagtcgccaatcgtatgcacgacttcctgaaaaccgcggtgaacgacggtgttgacggcttccgtttcgacgccggcaagcacgtcgaactgccgaacgaattcgacggttcgcagtattggaccaccattctgcagaacggctcgcaataccagtacggcgaagtgctgcagggcgattccggactggattacaaggcgtacgccaacctgtatgccaagtatggcgaaggcggcggcggagccacggcctccgactatggcaagaccatccgttctgcactgtggagcaagaatctcaatgcgggcaatcttatgagcttgcgcaacgggggcgtcaacgacgatcagctggtcacctgggtggagtcccacgacaactatgccaatagcgacaaggaatccacgtatctgaccaacgatcagatacgcttcggctgggccgtggtcggcgcacgcgcaggcggagcgccactgttcttcaaccgtccgaaggcctccggcggcaatcagccccagttcgcagaagcctctcagctgggcgacgccggcgatgacatgtggaaagacacggctgttgcggccgtcaaccatttccgcaatgccatggacggcgaggccgaatacctgcgcaactgcggttccgaacagaacaacaactcctgcctcatggtggaacgttacaagaccgacaacaatgccggcaatgacggcgtgagcatcgccaacatgggcggcgaccagaatctggccggcactccgaccaagcttgacgacggcacgtacaccgatcaggtgaacggcggcaccatcaccgtttccaacggcaagatcacttccggcaccgccaagggcgatgcggtgagcgtgtacttcaacacgagcgtgaaggaatccgtttccgcgaccgtcagcaagaagttctcctccaacaccatcaaggtgacgctgaacgccagcaatgccaccaatctcacttactcactgagcaatggcaagaacggctccttcgttgacggcgactcgctcaccatcggcggcgatatggagatcggcgattccgtcaccctgaccgtcaagggcaccggcgccgaaagcggcgaagcgctcgagttcaccgcaacctacaccaaggttgaggttcaggcgaacacgatttacgcgacgaagccttccggctggagcaagatgtacgcgtacgtgtacacgggcgacggagcgaccgcgaagaacaacgcggcctggccgggcgtggagatgaccgcgatggcggccgccgattcgtgcgccaaggccggcacatacaagtatgaggttccggatttgggcgagggcacctatcgcgtgatcttctccaacggcaacggctcgcagatgccgggggccagccagcctggttttgaattctcgggcaaggtgagctgggatggttcgtccgcctcgctgacagccatcacctgcacggcaacgcctccggttatcaagaccgcggacatcaccttcagcgccacggccgacctcaagaccggcgagaccctgtacgcggtcggcgactggggccagggcaagggcaagacctggacccgcgccggcggcgtcaagctcgccaagaacggcaacgcgtacaccggcaccaccaccatgaccaagggccaggccatcaccgcccgactgatcaaggtcgacgcgaacggcaagaccacatgggacgagatcggcgacgtcaaggccaccgccgacaagaccaagaccgtggacctcaagtggaccaacgcggtcgagaacaccgtggacatcaccatcaacgcggccgccgacctcaagaccggcgagaccctgtacgcggtcggcgactggggccagggcaagggcaagacctggacccgcgccggcggcgtcaagctcgccaggtacggcaacgcgtacaccggcaccacgaaggtcggcaagggcaacgccatcacattccgtctgatcaaggtcgacgccaacggcaagaccacgtgggactcggccaaggaccgcaagtccaaggccgacaagaccaaggcgctcggcgtctcctggacctccggcaaggtgaacgaggacggcacgatcccggacgactccgccatcagcatctccggcaagggcgtcgcggacggcaaactgtccatccagaaaggcaacctcgccgagctctacgtgatcggcacccaggacgccaccccgtccgacgctgtctggtggagtgacggggccgccgtggcggtctccggcaccggcaccgtctacggcgtccagaccggcaccgccaaggtgaacgtgaaggtcggcaaccaaaccgccaccatcaccatcaccatcaagtaaacggcaaccgccgatatccataaaacatttgagccttggaattcaatatcactccaaggctcaaatcatattcaaacgcttctatacgcatgaaaatacacacatcaaaatcagcggatttagcataatcagctcaaagcgtcgtgcagatatcgctttgagcggctgcgcatgatatccagtgcaatatcggcattgcagaaatcgatggtttgtgaggtatcagtacaatcaacttcggaaaaatcagtgatgattctgtcggcgaattgcacttcctgcaggatttgaccgcgtctggtgccgagttcatgctctttggtaccttccgtatacacccagaacggtttatggaagttgatggagaacagcgtgccatgataggagtccgtaactacaccctccgcatatttcaccagcgagaggaattcttccggccctgcctcgagcacattgacaagctcatcgcatttcggcacattgcccgcctgcggcgtcagcactgcgacaggcaggccgactcgacgagacagttcacgcagttgcctgaatacgccgacagcacgcttgggacgcagcagcgaataaaacagcagatactgttcgggcacgtgttgcgacttacgcaacggtatgcgttcctcccattcgcccgcgttgagcaacagcgtcggatcgcatacgtgttccacatatttgccgcttacctgccgcagtttgccgcatgcggaacgttccctcgccgaaagcgcgctgaattccaccaacgccggtccgatgcgccgcagctcatcgtcggtcatggtggccggcgacgaagcatacgagattttcctgcagttcgcccatttcagcaggtacgggtccatgtacttccagtcgacgcgttccagctcgttggaatgcttgttgatgatctggtcgctgccgctcacggccacgtcgaatgcgtcagccagcgaattcagctcttccggctcctgatagcgtcgttggcccacatgtatgttcgtgctgatgaaccgctcgaaattgcgcatgcgcttcttgcgcagtcccgcaaccggcagcatggttaaatccgcgagggacgatttgaggcccagcccacgccaatataagcgttcatagtagcgttcgccctcaagcggccggtagtcgatgacggtaacgtcatgccccatgtccgtgatggttgattgcgtggcatacgcctgcaataccgaaccataattataggcagcatgatacgtgattagaccgataatattatgcttctcgtccatatttcttcgtcgttcaagtagttatttctttgttttctcgctattgcagaagcactccgctttctcattgttttccactgaattgcttatgacgcacccatgcgatcgcagcgctcacgtaataccatcgatatttcatcgaaagcaacgcgatttgtcgggtcacaggaaaacgacctccccgatatcgatcaagcggctgccgaaaaaccggcatgttcactacttttccatagtgattctttcgttcatgacggttccatggcgcttcgggattgaacagatcattgatcataatgatcgtcagatgaaataatgtgtaatcatcgagcgttccatcagatatttcccgaaattgacgaatggtatcgcgcattgtttcgatcgcagatattgttcgccgcacataatcgttggagaacgaccgcaccgccgaatccgcattgcggcggtattcgtacaccatttcatccacatagccgattcgattcgccgccgcgaccgcacggaacgcatattcggcgtcctctcccaaactcaaggtttcgttgaatccgtcgatccctttgatcagcggcatgctgtacagcttgccccaaacaagcgcgatacctcgctgcggtcggagcatatcctcgcataggtcaagacgcctgcgtccctcgaacaccatgtcagtttcagcataatggtgttcttccacacttggagacccctcgcctttgccgcccataatgacggcaccagcggcgtcgggaacaccgttcgcatcggcatcggcacctgcaagcacgttgcggtacgcccccatcaccacatcgcagcggtatcgcaccgcaaacgcaagcatgccgtcgacggcatgctcggcgagcgcatcatccgcatcgaggaacatcgcccactgccccgtggccgcgcgcaatcccgcgttgcgagccgcggagactccggcatgggcgatcgtttccgtacgaatgctgaccaatggcgaattccaattcgagatcggtgccgtttcgaatgccggctcaccatcgaatacaatcaccgcttcgatacggaagccactgccctgctgccgttgcagactgttcacgcaatcatgcaacgtttgcaacgtggcacggtagacgggaatgatcacactgatggtatggctcatcgtcagttcagctcccgtgtgatcaccgaagcatcataccggaacgataccggcgattcgatgctttccgggaagttgccgatcgccacgaacgcaatcagcgtttcgtagtcgggcacgcccaacagcttgcggatctcatgctcctgcttctcacgcatcatggtgttgagagggcaggcggccagcgactcgcattccaatgcggtcaggaacgccatggcgaacaggcctccgtcgatatacggctcgttgcgttcctcaacgcttacgaaactgcgcacgtccacgctgatcaacgccagcaccggaggcgcatcgtacccacgccacccgccctgcaacgccaatgcctgttcgatgaatttcggattgctgatcagcagcacgcgatatgcctgcctattgcataccgatggcgttttcatcgacatgcttacggccttacgcaccgttcccatatcaacaggggtttcggcatactcgcgtacgctggaacgccctgcgaacaatgctgcatagtcgagcgatgcgttgtcgcgtttgtctgcggcacgcacggttttcacgcccgcattgcccgcaacgtcggctttttcggcttgttcgacgctttcgatatccaccgaggccacttcgtcggcaaaccatacgcccacaaactcaggaatcggcttctccaacgcccgatgcttgcgcacgtatgcacgaaccacctgccgtgccgcgatatacgtcacatcgtcaaccggatagtcgcgttcccgccattcatccatcacggaacgcaactccccgaacgcggatctgccgaatcccgcacggaaccgtctatgcgacaatcctttttcaatacgatgaatgtaatacaccatagtgccgcgcaattgctcggattgccccacattccattgccccgcgcagaatctcaggaaccgtttgcgctgccccgcatagtacgaagccaatgtcatgttcgctttgcatccttgcaatacgcgccagacgcgatgcggaacgatggttttgattcgctgcttcacgcccatgatctcacctttccttgttttctcgacgcaacgacggcaataccgcctgcaccttggccatgacttcccttgtaaaccagccttcacgcagcttctgccccaattgcgaagcccgtcgtaccattcgcgcatactcgctttgcgtcatgccgtattccacggccatggcctcttgcaacgattcgacggcaacgcccactccctgttcgactacgaatggtgcgagcgccgccttgttccatatgatcaccggcttgtcggctgcaagatacagcgacagcttatgcggattgttgacggtcagatatttgccgtaatagccgccgcaggtgtcgagactgtcgccgtcccagatcagaccaaatcgtccttccagtttgtctggcagttcatcgggtgcgacgattccgcggtaccacgccgttttgccgttccgccggtcatatttcggcccgtacagattgatgtcggctttggggaatcgctcggccagccgatacacgtattcggctttgccatggctgagatttcccgcgatatcgatgccgtgacgctgttccatgggcacaggattcgcttgcggcagcaggtaatcaaaaatgccgatctccacgatcggcacggtcgcgccgtacttgcgcaacacttcgctcatgcgcggattgtggctgatgagcagatccgcttcggtcacccattgtttgtcgaaatcggtgtaggagtagccgcgtaacgtttccaaatcatgaatcaggaaaacaaacaacgctccgcgcgctttcatcctacgcacggaaggcaaggcgtacagcgacaccttattgtacatgatgagcggaaattgcaccaacaccacatccccgcagcgaacggttcgttccagccgatgccaaacggcaagcgtacgcccaacgcacaccagcttgtcgaaataccctttgttctcgccgggacgcacttcgaacggctgccaggattggctttcgagcacctgccgaatgtcatcgcgcgctttggatccagcgtgcgcatgatgcagcgaacgttcgcagatcacgtagttcgtcattgccaacctccattgtttgcatatcgtccgtcactcgcattgcttgcgccatgcgcgttattctcatcattcgttttccgtacatgcagtcggttgaataccggctgaagcatggccataacgaatcgttcgcggcacagcagcaacgcgatgccatatatcagcgtgaacaggaatccgccgaacatcagccacaggaaggcgttccatgtctcggcaccgcatatcgcgatcgcgccccgcgtaaggcagcctgccgcaatcgcactgagcagaatacgtatcggatcgatcgacgtgcgaatgccaaccaaaaacccgcggcacacatatgagcgcatcgccagcatcaacgcttcgcacaatgaaatgctgatggcggaaccgaccacgccgagctgtggaatcagcagcacgtttgcgagtacggccaaggcaagtccgatcgcgttcaccatggcccatgtacgttccattcctttggaaatcatgatattcgcaagcacgatattcatggccgaacacatcaccgcaataccgacgaatcgtagcggaaccgcggattccgcgaagtcagcgccaccgagcaatgccacgatcgggtcggcaagcaatatcagcagagcaatgatcgcggagccgaataccataacgaaattcatatttttcgcgatcagttcgcctgcctgccgctctttgcgccgcgcctgataatacgaaaggcgtggcagcatcacgttgccgacggaattgacggcggtgacgagcacggatttgattttggataccagctggtacaggccgaccatatcggtggtgccaaggaagccgagcatcacaatgtctacttgaatatacatgccggatgaaatggatgcgatggtgaaccatagcatcggtttgaaatggcgggaaatattgagatgtccacaattgcggaagtccacgagcctgcgtagccgcaggagattgagcacgttggatccgtacccggccaccaccacgatcaggccgtatatcgcgtagtcgccgcgctgccgtacaaaagcgaacatgagcaccaatgccagcagtttgaaacatacgctacgcacggtgatgtattcgtattgttccaacgcctgatagaaccattccacaccgaacgaggaaagccagatggccaggccgaaaagcgcgaacagcccgaattgcgcgttcattttcggtacggtgaacaggcacgccaggtagaccgcgaacaccatggtggtggagcatgccagaataaccagcaattccagcaccgtacgcgatagttccgcgcggtcgtcgcgtacgcgagcgcagacgcgcactccgtagtaggtaacgcccaggagggccaccagcgaaaagtatgaggccacggattgagcgaacgccacatgcccggtgccaccggtggaaagcacgcgcgacacgtatggcacggtgatgagcgggaagatcactgacgacgtggtgacgatcatgttcatcagcacgttgaatttcacggatcgaatgcgcacgtcggttggatgcttggccggcttgctggacggctgcccgaccggcttggtcggctgacgttcagacataaagcaccacccgcttggcgaaggcgcgtttgcgtatgcgcacggagttcacgaagaatatcagcaccacccaaataatgatgtttctgagcatgatctggttgaacatggttgacatccaacggttggagaaaaagctgaacgcacagcaatagccgatggcaccgtacagcatcatcgatatgggaatgcccgccttgccgtattgcaatgcgaaaaccgcgctttcatagcaaagctgagaaagtgcggcgatcagcacgatggcaagcatcgcacccgcgatgccccagtcgaaaatgaatgcgtaatatgtggtgaatacgttgccaagactgcgctcgccataccgttggaagggttgccattgcatccagtcaagcacggttttgccgaatatctgggggaacgaggcccgggtggaagccaatgtcatgtctccccattgcgtggatttgaccgccaacgaaggcgacatggagttcgtgagatacgcgtctaggttttttatcggcgctccaatgtagatggacaggtattcgtacatggtcgagtcgcccgccttgcgtcccatcagcgacagcagtggcttgaacgaagccaatcccacgagcgcgatggccacgaatttcaacacagtgcggaagccgagccgcatgcctttccaacggttgttctgcctgcggaacaacgcccagtatgtccatgcggcaacgccaagctgaatgaggctattgcgtccgccggaaatcaacgtcatcggaacggccgccaacacattgatgaccgcaagataatcgttgtgcaacgaacggaccaccacgctgcgcatggcgagaaacagccacgcataggccatggcgttggtcgccagatgcagtagcgagggaattccagagagggccacgcctttggtgctgaatttgttgagtttgtcatacaagccgatggctttgtccagagagccgtctcccccgtagggcagtgtcaatgagattatctgccgtgacacgatcagcaatgccaaaccggtgaacagcaggccgccaacgtacacccacatcggcagaacgatatcttgcggctcaccgtattcccgatgtgctgtccgatgtccgacgcagctgcggaaaaacaccttcacaccgtaagccgtcaatgcgaatgcgaacgtgccgaatccaaccacgaagcaggtttgcatcgacaggtcgaaatcccaggtccggtaattggtgagtccattgaataccgcgagcgtgaatccgaccacgaatagtatggatggttccgcgaaatccccgcgatatgccactatcagcagcaccagcaatgccagcaatgtcaagaacagtatggtcgaggtcatctcatcaccatgcctaatgtgatgcgatttccggatgccgtcgcttgtacagcgcgtacatcatgccgtacagcgtcggagaggtggccaggagtttccattgcagcagttgacttttcccaatgattcccttgcgttccaccattggcagcaattcgcgcaattccgtacgcgcataccgttcgaattgcgcccattgcttgcgttgatgcgcgagcatgatgcgattgcaggtaccgacaatggattcgagatgcccatatgcggcatatgcttcaacatgcggatatttggttcgcaccaagtcgagcatggctccggtggattgtgcgaatttgtcggtgatgccatgcgactgactgttttccgacattctgtaacggtacagcggcgtggaatcgtatacgatgcgatccgccttgtcgagcagctggtaggtgaccggcgaatcttccgcatagacggcgtcgagcgggtagcgcaggttatcgaagagttcttttttggcgagtttgtcccacgcggtcacataaaagtagccatgctgattcacataggcgaatgcttcctgcgaggtcatgacgattttcttgtcgggaaaagcgttgcagtaggtgctgccgtcagggttttcccgttcgtacgagatgatcgacaggtcggcgtcggattcctgcagattgtgcagcaacgtgccgaacatatcgggaagcacgtaatcgtcggaatccacgaatccgatgtattcgcctttggcaaggtcgagcccggtgttacgggccgccgccaagccggcattgcattggcgcaccgcacgaatgcggttgtcacgattcgcccaagcattgcactgttcgcaggaggaatcggtggatccgtcgtcgaccagtatgatttccaatcgttcgtaggtttgcccgataagactttccacgcattggtcgagataccgttccacgttgtagaccggcactatcacgctgatgaggggttgggtcgaaactgccataagacctgttttcagcagcttttcacgtactttttgcctacgaatttcgccataaggaaaccggacccctttttgatccagtccactggttcggggctgatgataggcatttcgacgtacgggtaatggttggtttccagccatacatcgaagaggatttcgctgatgcgtccgggaaatcgcatttcgaagacgctgtatgagcttgaatcgatatgcttggccagttctccgatgatgggaaacatccacgagcagtattcgttgatgaggtctttgcgcatcacgaacatgttgaacaggtgcgccgaggttttgttcatttgcgcgtcgaatgcgtcgaggtagtcggaattggtttgcgcgataatgcttcgtgtcgcatcgagctggccttcctgcatggtgtgctcgtaatgtgaatatacggtttcgatatagtagttgcgtcgttccggcacaatgatttcgcacgtatcgagcagacgcgcatagtcttgttttcctgcgatgcagctgaagcgttcgttttcgtctccgtggcgtttcgcactgtcatttttggcaaaatgacggcggtagtgcaccaatccctgatagtcggcatcgcagtttttccacatccaatacagtccggtcagttcggaatattgtgcgttcaactgcgaaatattatcgccggtgttgtcgcacgtcatacccaaatcgacgttcggatgcaacgccctaccgacctgcaacggcatatatacgccgtcgatcggcatacggtacgccttatgcgtggccacggccaccgtgatgtcggagtccgccatcactgtcatcccttctataccggacgcgcactactgccaaagcacgcccttatacttcaccctcccccttgtctggagggtacagcatacgttttcattttatctcaacagttcatctagatttcaccaaacgtcagacactcccgttttacaaaccccatttttcaagctttttcaagattattttacaaattatcatgttttgcaagagattgcagacgtttgcatacacgacgtgaaaacgaactgatttaaagctttaatcacaccccacacacgccatccaacacccccgatatggcaatttcaggatcgcctctttcataaatattgaaaatctcgtcacaactgtttcattactacttcggcgtttcgctgccatcatgttgggattacaagaaaaaacgtttgcagatcattgcaaacgattatgaaaaacagggcgcacgactccaatatcacatattgaaatcgcacgcccctgagatctaccggtcagaccggtggatgtatggctttatgaaatccgtttgattccttatttgacggtgatggtgatggttgcggtcttgcccgcggccttcacattcacctttgcggttcccgtctcgacgccgtacacgacaccggttccggaaaccgccaccgccgcgccgtcgctccaccacatgtcgggatcacccgtggcgcccttcacggagaggttcgcgagctggcccttctggatggtgagcttgccgttcgagacgccgtcaccggtgattgcgaacgttaccggcacggtgccgtcctcgttcacggtgttcacatcccaggccacgccaacggtcttggccttgtcggcggtggtcttgcggtcggtggtcggatcccacgtggtcttgccgttcgcgtcgaccttgatcaggcggaaggtcatggacttgccggtcttcacgttcgcggtgccggagtagacgccgtcggctcccgtggcggtcaggcggatgccggaggcgcgggtccaggtcttgccgtcctgaccccagtcgcctaccgcgtacaggctttcgccgctcttcaagtcggcggccgcgttgatggtcacgtccacgctttgcgaaacctggcgctcatcccacttgagggtgagggtcttggccttgtcggcggtggtcttgcggtcggtggacggatcccacgtggtcttgccgtcagcggaaaccttgatcaggcgcatggtcatggactggcccttggccacggtcgcggttccggtcagttcgccgcccacggtagtgagctcgacgccaccggcgcggttccaggtcttgcccttgccttggccccagtcaccgaccacgtaggccctctcgccggacttcaggtcaacgccggtcgccttgaacgtgatctgcacgttcttgtcgtcgtcaggaggcaccaccacggtgcaatccacggccttcaacgaagcagacgaaccatcccacgttacggtgccgccgttgtagtcgatgcccggctgccgggagcccggatactgctggctgccaccgtcgttgaaaatcaccttcgcgccggacgcgagcgaatcaggcacctcgtactggtaaccggtctggtcgcagttgtcggcagccaccatctcgacgcccggccaggccgcgttgttcttcgcggtcgccccgtcgccggtgtacacgtacgcgtacatcttgctccaaccggaaggcttggtcgcatagatggtgttcttcgccaccggcggtgtcggaagcgtgccggtcaccgtaacggtgatcgaatcgctctgggaaccggactttgcggtgatggtcgtggtaccggccttcttcggcgtgaccgtaccgttggcggaaaccgtggcgacggccgtgttggaggagctccagctcacggacgaaccagccggatcggtggtggcggtcagctttttcgcaacggcgccattggaaagatcagtggtgtagctgccaccgttgatcttcacgctggtcaccggagtcggatcttcatggccaccgatgttggccatggcaacggtgaacgtgtcttcgtcggacttctcgtaggagttgttgacctgagaggaggtgtccggcagatcggcattgtcgttcatcgccatgtcatacggcagcgaatccattgcggaaaggccgaaggtggctgccagttcaacgccgagaccgtacttttcgatatggtccgcggtggtgccgagttcgctcagcggaatggcgatctcgtagtgatcgtccatgcctgcggagttgtggcccagatcgttgaagttgacccactgtgcggagccttccttgtcggcgctcatgtcgccgaccactcgaccgttgctttcaccccagccgccgttgatgccgatcacctggctgctcaggatgccgttgccgtaaccgaacttgacgccggaagccttggtgttggtcttggcgttggctgccggaccatattcggcgttggaatcaagacctgtagcgtcgcccttgtagatccacggaccgttggaaccgttggtggaaatcgtcacgaccttgttgacgttctgctcaccgctccacttgatgccggaagcccacagggttccgccggtggaaagtccgccgtccttgcccactcgggtgctttcgtccttcgtgtcgatggcgatgtggaacggcagattctgcgtctgccacaggtggccttggctgagcggataatcgtcgccggtgtcgaccacgtcttgcacgttggtcatttcccacatgaggtacagattgtcgtcatcgtaggcaccatacagtgcatacagatcgatcggcacctcatacatggaattcggtcggtagacgcgcggatcgtcgttggctgccccctgtgcgatcagcatggagctgtcccaatcggagatgctcgcgccttttccggcattgaagctgatggttttcttcacgccgaagccgactttgttcgtgccatatcgcgaggcgaggttctgtttggcgacttccgtcttggtcaccgtggtttttccggtgagtttggatccgtcttccgtgcttgtgccggtcacggtcacggtcacggactcgcccacggagatggagctgcccacggtgatgacgtcaccgttcttgaaggtgccggacttgccttcggaggtcgtgtacttgaggttttcggccttgcttgcgcgcagggtcacgtcaacgctgcttccgctgaatgttgcggaagacggttccgcggaaacgtacggcttggcttcggccttcagatagtaggcgctgaccgcgttgcccttggcggtgccggaggtgatcttgccgccggaaacggtgatgcttccgccgttgacttcatccggatacacgccgtcgtcaaggttggtgctcatgccgacgaggctctggtcgccgcccatgttggcgattaccacgccatcgttggcggtgccgtccttggtgaagcgttcgatcatcaggcaggacttgttggcgttgttctgatcggcgccgcagttctgcagatattcgctcttgccgtccatggcgttacggaagtggttgacggccacgaccgacttgttcttccacatgtcgtcgcccgcatcacccagctgggactgctcggcgaattgtgcattggttccgccagagccgaccggacggttgaagtacagcggtgcgccggccttgcgggagcccacgatcgcccagccgaatacgatctgatcattggtcagatacgtggattccttgtcgccattggcatagttgtcatgcgactccacccaagtgacgagctggtcttccttggcgccgccggtatcgatgttctgcaccatcttggtgctcagattgcctgagctgatggccgcgcgcacggacttgccatagttggatgcggtgttgccgccgccgtcggaggagttgttggcgaacaggtccgcataggccttgtagtcgaggccggaatcgccctgcagcacttcgccgtactggaactgcgaaccattgttcaaaatggtgttccaatagttggaggtcttgttgtcgaacacttcggtcggcagttcgacgtgcttggcggcatcgaagcggaagccgtcaacgccgtccgcgactgcggtcttcaggaagtcctgcatgcggtcggccacatactggttctgcgtgttcagatcccacaggccaagcaggtggcactgggtcacatcgcggcggctggaatagttgatctggtcgccgtcgttgccgccgcagttggaacgggagtggaagtagtctttgttctgccaatcggagtcgatggcgctccagtcggaggtgaagtggttggctaccacgtctacgattacgcgcacgccgtatttgtgtgcagtggcggtcatttccttcagatcgtcttcgctgccgaccacgaagttgccgatggaggtgttcgccggctggtacacgtaataccagttttcggtgaacttcttgccgtttgcggcgacttccttgattttgctcatcggctcggtttgcacggaggtgtagccggccgcggcgatttcaggcatatgttcggtgatggttttgaacgaccacatccacgcatgcaggatggcgccgttcttcatgctctcggtcaggccgtactgttcgcgggcctgctcgaacgtggcattgccgaccgtatcctggtagctgtcacggtccgaggcgagtgcggtggaggccacgcccatgccgcccagcatggtggcgacggcagcgactccggcggcggctttcttccacgttttgatggtgcgggccttgcgggccgcctgcctgcgctcgacgcgggtcatcggttcggatggacccccgtcttgcgggggctgttgcttagtgaatacgtgcgcaatacctgcgaacgtacgcgaacttattcgcactttgacctcctgcttccttgcatctttcctttgaaaacgtttgctccttagcgaacgtaatccttaaaatatcacaaatttttggtgaaaaatgagtgatttttaatgaaatcgacgatgaaaaatgattggtttttctgcttttttacaaacgctttcagcaaggttgtcccccatccttcgacccccgatatacgacatgcctcgaaacagccacatgcaaacgtttctgaaaatcgtttcaccgcatgcacccgtcaacagcctctcccccgcttcttcacccctcttcagggcaacgggtacaatacgaaatcgtcggaaaacacgaagaaacacggtaggaaaggacagacccgtgaccttcaaccgctacatcctcttccgcatggtcgttgaatttgtgggagccatcgcctgcgccatccaaatgttccagcatcacacgtggccgggcatcatcaccatgggcgtgttcgcgctggtgtgggccataggcgagatctggctgagcacggtgtacaaccgcgcgcacccccgccgcgacgagctgtccgacgagcatcaggcgacggccatccgtttcacgttcttcgtgcttgtggtggcgctggtggtgttgggcttcgcaggcatgatcgtcacactgttcaggcatgcgccgttcaccgttcccgccatggcgttgccgacgttgggcatgctggcgctggccatcgccgacgcccgctacctgtggctcgagcatgagggcggggacaccgatgaagactagtttgaagttcaaacgtatggaacgcggcttgaaacaggccgatcttgccgaccttgtgaacgtacgccgcgagacgataggacgcctcgaacaggggcagtattgcccgtcgctacgccttgccatggaccttgcaaaagcgcttgataccacggtcgaagacctgttcagtttcgacgacgaagagtgacgcttcggcgtgttgcgtttgtaaattcttatcaaaatggcgattttccaacgaaaaatcgccatttttcatattcgggggcatgtgcgaacgtcgtcacatggtgtgacaacgccgtcacatatgtgcgattcacctcacatcccccgagagcgcggttctcaacgggggcgtatagtcaaggtcgtagcgggaaaccactacggcaaaccgctgaaatgtacgttttatttagagaggaatcacgattatgaagaagaagatcgtcgcaattctcgccaccatcgccgccgtgttcggctttggctttgccgctaacaccgctatggcttatggcgcgaccggcaccgtttccggcaacgtcgccaccttcacgtttacgggactgactccgggccagcgctacgtggtgtcctacgatgacaccaccgtcgagaacgtcaccctggctgccaccaagtactccaacgttaaagaggcacacaaggacggcaccctgaccgccacctacaccttcaagtctggctttgctggcaccatcgcatcttccatctacgcagtcgatggggcaggcaatccgaccggtgccgctctcgcttccgcttccgtgaccgtcgccgctaccggcgaaggcaccgccaagaagaacgagaccgcttccaccggtgctgctatcgctccgtacgttgtggccgtcgtgctgctggctgccgctggcatctccctggttgccgttcgcaagagctctgctcgctgaacaataaccaagtagatacacaccatatctatgtttcatgaaggggcttgggttttcccaagtcccttcatttattcgaaaacaagcatcgtaaaaccgattgttttcttttttcaggaagagatcatgaaagtcctgtttatctgcaccggtaatatctgccgctctcctatgggagaactgctcctcccccaattcatgcccgatcttgaatccgacagtgcgggcacacgcgggctcgtttcgcacgaaatcgcaccgaacagcaaaaggctgctcgaccagcatggcatcgattccagcagcttccgcgcgaaacgagtcaccccgcaaatcgcgcagggcagcgatctcatcctctgcttcgaacacgagcagcgcaaggaaatcgcggtgattgcaccaaccgcggcccgcaaaaccttcctcatcaacgatttcgccaacatgtgcgtctactgcaaggaacaggggtacatggggggtaatacccggcaggaaaaactcgaatcggtaatcgacaacgcaagcatgatccgaccgatgatccccgataccaacaatgtggaggatccgatcggcaaggacttcgccgtatatcaggcagcgtacaacgaaatctgcaaggctttgcagaccatagcaagcgccactgcctgaaaacgttgaaatctcaacgaaccaagctagaaagggtgcccaactccctccatgggggtgctctttgctagtatggaacctgatcaatatgatgtgacaaatgtcgaggggaaacatggctgcagcagaaagcaacgtgccagcaaccaatcaggtggtcgtcgaatccaatgatacggaagacgacggcatcaccttgatggatttgttccgtatagtccataagcatcttctggtgggcatcatcacgttcgtggtggttttcgcagcggtgtgcgcatacacattcctggcacccccgaagtattccgcgaccgcgcaggtgttcgccacctacagtgattcgtcggtgcaagacaacaatatttccaacatcaacagcgccagcacgtatatcaccaaccagattcagtcgtatccgacgctggccaccacggaatccgtgctgaagccggttatcgacgatcttggcctcgacaccaccgtcgcgaatctggccgggcagctgaccgtcacgaacccgacgaacaccgcgttcgtgaacatcaccgccgaaacgggagacgcgaagcaggcttccgacattgccaacagcgtggcggaatccctgagcaatgtggtggagaagtcgctgtatgcctccggcaaggagtcgccggtgaagctttccgtggtgcagcgcgctgcggagccgatctcccccagctccccgaaggtggcattgtacttggccgtcggcttggtggcaggcctgattctcggcgtgttcgccaccctgatccgcgatcttatggcaacccgcgtggaggaagccagcgatctgcaagacattatcaacgcgccgatcatgggccgcatccccaccgacgaaagcctgcagagcaacaagccgatcatcgtgtcgaacccggccggccgtatcgctgaggaattccgccgtattcgcaccaacctttccttcacatcgaaggttgaaggcagcgatgcgcgcatgatcgtcatctcctccgtcggaccttccgaaggtaagaccactgtttccgtgaacgtggcggccgcccttgccgaaaacggcgccaaagtgctgctgatcgacgccgatttgcgtcacccgtccgtagccgaacgacttagcctggaaggcggcgccggcctaacgcacgtgctttccggccaggccaccgtgaaggatgtggtgcagcgctattggaagccgaacctgcatattctgccggctggtccgaagccgccgaacgcttccatgctgctgaactcgaagaccatgaccgaattgctcgacgcggctttgcagacctacgattacgtgatcatcgacacttccccgatggtggtggccaatgatgccactgtcttcggctcgaagagcgacggtatcgtgctcgtttccggtcgcgacgtgaccatgaagcgcgatctgaaagacatcgccgtgcagcttgacaacctcaatgtgccggtggtgggcttcgtattcaacctcgaaaaggaacgcaagtcttccacgaacggcaattactactattactactattacgacgaggatggcaagaagagcaagcacgctcataagaacagccgcaagaagtccaagcacaactaagctgctgggcttcagggtttccgccctctatcgcgagtcggaaaccagtctaagtaaccgaaaaggggttgcagcaaatcgttaagattcgctgcaaccccttttccatgcccaaattttttgccttcagccggctggcccgcaacttcgcatcagctgcggaggaggatttcctccaaggcgccgatcaccgcatcgggcatgccggaggtgacaaacagctcgttgctgaaacggggcgcggtatcgaaggtgcgcagagccccgagcgcacgcactccttgctcacgaatcgcctgcatcgcatgctctttggaaatgtacggcatttgcgcatgcaagagcacgtcaagcacgtcctgttcgactgaattctcagcaatctgcagtccgtctgcaatcgtaacgttcaagcatgcagtagacggcacgtcgcgcacaacgaccgacagactcaacgtctgctgatcgtatgtaatttctgcagtattgcaagctttaccgccaatttcgatacgaacgttctgcgtgtctggctgcgcaactccacggaacacaatctcccagttacgctgtgccggaatggcttcagcacagccttccaccggactgatggtgaactgcgtggcattgtccgtattcttccagtcaaggctcatgcgcgtatcggcaacatgaatttggccatcgcaagactcggcagatgcagaaccggaagcagcagaggccacagaaccatcgtcttccttgagtgtgaacgaaccgttcgcaccggggaacaccagcacctgcagggactccggattgcccagatcattcaccttattgccctcgccaagctgctgcaacggcacgataccgccagccttggcaaacaccggcatacggtcgatcgcacgccacacttccaaacgacgcccggactctcctgccgaaacgtaacggcgaccatcgaagaagtcataccattcaccttgcggcagccatgcttccgtgctacccagctgcgcggaatcgtcattgtcagaaacaattggtgcaaccagcagctcagtgccgaaacggaattcatccggcacctcgtacgcctgcggattgttcggatccgcccaatacatcggctccaccaatggcatgccctcgaacgcggcgcgatagttcatggtgtacaggtacggcagcatcatatggcgcagtcgcagcgaacccaccatggaatcgcgcacttccgcggagaagttccacggctccttgcccatgaactgcgaattgctggaatgcaggcgattgatcgggctgaacgtgccaagctggtaccaacgggcttccaaatgctcgttacgatagccacacatatgaccgccaatatcgtgactccaccatccgtagccgatattcgacgcggtagcagtgaaatacggctggaactgcaaggattcccacgtaacaatggtgtctcccgagaagccgaccggatagcggtgcgaacccgggccagcataccgcgagaaggtgagcggccaacggttgttgcgttccgtgcaactcacgttgcgttcggattgctcgacatgcatttcatgctcatcgcgagcgcccggctcggcgcacttttcgcattcgcagttctcatttacattgcgttcggaagaagtctcgtagcgcccggaatccaggtagtgcaagtggttgagcacccacagcgggtcaagtccgggctggcgagtcacgccgccttgctgccagtcgagccaccagaagtcaacgccttcggcttccatacgatgatgcatgtcgaagtaggcgcttacgaaatccggattcgtgaggtcgaattccactgcctcttcggttgcgggatcaatgccgacgcgcttggccaccgcctcatagtcgtcttcgaacgcgcgcacgccgtctcgcggatgcacgttcaacgtggctttcaggccgcgctcgtgcaagtcgcgcaagaacgcctcatgatcgggaaacagctgcttatcccacgaatagccggtccaaccggaaccgtatttcggatcgacatcgtccacgcggtgccagtccatgtcgatcacggatgtggtgaatggaatgccttcgcgcttgaaccggtccatgagctgcaggtattcgtcttgcgtgtagcggtagtagcggctccaccagttgccgagtgcgaagcgcggcagcagaggcgttggtccggccagcttgtagaagtcttgcaccgcttcggtgtagcggcggccatagccgaagaagtagaagtcggtttccgcgtgatcgcgtggcataacccaagcccccagcggattcggtttgccgttcacttcgtatgcttccacgatcacgttcgcggcggaatcatcgagtaccgcccatccgtctcgcgaaatcacaccatcgtccagagaaatttcgccgttcgcctcgtcgagcgtgcgcgcggtgcctttaagattatgcttcggttcgtcgccgtaatgccacgtattgaactgggtgtcggccacgcccttgacgactacgctcaagccttctttgctgaatggcttgccatcgtacgtcacatacagcgcgggggtgtcaacaatgagcagtccgtcgcgatgcgtcaccgtgaattgcgggtcggcgccaaaatcgcggttgaccaccatttgcgtgagattgtcctcaaattcgccggaatcagaccattcgaaacggatcagcgattccgttagaatgccaatcctccaatgatccccttgtaaaaccgacgattctcgcattttcggacgtgccttgcgcacatagtcgacgaataccgtgccggttgcgttatctaatgcgttgtttgccatgctactcctgccttacttgccactgcccgtcgcaatacctgcgatgaactgcttctggaaaatcatatacacaatgatcactggaacaattgccaacgaagtcgctgcgaacaatccgccgtaatcggtgccgtattgtccgttgaaggccttcagaccgacagcgagcagctgcttgttttcgtcagtgatcatcaagaatggccacaggtagtcttcccaattccacaggaaggtgaagatggcgagcgccgcgatggtgttatggctcattggcagaatgatgctatggaagattctggtttcggatgcgccatcgagtttcgccgcttcaatgagttcgtcagaaattcccgagatggattggcggaacaggaagataccgaatgcgctgatcatgccaggaagcacgagcgacgtgtaggtgtcttgcagaccccagttggtgaacatttcgtattgcggaatgatggtcactgcccaaggaatcatcatggtgctcataacgatgccgaaaagcaggttgcgaccacggaatcgcattttagagaacacgtaaccaagcaccgcacttgtgtagattgcaataccggttttcagtactgctacgatcagcgagtttgcgaacaatcgcaagaaattgaacttttcttggatgctcacataattgtcaatcgtggatggcttagggaataatcctccggtcactttgacgatttcgctatttggcgcgaatgatgaaatgaacatccaaacaaatggaacaatggtgatgatggcggcgatgaagagcagaatcgtaagaatgatgccgccaattttacgtgatttcatgccagttcctccgaatctccagaaaccttgaacatgatgagggtgagcacaccagtgaacaggaagagcacaactgcctgagctgacgcgacgccgaagttgtatttctggaatgcctgatcaaagatgagatagctgatggtgtaggttgacgtgcccggaccgccttcggtcatgacgagaatctgcacgtatgcctgcaggtagctgatcagtgacgtgatgacaatgaacaaggtggttgatttaagcaacggcagggtgattttgaagaaaatctgcactgagttggcaccgtcgatggcggccgcctcgtacacgtctcgaggaagattcatgagaccggccaaatatagaacggtcgcgtagccaaaatccttccaaatggtcatgatgatgactgccggcatggcccatttggtgtcgtgcagccagttgatgtcgagtcctgtgattttgtttaccatgccgaactgcgggtcgaacatccacatccacacgaaagagactgccacgagcggagtgatggtcggcatgtagaacagacctcggagggtgtctttgcatttgacgagtttggcgctgagcagcagggccaagccgagaccaagcacaatgcggaagagtgtggaaacacctgcgaataccgccgtgttccccatggaagtccagaaaagtttgtctgtgaggatctgtttgaagttgtcgagtccgacccaatcataagtgccaatcagaggattccagttatgcaaactgcccgcgaaggctttaaaaattgggtaggccaggaaaatggcgaaatagaccaccaagaagacaacagccatgttgcgtagggtgaaaattctcgataccagagattcaccatttttgtttttcattgaatctcgcctctctgtgagccgattcgaccgttttgttacgcaatacagaatgtcagatcgaatcgaataagaagattgaacgtatctcgtagataaaaaggcagtcgcggcgcggaagaagaatcgtaccgcgactgcccggattggaaaagggattggaaaggatatatcggtattacttatgttcgtcgaagtaagcgtacttgctttccattgacgtgaagtcagagctcttcatgtcggtatccatctgaccctgggcctccttgagagccttatcgatggacatgccgttctggaagacgttctggaaagcagtggtgccgctggattcaacggtggatggtgccggtcccggccagatcagtcggtctacgcgtggctggatggcggccatgaccggcttggagagaatgtccttgtcgttctgcagcgaggtcttggctgggaaggagttcagttcggataccgcttcacgaatgtaatcatcgttggcgagcaggtacttgatgaagtcctgggcaacggcctgctgttctttgctctggttcttgttgacgcccggagtggattcgccgttgtaacggtcgtatgcaaacggagtgtcttcggagaaggttggggtggcgaacacgccgtagtcaatatctggatacttttctttcagcgtgccttccatgtggccccaagcgtagatcatcgcagactggccgttaccgaagctttgggtgtaatcgttgccgaagtcaacggatccgaccttgtacttgtcatacaaatccttgaggaactgcatgttttctttggtcacatcgttgttgtagttggctttcttgccatcttcgctgaagagcagttcacccttctgataattcagaccttgatagatggcgctgtaggcgtcgccgttgaagttgaagccggcctgcgtcatcttgctgccgtcggttttggtgagcttttgggcgacctggatgaattcgtcccatgtggtcggaatgtcggcgtcggtgaggcccgcttcgctccacaatgtcttgttgtagtagatgttgccggtgttgatcacggagtcgatgtacttgactttgccgttctcatcttcatgtacggatgcggtggagtagtcggattccaaagacttggtgtcgatatcgtaatccgctgcgtatggacgaatcaacgcatcgtaagagttgtggatgttgaaaacggccggaccgtttttgcctttcagagccaacggcagcttggtccaataatcatcccatgaaacattcaccgttttgatggtgacgttcggatacgtcttcgtgtaggactcaatcatcttgtagacaggatccgtgcccttgctgccccagctccagtactcgagctggattggcttgccgtcgttcacgagatgattggggtcgtaggtgatggtgttgccgataacgtcaagccctttgtcggctttcgtatcggttgtgccggacgcggcattgctgttcccgcacgcagccaagccgacgatgctcaaggccgccactgccactgcgatacctttgttgattttcatatctctccttacgtcctcgtaagccttcatccgccccttgcggacaagcaatagcatacgacaagggtttcatattggcaattcaaggttttttaaaatgtaaacggtttcatttgaaacccgtttcatctcaccgctgtgagcgtgcacacattgtttttcatacggcgtgtcgtatcgcaacccttttcattcatctttcaactctgtagccatgaggacggtaatgatggtaggctgaaacaaacagtgaaaaactttcggaggcaccatgaaagcgagcatcggcgatgtggcactgaaggcaggcgtatcgaacgctacagtctcacgcactttcgcacaccctgaacaggtgtcagaggcaacacggttgaaagtgcaggccgcagccgatgcgttgaatttcagcgtttccagatcggcaggaattcttaaatccggtagaacctatcgcatagcattattggtcggcagcggcgtcatcgaatggttcaccgccgaaatcattgccggacttaacgatgttttgcgtgacgccgggtacgatctggtcatctaccccatcgaggggtcggaggcgcgtgacgcattcttcgaggaacttcccgtacgcagcaacgccgatgccgtattcgtttcctcatttggcatcagccccgacgaggtcaaacgtctcggaaccgcaaaaattccgattatcggtatcaataccaccagcgaaggattcgatgcaactgtcggtatcaacgacaaagaaggcatcaaactcatcgttcgacatctcgccaagctgggacatcgtaacctgctgtatttatatgaaagcttttcctccacattgggattcagctcatttaaccgtatttccggattccaggaagcctgcgatgcagttgacggactgaccgcccgcacactggcagtgcaaaaaggcgacagcattctagatgcggcaatttccgaaatcatggcgcaagacaacccacccaccgcattgtgtttccatcaggactcacaggcaattccattgttcttccgccttcaacgcagcggcctttccgtgcctggagatatttccgtaaccggatttgacgacagcaccttcgccaaagaagctgagctaaccaccgttcgacagcgcccatacgacatggccgtcgatgcggcacaaaaggctctggcgctcatcgaaggacaacccatcgaggaaccattcgagacattccccgtgcagttgcaagtacgaaactcaaccgcaaaaccacgcaccgctcccctgctgtaggccgcagcgtgtactcgcgtgaaatcacttcgcgtaataccccacaccaaccggtctatctgcgttatgtatggcagattttgcttttcgtacggaaacatctcgcttatatatggcacgtcgcctgcgaaaacagccacttcggggatacgtttttgaggttttcgccgcatgtgtctgccatatgtaagtgagatgtctccggtcaggcctccgaatctgccatacatagacgagatgcgagccgcagacaagcctcttcgtcttaccccggcgttcaatgtacttttcttcacacgcatgtacgtttaatcgcctcaagcaccgatgcgaatcaaactcaccaatgttcgcaccatcaacggcatacgccaagccaatagcacggactcaatccaaaccactaacatcagcagtttggcggatactcgcgcgcatagccgtccacacctccattggatgaaaaacttggaatcgcgtcattgccttttgtcgaccatcatggcgacgcgcgcaaacagataacgctaaacttgtctcatgctgcttatttgcttaacctagcgaagcgacagggcgagagcaggtgatatatggtaacaatttctgacgtggcgcacgcagccggtgtttccaaagcaacagtctcgtatgtactatcgggagatcctcgaatcactcaagctacaacacttaaagtgcaacatgcgattgacgaattaggctatacggtgaaccatgcagcccgcgcactatccgtaagaaaaaccaaaacaataggtgtggtctcccccgcctttcacggcaactatctgtcagccctctttggactgtacgtgtacctgctatccgaagaagcgacaaagagaggatacgacactctgctcattggcgagaacgacggcttcgaggcaatgcatgaagcatggtcgtcaaagaaagtggatgggttcatcctgatggacgtcaaagatgaggatccacgagtcagctatgccgcaaaagagcacattccgaccgttgcattcggctcgccaaagaactcatacggtttggatacagtggattccgatttcgccaaggctgcatcatcaatcttgcatttcctagcctccgaagggcataaagaggtgattcttattccatggtcacacacaatatttgatcagggtcttggctacgcttggcgctttctggattcagcgatagagaccgccaaacgtcttgacctgaaaatgcatgtcgaatatccgaaagacgacgattcggatccttcgcccctcattgagcatgcactagatacgcacaccaaagcgaccgctctgatacttcacaacgagccagcaacaatcgttgcccctcaggtcttggcacgcaggaatctccgaacaccggatgacttgcaggtcgtaaccgtcttcccgaaacagctagcaacatcaatgaagatatcgttctccgcagtgcgtccggacattgcgcaactatcagaagccgccgtgggagcccttttgcgtcgaataaacaatccgaaagcccagacggtcacccgctatcttgattatccactaacccaagagcccgagtaacatcgcagctacgtagattacgcgcagaaaacaaccacgagattctacattagttaagttcgtcgatttgacttttcaaagatcagggtttattatctaacttgtttaaccggttcaacagtttgggattaaaacttcccaaacgcaataaattaatcattcagcgcataggtgcgctgttaatgaaaggaaataccaaatgatcggttcaaatatgaagcgcgtgatagctttaatcgccgcaagtgccgcggcagtcagtctcgccgcttgcggtagcaactcgagtcaagattccaaaacaatcgaattctgggacccataccctcagaagaacgatagcagcacatgggcgaaatacgttaccaattgtgctcctgagggatataacgtaaaacgcatcggctatgcgcagtcagacctattaaacaatctcacaacagctgtcaaggccggcaacgcaccccagatcgccctgatcgataacccaaagatgcctaccgctgtcgacgcaggacttgttacggatatcgaggcagcgggagtcgacgtttcaggattcgacaagaatatcgaaggtcccggcatcatcgacggcgtacaatatggggtttcttacggcactaacgcattgggcttgtattacaaccccgatgtcctcaataaggctggcgtcgacccggaatcgattaccgattgggattcgctcaacagtgccatcgaaaaagtagtaaacgcaggatataagggcatcacgttctccggcatttccggcgaagaaggaacattccagttccttccctggttctggggagccggcggtcaattgaaggacgcttcaggttccagtgccgagcaggatgcgcttgatctggtatccggctgggtccaaaaaggttgggctccgaaatcggtcgcaacggacaaccaatctgctgcgtgggatctgttccttggcggcgattacggcttctctgaaaatggttcatggcagatggagtcggccaccgagaaaggctacaagatgatttccattccagccaaagatggcggagtagccccggttccaagcggtggcgagttcattaccattccagcccagaaaaccaaagacagtgacaagatgaaggcaaccgcggaggtcattcagtgcctcattgacggagataatctcaagaagaccaatgatgagatggtttatcttgccgccaaaagtgacgtccgcaagcagcaggtggaagagaacagtgcctgggcaccttgggttgacgccgtagaaaatgctgaaggccgtaccactgacgttggtctggaatacgaagacatttctgcacagctttctgaagatctacaggctgccttgaataagggctgattcgcggtctcatatttttctggggcatctgcccgccattcattgcgatattcagacgccccattccatcttttccatcaacaggcaggtgaactgtgtctcaaacaatcaccgtagataaaccaaggcgaatcaagccaaccacattggccgccattggtttcgcggccccgctgattatttacatgcttatcttctacgtttggcctctgattcagaatatttccatgagtatgcaccgctacacacgtcgcacttttgtgaccggcgatgccccttggtctggattcgatatctataaggaaatattaagcgatcaacagttctggaccattctcggacagactttgattttcgtcttcgcttctatcgttttccaatactctatcggcttggcattggcggttttcttcaatcagaatttcaaactttccgcggctttgcgcggcgcattccttgtaccatggctacttccgccaatgatttccggtacgatctggcaatggatgatggacgccgacagcggtgttattaataatttcctcaaactatttggtttggacccggtttggtggctgcaagccgatcattccttgtgggcggttatcattgccaatatttggcttggtattcctttcaacctcgtaattctgtattcgggcttgcaaaacatcaatggcgacttgtatgaagccgccgcgttggatggctgcaatgcttggcagcgcttctggaagattactttcccgttgctcaagccggtatcgatgatcacgctcctgctaggtttcgtctacacgttacgaacagtagacatcatctggattatgaccaagggtactggatcttcgagaaccttggcaacttgggcttatgagatggctttcggaaagggcacatcagcaaccatccggtattcggaagcatccgttgtgggcacgattctcattgtcgtagcactgattttcgctctgatttacctgtgggcccagcggaatgaagagaagaggtaactaaatgaaacatcgttcatcatggtggaaaacacttataggcatcattttgacgctgattatgctcttccccgtatactggatgatcaacatatcattcacgcaacgtcgctccatccgttcaggggatctgttcccgaaagatttcacgctcgacaattatgcctctgcgttaagttcacagctcccctacctaggaacgtcattgctagttgccataggatgcgtgatcctgactctagcaattgcattaccttcgtcatacgccattgttttcttggagttcaaaggctcaaagtccatgaacttcctgttgattgttgctcagatgattcccgcggtcgttatgtctctaggcttctaccagatctacaatgacatcggccttctcgacagtattccgggacttatcgttgccgactccactttgtcggtaccgttcgcggtgattctgatgacgggatttatgtctggtatgccacgctcgctggtggaggcagcgcaaatcgacggagcatcacagtggggcgtttttaccaaaatcgtgattccactctcccgtaataccgttgtcacgacttcgctattcgctttcctctgggcatggtcggatttcatgtttgcttcgaccctcgattccggtggcggcaagatgaggccaatcaccatgggtctatatgactttatcggttcgcaaaaccaagaatgggggccaatgatggccaccgcagtattggcctcagtaccaacagcactgttgctgattttcgcgcagaaatacgttgccgccggcgtaacagccggagcagtgaaagactaatccaacccttaaatacataattaacaaggaccagctatgagtgaactaacttttgctatcgatggagatgcactgttgtggactggggacggcgaataccttcgcatcgaaccatggggaaagaattcagtccgcgtccgcgcctcgaaaatgcatgagatacaagaacaagaaggagctttgctaccacaaaacaatcaggtctcagacagccacaactatggtatcaccattgacaagcccaatagaaccgccgaattacgcaatggcgatattgtagttcaagcgaaagcatcctgcggcctgtactccggatcaggatatgaagagccacgctgtttactaagcttctataaggcagacggcacaccgctcattcaggaaataccatctggcggatcactaaatcttcgagcgcgatggttcaaaccgatcaccggaggcgactattccatcgttgcttcctttaccacaccggaaaatgagaaactatatggtatgggcgagtaccaacagaacatcctcaatctgaaaggttgtaccctcgaactcgcgcatcgcaattcacaggcatctattcctttcgtggtttccagcgccggatatggcttcctgtggaataatccggcacttggaaacgttacgttcggcaagaaccgcacggaatggcgagctgaatcagccaagcagattgactactggattaccacaggcgatacaccttcttcgataatgaagcattacgccgacgccacagggcacgctcctcacatgcctgaatggggactgggattctggcagtgcaagcttagatattggaatcaacgtcagcttctagacgtcgcccatgggtttaaacagcgtaatattccattggatctcatcgttgtagatttcttccactggccgcatatgggtgacttccgttttgagaatgaattctggccagatcccaaagctatggcggacgatctgcacagcatgggagtgaaactcatggtatctgtgtggccccaggtcgcgctcgcctcagagaattatgttgagatgaagtcaaagaaccttctcgtgcgtgcagataagggtgaagacgtcggcatgatgttcgaaggtcccagccagttctatgacgccaccaatccaaaagctcgtgaatatgtttgggagaagtgccgaacaaattatgccgagcttggggttgatgcattctggctcgacgaagcggaacctgaatacggcacgtacgatttcgacaattatcgatattacgccggcccaaaccagcaggtggcaaacatctacccaagagactataacaaaggcttctacgaggggcaacaaaccataggaagggatggtgacatcgtcaacctcacccgttgcgcttgggctggttcgcaacgctatggttctcttgtttggtctggagacgttggttcgaccttcgccgacctccgtgcccagattacctgcgccattcacatgggcatggccggtatcccttggttcaccaccgatatgggcggtttccatgatgggataattgattcggacaatttcaaggagttgttggcccgctggtgtgcgttctcatgcttcctgccggtcatgcgcaaccatggcgatcgtagtctgcatacggcaaccggcaaggagaccatcactaattcggccggagaccaccgttcgccaagtggtgccgacaatgagccttggagctatggccccgagatggagcaaatcttccgaaagttcattgccattcgcgaaaaaatgcgcccttacactcgagaactgttcgaatcagcacatatcgatggccagcctttggttcgcggactcttctacgagttcccccaagacaagtcggtgtctgatatcgccgatgaatacatgttcggccctgatatcctagtggcccccgtagttgaggccggagccagatcgcgtgaggtgacgcttcccggaaacgctagcatcacatggacggatctacgcaccggcaaagtgtatgaaggtgggcagaaaatcactgtcgacgccggaatagacacgattccagccttcgcgcgcgacggccacgaccatgggctgatcggaatgctataaattcccacacaggaaatgtggggcgtccgtttccaaggcgaacgccccacactctgcgctttttcccatttcaaccggtctatctgcgttattatggcagatttgtagcgggctttcgatcaaacagatgttgagcagttttacatggcatttatcaaagtttttgctttctgccgctccgcactcaaagaattcagccagaaaataccgaccgctttttgcagccgcatcaattaagtgcctgcaaaaagccattcaatacgttgctgtcagcaacacctcggaaagcaaagtaaaagttgtggccaatatattcggaggcatcgccaagcaatgcaaccgtattaaaattcggttcgattaaggttcgataaatctacctcaccatttttgcttatggcgagtcaaaatgcatccttcccacatggctttgctgctttttgtatcttttgttgttatccgttgccacttgtcggtagcggcacggcacgtcagtatcatgtgcgtatgcgacttattggcaatattctgtggctgattttgggcggactgctgcttgccaccagttgggcgattatcggcctggtgctgtgcgtcaccatcatcggcattccattgggagtgcaggcgttcaagatggcgggtttaacgctgaccccgttcggcaaaaccgtggtgtatggcggcggtgtgggatcggtgctggccaatatcgtatggtttgtgttggctggcatatggatggcgattggctacatacttgctggcctgctgaactgcgtcaccatcattggtattccgttcggcattcaatcgttcaagatggccaagctggctttgtggccgttcggctcgcaaatccgcagcttgtaatcacttcagattacttcacccaacatagacggccatcgactgccgtcttgcatataagtatcgaggagctgcggtccgaacggaccgtgaccactgcaccctaggcaacgaaacacatttcatttcgcttatggcagctccagagcggcaaggctcaaaaactgaacagtcgaacattacctacccaaaatgattgctaatgccagccgcgaatcccaccgcagcacttccattcatgcccaggccattcaacaatcgtcccgcatgcttcgcgccggcccataccgcgttgatgatgttgccggcgccatatccggtaagcaccgtccacggatgggcgagcagcccgcatatcgggtcaagactctggtagattcgcgcgaagaacaattcgggtgccggcctgcatcagcacagcgccaatcgcatacacaacgatgaggttgcgcaaccgcttggcatagatacggtcgcgcccacgcataagccacataagcggcagcaatacgccgaacagatgcatgccgatatagctgggctccgcgaacaggaactgcgggcgaccaccgccccacactgagctttcattgatgtactgccggtacatgaggtgcgcgaaatagtcggtcaacggcttgatatgcagatggatggatagccattgcaccacgcccacgccgaaggagaaccagtaagaagcgatgagaatccgcaatggcgtacgccatggaatgcgtttgatgccgaacgcaatggcgatcgcacccaaagtggcgagcacgcccaataatccggtgatgctcatgaacgcggcgttgagatggataccgaatttcagccatcccgggatggacaggattatgcaggccactggtaggaggaacattggcaggtatcgattggctgcgatgcgcagttgatgccaattgcataggcagtacacggcgaacagcgccggactgattggcgaccagaacggcgcgtacaggccgagcgtggtgccgtccaccggaagaaaagcgatggccagcagcagccaaatgacgttgcgttcctgcgttgtcaggaattgcaggaacggccggtatcgcggtcggtatcgcgaccagccatgatggttgcccacgtcgatggtgtcgttgtgtacgcatgcttggttcatgtggttccccctccccgtcaaccttactcgttcatcatgatgtatggatgccacccgttgttcatttgtaagcgcaacgccttcgtcaggcttgtaggtctggcggttcgtcggcgaatggctcggcgggcgtgcggtagccgagcactcgcatgggccggtcgaccttgcgctgtagcggacaggcggcagcccgtcatcattcatcgattaaacgtccacttctcctcaggcttgcggcaaattgttcttccgtgatttcttctgtcaccagtctggaaatgagtttatatagggtatttcgttctggctctggatcatcatcgatatccaaatcaattctttccattttcaggatggccaaggatatggccattgcggtgcgcttgttgccatcagcgaaataatgatttttggctaggtgaaaggtaagatgcgccatttgtcgaaacaaatcttcgaatcgttctttcgacgattgaccgaataccggcagaaatgtcgaatccacaacgccacttacggaaccggcgtcattggctctttccacggtaaatccgccgatgtcgtcaagttgcttcctgtgtactcggacgattgcttgtgtcattgcttctgcgaaatcatcagatggaaaaacgagtggcggcgcttggatatgccaccactcgtcagtgtattgctcaggcattgcgcagaatcctgaaggtgttctgccattttgcatttacttcatccaaactagatgcaagagtgtttttggggaaggtcagaccgtcgtcggatgcgagaatggcatcgttggtgatttcgacgttttcttcttccctgtagacattcttccaagcggagttctttcgatgggagaatctcacaagatcgaatgccgtcagaaaaccatatttctttgccgtcccatctacgacggataaggcctgttcatcctttgcggtttcgccctcgggcttgagaatcctgttgcgtccgtatttttggaaagtgaaataaacgttcctctcaaccggaccgtaaggccacgcttcaatcttgtcttcgaacaatggtttcccggttgcgcgcagagattcgacttgcgcgaaataaacgagcttgttcagcacaagattcgtaatgtcgatatcagagccatggcgaagaatgaaagcattcgctacttgtattgacttcatgcccctcctctgtcatggaaatttctatgttcagatatatgaagcttgctttcgaaaggatgtatattaccagtccttctctcaaaacacaaaggtagcattcaataatgcatttgtcagacgctgtaagaaatccttcattttcagtttggcagcattccgcacgctagggctgtcgacaaggataaggaaaccacatattgttgccacaaaatcatgcgtcaagggatagctacaaaatacgtcgaatagtcgtttgggatttcgaggtggtgacgttttcttggactcccctcccggtcagggagtccaagaaaacgtcaccacctcgtagtcaccagttaatctgaacaccatcggcgttcaaaatggacaccgtcaccggaagccgggatggttccactcttttgtggaccgcgccgatgctcacgctgagccgttcggcggcctgcttctgccgcatgtctcccggcaccggctcgatcgtcttggtccttgtctccagtgggatgatgggtttggccatatggccggcataccgggcatcctttgtcagccagcattccaggcactaccgcctggtcggataacccaggtgcttcaccacctgggcagtggtcatcggcgtggtgaagtacagctccaccgcgcgctcccgttcttcgggactgaacatacgaaaatcttttcgctcagtctccaagaaaacgtccgcagccccctaccactttcgcagacaccggaaacgtcgcgaaacacaggtaaaaagacatataaagatagaatcgaggaaagtatgaagacgctgtatcttcttggcaatggatttgatctggcttgcgggttgccgtcacgatattcggattatttcaataatcgtttttctgtatttcccggcttcgaaaaagacaaaccgacagcagtgactgcgctagaagaaaagcttcagaccaacgactgccacaagattccaagcgcctggtttttcattttcgcctactaccatgaccagaacaacggcaaatgcgcgtcgacttggaaagacgtcgaatctattatagaaacttttacaataaacgagaatgattatataaatctgagcatcggcatgtgcgccgacatgttcgcatacccccgcaccccaacaggccaagaagaacatgtagcgcatttaatttggttatatgaacgtttacgtacaaacgaccaattccaaaacaccgatgttgacgtctacaatcttttcctgaaagaactcaagaatttcgaatccgatttccaagaatatctggccaccgcagtcaacgaaaacatcccctatagggaacgagccgaccaactttttaaggaaatcaccgaagcacaaaccccgattcaagaagaatccttcgcaataggttccgtcgaaaattatgcatctttctccagcggaagagatgaccactacgtcctttctttcaacttcacacgccccttgaccaacagcccaaccttcgccaatattcacggctcattgcaagacaaaaacgccttcttcggcattggaggcacgagccaatatacagaagacgacgatctgcctaatgccgttcgcttcacaaaagcggaacgctctctatctcttggcgtcaccggcaccaatacggatctggattcggtcttcagagcacttcagtcccccgaagagaatttgcgagtcatcaaatttttcggcctgtccctaggcgaagccgactacccctaccttaagcaattcttcgataaatcccacatcacagacacagactccggagtgaactcattcctgggattctattacacgaagggccaggcccgggacgaacttgtccattcgatcaattcgctcctgcaaagatacagctccgacacaggccacaaaccaatcggcggcttgatgcgcgaattacagaataccggcaggctggctatcgaagaattgcaagtcgcatgcgattaatcgccaaataaaaacagcgtattgtcaccagttaatttgaacgccagaggcaacagagtcactcggttgaataagcccgacgcgataccgcgaaactaatgaatggagctgcaaccatctccaagcaaacgtctgtaccccgctaccggtagatggcacagaccaatatgagcctcctttcgaaatagatacaacctagagtctgttcaaaagaagttgggtagacaaggctagtaacgtttatttgaccataaacaagccaaaccgctggcagattagtaacaccattagcctcaccaccgattacgccacagatcccagctcataccgtttgcattggctaccactccggaacggcaagcgtatggcgaaaacaatagcaatttgatatggaaaatccgtgtgatttgaggttggcgatcgcacggattttttggaattaccggggattgttacgtagcacagtgaggcagatgagaacgggaaggataccaggaaagcggtcttccaccatattctgaagcgacaaccattggaatgtccccatcaaagcgtccccaatgggcgccacgcaccgggacacggcccactgaggcagcacccctaaacaccatccaccctagaactcagttcttctggttgggaaccagcatgatctcgccatcggcgatgatcttgaggcgctggccgtacgggctcttgccataacatttcgcggactccatcgcctcacaactcataatccgccgcgctgcgtttgcatttgggattcagagatgttttgacaagaatcgctatggcattccagaacaacgggaatacctcagtcggtctgagaccgtaggattttggaggagagaattcaaaccagaggagagccgtgagcgagaagaaccatgacatggagaacaacatcggcatgagcgccaagcacggcatgcagttaccttcccgaatttcaaatggggggggggcagaggaattccagcattgagctgctgcgcatcatcgcgatgttcatgattctcgcccatcacttcatcgtccctaacggctatgacgtgctgaaactcccttgggaccggagcggatcttcttccagctcgtcatggccggcggcggcaaggtcggcgtggtcatcttcttctccatctccgcatggttcttcctcgacaaggaacagaccatcaaatccaacctgaaacgcgtgtggatcatggaacgcgaactcctgttctggagccttatcctcgtaacgttctacctcgtgttcgaccgagccgacctcagtatgaaactcatggtgaaaagcgtcatgtcattgagcatgggcgtgtggtggtacgccaccgcctacgccatcttcctagcgctgcttcccttcctggccaagggattgaaagcgctcggccgcgaataccacctcgcgctggccgcgaccgtgctggtcatatgggaattgaccagcttcatccccggaatgataggaatcaacgacggcttcttcgggttcatctacctattcatcctaatctccgcctacaagtggtacatggaaccgttcaccaccagacaggtctggctgatgattggcacaggtctcgtttttcctgttgtacacctgcgcctccataacattgtcgctactcgggcacgacatgggaatatatatcaccggcgattggcggttgcccgtcatcatagtcggcttcggcatgttcctgctgtttgaccgtgctactttccacaatcgaaccatcaaccgaatcgcgcagtccgcgttcgccgtgtacctgatcaccgactacgccgcatccgaaaaactgctctgggtcaggttgttcaatctgcaggacctctaccagcagccgctggcgattctgcagattctcggcatcctgctggcgatctacgcggcctgcacactgctcgacttcatccgccaagcactattcgccgtcacaattgaccggcgtcgcggacattggttcgacctgctgtgggatagagcttttgagcggaagacagccaactgaatccccgctggccgattaagccaatacccgatgagttcccattgatataagaatctgactttcccggttaaaagaacatcatcgcttggccatgtgcagtttcatgagttttcccgactggaagagcgacgagttgttgacgccgtggagaatttggtggaggctggcgttgtggaggcgtccggcagcggtgcatcacgctcgtacatcctgagttccaaggtatacaaagcagacaatgcgttgccggcatacgtcaggcagaacaatatttcagcgacacgtcagcgaggattggtgcttgaactagccgagaagaacggcgacgaggtgacatcttcgaagtcatggatttatcgggcttgaactatatcagcacataccgcctactcaagaggatggatgatgaaagcaaactcaggcatgagggcaaaagccgttcctcgagatatctcatcgcgtaaacaggatgtgccagcacctggagatggtgccgccagcgaatggctgcgaagctacctccaagaaagcatccgccccccgtttggccatatggccagcataccgggaatcctttgccagccaacgttccagtcactgcctggtcggataacccaggtgctcgaccacctgagccgtaccacctaggccgtaccacctgggccgttggcctcggcgtggcggaatacagttccaccgcacgctgtcgttcttcgggaccggacatacgaagattctctcattcagtctccaagaaaactccagcatccccaatctcaaacactattaataccatctaaaaaagtcattagatggaataaaaatatgcgccaggtcgactctcactctgtacagtaaattcttcatccgaaagagcgcgtgcaattagatccttcttaaaaggaacatgaattgttggaactgcattcatcatttttttaaaaataggtaagttatcccatagtcttttgacagaagaagaaaaatctctcctcgatgaatcaactatattagtattttcgagttcaggataaacaacaataacaggaaggcgaaggactccaattccatactgaagttcctccctcagagcacgactttcttttgtaatactgctaagaaacagaataatgtttttagaattcataagacgcttatgcagacgaggctttaatgtaccttcccaatcactgccgtctcttacagagtaagttttattatgcgaatcaatgaaaggaaagttcgaatcctttttcttccatgcgccaagaagtgagtaatagcagaaatcatgagcttgtcttgcccccaaagagtactcatcaaatggctcagagacatagaaagcgctataattaccattacgataattcattaatgtcctttcgtgttagttaactattccatatagagaccttatttgcatctttttgatatacaacaatttctatgcacccatttatatcttttttccgaagtaaaagataatttttgattatatcaaaagattcttgatgatctaatttcattcttgaatttgccgtccccataagaggaatcatcaatttggccccctgaccacattgattatgatatgacacagcagattgaagcactgtctcaagatcagtttgagtactatgcgcaacattgttggtgtcaaaagcagttagcgcgactagtagatatgttatattcttacgccgggcaaaagaatacgttccaatcttatactccatgcaattgccacgcttcttctgtaaaggatctattttacgatacggttttccactcatgtttcctaaaacttcattattcagaatctcttgttcacattcctgctttctaagccattgcccatgaagcgaatttggagaaacaagcggtttatcagttgagcaaggatcatcaacaatcgtatcaaaagctgtatttacaggtataaccctaatttcttcatgcttagaagactcgtcaagaatatcaccatatatagcagtgattttattattacctttttcccatattgtattcttctttccgaacattgtctggcacaatgcacctatcccaaagatgacacaagtcgcaaacagaataatgctgttattaatgtctttccctatgatactgatttttgggaaaaaggtaagaagagttgttgcaacaccaaaagagacgctaccccatattgatgcagtctctttgagccgaggtaatcgagaaacaaactttccgtgcataagaaaaaacatatatcattatatggatgaaggtaatgcccgaaaagttgcgcactttggatcatggccgtccatggcgcgatgaccggttcgctgtggattggctacaatgtattagacagtccgatgagggacgaatgacatgagattggaggccgacgatggccggcccgaagcatccccgccactacgacgaggcgttcaaacggcagatcgtgcagctttacgagaacggcaagccggcgcgcgaggtcaaggacgagtacgacgtctcgcattccacgccgcaccgttgggtccagggcatccgcaacagcggctccacgaaagccgccgacaaccgcacccctgagcagaacgagctgatcgagctgcgcaagcgcaacagacagctggagatggaggtggacgttttaaaacaagcggcgctgatattcgcacgaaagtagcagtgatacgggccaacgtctcccgttatccgatatcggcgcaatgcagaatactgggcgttccccgctccacctactactggatgatcgaacatcccgagacggagcgtgcggatccgatcgccggcgacgtgcgcgcgatctggcgcgacagccgcgaacgctacggcgccagaaagatcaaggccgccctggaaaggaagggtgtcaccgcgtccaggagacgcatcggcaacatcatgcacgaacagggcatgacgagcgcgtacgcgcgcagaacgttcaaaccacacaagacgcgggccgacgaggccaggctcgcgaacatcctcgaccgcgagttcgacggctacgagccgcgcacccacctggccagtgacctgacgtacgtgcgcgtcggcggcaagtgggcgtacgtgtgcctgctcatcgacctggcgaacaggagcatcgccggccacagcgccgacacgagccgcaccgccgacctggtcatggccgcgttcgccacgctcgacttccccctgaccgaggtggaggtgttccacacggagcggggcagcgagttcgacaacgcgaaaatcgacgagctgctcgacgtgttcgacatcagaagatcgccgtcaaggaagggcaacccgtacgacaacgccgtggtcgaatccaccaacaggctcctgaagaaggagctcatataccggaaccactacaccagcctggaacaactacgctccgacctcaacgactatgtgtggtggttcaacaaccaaagactccactccaccctcggataccggagtccgaaggaattcaccgaacagggactcgtcctctaagaacctgtccaacacgccgttgccaatccaccccgatggcgttgcccctgcggtagtgcctcgacgaggcggccagcgcgtcgcatctgtcgagcatgatccgtccgagctgcgtgtgggtctcggcctccagcggcgggaccatgaggttgcggcgcaggaacccgaccgcgttctccaccgcgcctttctcccaaccggaataggggttgcagaacatcgcgtcgatgcggtggtgcgcgaggaacgcgtcgaacaccgcggtgagcgtcacctcgcccctcgcgttcctgcgtcccgcgccggtggcgttgtccatgacgatcactggcgggactccgccgatgcgctcgaacacctcgaccggcccgcggcacaggcattccgcgttctccccgggcaggctcgtcacgtatcgcatattcgaatgggggaacgtgacgaccaggcagtggtcgtccacgagctcgccggcgatgcgggccttcgccacgccgaaatcgatctgcgcgacgccgggtgcccagacgagctcgccgtatccgtcggaaccgctccggttcgcctcgcgccagcgtctcacgtaccccggcgtcgtcgtgtactcgccgtcgtactcgatctccgcgcggagcctgtcgtgcacgcgtttggcggtgtggcgctgcttgcggggcagcatgcggtcggcctcgagccatccgtcgaccaacgccgcgtacgggtcgatcttggagccgcggcgccggtccgtgggcggtttcggcgtcatgtcgtccatgtcggcgtatttcgcgacagtggcgcggtccacgttcagcctcctcgcgatctccgacctggacactccctgacggtccagtctcctgatatcttgctgtttgggcatcggtatcgccatcgtcctttccttcccgagcgccgccggctgcaaccggcggattcgtttttgggtcacatctcgggaatatacaggcacggcgggctggtgcctgttttcgtctgggcggtcatacggtgcagtttccgctggaaaccagcagcctatgctgcggaaaaatagtgcagaaattgcttaagaaaaattgaagcaaaacaggagaatctggccgaatcccaattggagaccaaacgcggcctgcagcggcggcggctcaagaccgcccgggcctgccggatgcgcgaatgcttgcaggacatctatgccgacagcaccgacagaatcgaggctgaggcggggttcagggcgttgtgctcgtggatgatgcattcgcggctggagcctatgaaagccttggcccgacatcctcgcctacttcgaccaccggtacgcgaacgcgatcatcgagggcacagcatcattcagaacgtgaagatccgcgcaagggacttcaggaacatggattacttcagcacgatgatcgatctgacctgcggcaaactcgacctacgaaccgtcaccacctgacccgcttcgcccataccaaacaacgaaagaccatttttccttttaggacttaaccaatacaaccatcaaaccaaccattagcgaatcaacttcttcctatgcagcataaaaagagccttcgagcgctcagttgctgttaatgagatatagaacgcgccaatacaaaacagaacaacatatatcatgccccacatcaggaaaaacatgatggaattcaccggtacgaaatacgttcccagcaagcatattcccgtgacgaaaaccgccatgataatggtaggtatctgattgcgccagaaatatagcatatccaaaccaatgtgagtctgatagtaccaattcatgaaaagaccggtccccaaaacaatactcacaatgtatccgactgctgtggcccaatatcccatggaaggaatcaataaaatcgataacacaacatccagcactgccgtgaaaacataaattacactacgtgtcttatgcctgtttttcgcacgttgaatttcaatgccggtattctgtgtcagaggaatcataaccgggaacaccatgataacagccaaccaatatgcgtccacattctgctgtccagcccacagcacaacaaagaatttccctatgattatgaaaccaccatatataaaccagaatattatcatttgataacgtccaacccttgtcatcaattgagttaagaccttgttgtcgttgctatcagcaacgatacggtttatctgtggaatgaatacattagacatagtcgtgctcatggcaaagaatatatttcttatttgcacggcaatagagaatgtggccacaacagtcgatcccgccatcgctcccaaaagaaaattaggaacattattgttgaccaaatcgaaaatctgattgaggaaaatccaaaaactgaatactgctatggctttgaacattgaccattgcaagccggtgaaggtgaaacgcatgcccaatttttttactgcatatacaacattcatcaacagtaaggtcatcgtaaccaccagcatcgccaatgccacacctatggctcccatgccgcgccacactagcagcaccgcaagcagcggctgcaccagcgtagtcaacagttgccgtgtttgctgatagacgaaacactctttggctgtgatatatgaattaaatggactggtcatcaattgcgcagcaacattaagaaccatgagtaccattaattcacgagccagtaccaactctcgaggattcaatcccccggagaacagtaaatccacattgaaagtcaatatcacgccgcctataaggcatagtccaactacaatcaaatagataagaaggaatattccattcagtcgacggacactacttctcgttccatgcgcaatctccctcatgtagaaacgcacgtaggctcctgaaaaacccgcgcttagcagggtcaaagcgaaaacaacactattggtcatttggaacacgccataatcgccttggcctacgaaatgcaacagcaaaggcacatacatcagattaacgaagttcttcgcgattacattggcatatccaagaaccgctcccgccttgcgttggttagccatcccgcttatacctccatggccttgtcaagccatgccctggactcagtgcgatgctgctgcagcagcaaatctactttcctgtaatcaatttccggcgcaagcccatcatccaacatgacggaatcgagttcaaaaagacggaacagtgtttccatgcgggaattcatacttgctttacccttagtgccagcacgattgaacacagtgaactgcctatggaaaagaatggaaaaacagcaggcatggtacgaatcagcaaacacatattctgctttcgaaaaaagctctacaaaatcctccggaccggccacgtatgtttcaggatcgcgaagatcgatcatacgccgtatacggcaaccatgcttcttggcatattcctgaatagtacgttcttgttcggcgctcggttcgcccaaaaaataggtaagcacgtatttatcgtcacgcggaacgaatcctctgacaatagaacgccaatgctccaccggcaccatgagcgtcggatccagcacgaccgttgccggtttcccagacaattcaccaatcagctttgccccttggtcttccctcaccgagatggcggaaaaacgtgccaattgcttcttgaaaatcggcttcgactcatccttaacctgattgattccgaagctcgccgcataacttatcagcttcgtcttatcgctcgtcatatcagcgagtcttgccgacagcacccgattcgatatccaacggtcattccaaacctggtcagatcctacgaccactgccttcagcgcggcaatattgttcgcaatcaaacaagtggatgcatatagcttggagcaaggaacatacctgcgcgtaaatgcttcagcccgatacaaccttttgaaatcgagtgcatgttttgacggcaacaaactcaaaaccttgtgcgctacaggacgaagtagagcaaaaaacctcttctcaataatctcattgggcttgctgacgttcaagaattggtttaccgtactcaccgtaccgtaatcacgcaatacctgctgaagtgcataattttgcaaacgattaccatagtttttaggatcatttacagttatgattccgatttcgatttttgttttcattatttcaccataaacttaaagagctttcttaaaaatgctttccataggcagtcgagtggactgcggagtacggacagattccgggaaatgaccgacttcaatgaacattacgaatatctcatcgtcgggcacactgagaatctctcgcattttagtctcggtctttccatccagcatcgcatgcaaagggcaagaagccaatccatacgcctccaacgacatcagcagcatcatactgaaaagaccaccgtcgataaaaccctggttacgctcgtttggccccatgaacacgctggttttggcagtgacaagaagcaactgaggaggaagggcataaccccgaacacctccctgaagcttcaatacttcggcaatttgatgcgcatcactaatcaacaaaacacgcgcgggctgtcgattgcaggcagacggagctcgagtggcgagtttcacagccttgacgatttcttcttcggcgacgggccgtgcggaatactctcgcagggaatgcctattctccgccaattcgataaacgttttttgtgcattatccgctttttccgctgcggcgacgacaatacttccaccattttcatcggtcgcctgctttgcgcgctcccaatgttcagcgccaagatatcggcgctgttcgctgatatcttttcctgcggcctcgtggcgagcaatatactcatgcactgcgctcatgcactcgcgatagaccggattatcgagataatccgaatcagcagtctccagttttgcaagctcgggcccaagtgctttgaaaacatgtgctccgaatccatagcgaaactctcgatgcccgagacctttttcaatctgatgtgttagaaaaatgattcgagtttgcacttgcataaggccagtggaccattcgcgggaaaaagtcctgttgaatcgcttcgcctgcagattatattctttccgaaggataagcgaagacttaatttgccttagagaattcacaacactatcaggaaaaatattaccgataacatgcttaaaactcatcgaaaaactccttgcttacaatgcagtaaaatacttatccaaaaactcacttgcgacttttctgaaatccgcaagcattgtttgcacaggtccccaatcaatttccccatcggccgtatcgatatccttaattgcgacttgattatcagtgcgacgatcagaaaggtcgaaatctttcaatacgtcggtcagccgtactgaatatcgaggggggtcaaatacaatcatcggtttgttgaagagaattgagaagcatgtgccatggaatgaatccgtcaccacataatcagcatcacgaaatgctgccagccattgctcaggtgttggctgacaaattgattcgcaaccagcagagccgggctttcgcgggctgaaagtgacgatacgaactttcaaacctttttcctcggccagctgctgcgcatagccgatcattctttgattatgattcaacatataaatcaatacatattgatccttatacttcggcacgctatgagaaagctcatgccacagctgaggacggcagagcagaacgggatccttcaacgcaacagaacctttaatacccatttgttcaagaatcgacacgctagagctttcacgtacagaaattgcgtcgaactgttcaagcaaaggtttcatcttcgcggcttcggcatcaggaatagatgggcgtccgaaactagcagagagggaaatctttcggcaatccgaaggaacgttcttcaaggtatatacagggtcaatgcccttgttgagctcctcattccaagtttggtcgctacctacacaatacaccgcttgctcgtcaaatcgaccactacccgcgatgaatggattagcatcgaccaaatgcaactgtctttccacgaaagagcggaatagttttttattcgtcttcaactctggaagtgcgacaaaatatcgaactatgttaatgggcaaaaagtgattcatatccttaagataaatgtcccgcaaaccctcatgagtccacgcttctcggcaatagtcgataaataacggcttgccgtatggtccaagaacatcgcgcgttgccacagcctgtaaaacagtaccataattatatgaatcgattattgttgacacatatatatttttatcaaacatcgtcaccttctttatcttaaagtttttctttgcaatttcgagaacaacagtatttaataaattcttcaaaaccatcaaacataggtttcgaatattttgataaattgacgcttaatgtaaaactgccatcaatgagatgcatggtttgatcaaaagcttcgcaactgcaaattccatttttatctggactctcaaacaaccagaagtattctctaaaaatttctttaggcggtatctctccagcatgggacgcacaataggtcttaaataaattcagagcctcatcaagctgtgaagcgattctcttatcccgatatttcgaaagcggcataagcactctgcatgggttgcctgccgctaccgaatcagcaggaatatcatgtgtgacaaccgagccagctccaataatgacattatcgccaatatttacatttttaagaataatcgcattcataccaatgaacacattattaccaattgaaacctgccccgtatttccgagcacatctccataacgccctttaagaacacaccagtcatatccatggtccacaatcgtgaccccatgggtaatccgcacgttgcgtccaatgctgagattaaaaggataatttagccccaaacaattgctctgcggatcataaaaatatgtgtcatcaccaatagaaactcctttccctctccagtagtcaacaaacgccttcgaactagatttttcgcgaagaatcaatcttctaaataaatctttaatcatttaaccgtcctttaaaatttttctttgaatcttttcttataagtatcaatccagaaccaatttaatacattaaaaaatctgttctgcaatccggttttagttgacggaaggaatttggctttaacaaaacggtcaggacgtatctccacaattggtgactgtactatatcagaagacatgcgcatacgtcgtgattgcaaatgcatatacagatattgtcggatacacacatggtctttgtcccatgaagccgaaaacaatccgtcagagcacaggtaataacgtgctaaatgcgcatatctaagatcctcttcgaatttttgcgtcttagggttgtaagcagtcctagtaatcttcgctttcttaggacttacattgaacgacaaatctttctcatatatctttgcgttatcatttcgaaaaatcgtatgtacattaagccgatcaggattcatcgagcatttaacattttcatcaaatacgtagatacgatttgtcgtaaatgcttctctgtaaatttcacgcccttcaagcgatttcataaaacgacgattgttttcaaagttgtttctatatatagtcaaatgaccagcggcaaaaattttgtcgtaatccttatccagcacaggagataatatcttttcaagattaccgaaaacgagatcacaatcacagtgtccccaatattcataatctcgaatgtattcttcaaacaaaaaaccataagctggcttaaaatcacacagtttataggcagttgtaatgcacggttcaaaacccaacttttgcgaagcgttagtcctaaactcagacagcgtcatcggtactacgtgtacattttgcggataattatacggctctgtgctatcagtaaaaataaaaaaatcgtaagcctgattatagccacatgactttaagaacaaagggaaataattattaaatttaccgaaatacggtaatatcaaagcacattttttcatctcattatcccttcctctgattaatgcttaatgaaattacacgaagcaaagccaataccgcaaagaaatccattccataacttatttcaacagttcctatgcaaatgaatgcatagacgaaagccacacaaataagcatggcaacgttattcgttgaagcatgagtcaaagctgttttgaaatttagtgcaatcaacaagatgattattatggcggtaatgtagcctccatataagatccattccgccaaagcattctgggtatccggcgcacctttcagagcaaaatcgagcacttcatagctgactccatatccgtatcccaaaagcggtttccgagatagcaccttaggaacgacttcaaaaatcagcaatctacccgtcatcgtcacatctttatgaagagtatctacgatgtagtttgccacaaaggtaatatgcaaaaaagacgtggcgatatacatgaaaacataactgagaacaaccgtgacggaagcagtaatgggattataaacgaataacggaaaaatccttcccagaataaaccacacaatcatcagcactatcgcattaatcccggtagtgcagtccaccttcaggcaaatagcaaaagtcagaataattaagccaacaaacagtgtttgatttataaaacttttactgttcttgaaaaatgcttttcgtatcacgaataacacaacaaataatacatgaaaataagcaattctgaatttatttccaataagatatatcccagaaaaataaactgtaacatccgtaatcagcaaaacaatcaacgctactacataaaagacatttagagccgaccgcagacgtcttttctcaaaggcatagtttattactgcaataaattccagcaatccacctaaagccacaattgcggccaagaacggattccgggatgtatagtcatccctcgataagaaagaactaaagctaacaaccgcaaagaacactaaccaaggtacaagacttaaccagtttttatcagaaacaatgacagttaatttcaaacagatgaatatacctacaattaataacatcaggtagcgtatatatgcatatgtctcaataacagacgacacatctacaaaaaccgtcaaaaacgacaaagcatatatccacgtgtctgcttttataggttctctcacaatccctgataatcgagcaccgctcatagcactgtttctattggaaaccataagttatctaccgtcccaataatttagcgtaaaatgtgggccgcccatgcacttccttgggaaaactctgtttccaagtaagcttgaatagcctcgtatcctctgtgagcttggaccaatagctctcatcgtacagctcatcaagcactttgtataaatcatcacaacgtgggttgttgggcttaatcgccgcaaatgcatcagctatgcccttattatggcgttgggcgagcacaatgaggtaatccgtcaacaaataatcaactaaataatcatttaattcccaataatgtaagtaaaaatcacgtaaagcacgaaaaatccatctatttttatttacacaaccaagcgaataatttgcaaaatacccctgtgcaactgaacaatgcaaataatccggacgtttaatcgaaaacataggactgccgaaagccatatctgaaagcggaccagtgcagaaaaaagtggcatccagccataaaccgccatattcagctaacaaagacagacgcaacaaatcagaaagatgtgttcgtgaaataattccttcagattgcttctttttaacccacttcggaatcttgatatactgttcgacgttctgatcagtaataatcgtgacctgatgattacctgcattgtggcaaatagattccacacaacacttcacaatttctggggcattctcaagcccttgccaccagcaaatccaaatgcgcccttccatatctggatcgacaggagccatcggtgcatcataatcataattacgataaaaatcgccgtatcgctgttcgaaatatttcaacataatctcatgcttacgaatcaatcgatcgcgcacagcaggaggctctgcgaatccgttatgattcattacctggatatcccatttcgcatgaaacgtctctagagcatcattccatgatgtatacgaggcgatctctttggtggaccgaagctcctcaccgacccgatgaacaattcgttgaatactgttatgccccacagccatcacttccaccatcctttctttttcagaacctgccgtgcctccgccaaaacaaatacttcccatgcctggccgctgcaaagtgcttcatgaagcattcgctgttgccttggtaatgtctccaagggatatcccacacacgcttcaacacacatgtggctctgtgagagtctacggatgttccttaatttatcccgtacagacagaccacttccaacaattagccccacatacaaacggcaatagtcaatcgccatgcgctttgttcgcatgatgcattcatcatgctggtagggctcttccttggcaagaaattgcaccgtatcaacaaattgttcgtattgtgtaagtttttttgaagagaatgagcgcattatcgatgaatggtcgtccattcggtaccgataatctgtatcaccagtaaatgcaacaacatttgcacaccgatacgcagataagttaaaaattgtatcttctgatagaattgcttggaattttaacccattcactttcaagaaatcatttcgataaatcgctgtccaaacccgcataggaaatgattccacttcagtatcttccggaagatgcccaaaaagcctattccgcacaggcagaatctgatcgcttccccttaaaatttgccctgccaatggatgcgctttgacagctcggacactcccattgaccatgtcacagtgacctccgacaacaatatccgcatcgcattgcgacgcggcatcataaaggctactgtacattgtgggagcaatccagtcatcggaatctacgaagccgacatattcaccagtcgcattggcaataccagtattacgtgccgggccaagacctgaattcttttgatgaacaactttaatgcgagaatcttttctagcatattcatctgctatcgctccacaacggtcagggctaccatcatcaacaaggatgatttcaatgtcttcaagcgtttgaacttgaatgctatcaacacattcctgcaaaaaaggttcaaccttatatattggaacgacaacactgactttaggattattcatcacttatcgctcctctccctgattctttgaacgcaatttagtcaagccaaaatatttccgttccaactgcttcgcataggcttgctgtctgcagtgcgccgcgacatattcggcacactgatgctgcatcacgccatacgcggattggccaaccgcggcggctttaagcagaccatccctcacatccgtgatgtttccggattcgaaagtaaagccggttttgtcttcctccaccagctctggaatgccaccgatgctggcaccgatgattggggtctgggcagccaaggattccagaccggagtacggcatgttctcccgccactcggaactgagcacgctgaaacgggcgttgccgacttcccgctgcaggtcctcgccgctcttgtaccccaacaagtgaatgcgagactcggcctgcgggccagctgaggcgatcagctgctcgatcgcctcacgttccggaccatcacccacaatatgcagatcccacgcatcaggaagcacctggacatcctggtcactgctccgcatatcggcactcccattagcaagcccagtggcccacaggaacgccttcaccaaggtaagaatgcccttctctttggaaagtcgcccgaagaacaggaaatacggcctcgccccagactgcgcgtcctcgaatttgtgcgtattcgccacacgagcgcccatcgccatctgcgaatcggtcaggaagttctgcatggcgacggttttgcctgcgaaacctccctcgtcgagcttgctcttcatgaatttcgacggtgcaactatcaagtcaattttgtcgtacgcatggtggaattttaggaattccgcctccatggtcgccaaggcgcttttggtacgggaacctttcacacacacgttcttcacagcatgcatgaaatgtttatccaagcaagcgtcgcacacttcaccatgcccgttgaccatagtgtatgcggggcaaacaagaatataatcatgcgccgtatacaccaccggcacatgatgtttcttcaaatacggtgcatcaagaatcgagagcgtcagctggcgatgcacattgttcatgtggatcacatctggcttgaattcctctagcaaagcttcgaacttgcgtctcgcttcaaaagagtaaatcagtgtggaagcttcctgaaccttcttgaaagcggaaatatcccccacataatccttttcggaaacaaaatatttactccaataacttgactcgttattcgggtgctgcatggagaagaacgcgacatcgtggccgagcgcacgtaagccttccgacaatgcgaagaaataggtttccgcaccacctttgcgatagaaatatttgttcactaggagaattcgcatgctcactctcccccatacaggttcagtgtttgatcggtgacgtcatcccagctatatttgctgacgatgtaatctgcagcatttgccttgtaacgttgtacaagatcatcgttttcgagcaattcctgaagtttttcccgcagggattcaacagaaccatgctggaatgtcgctgcgtgcccttccactacctccgcacattccggaatgtcggacgtaaggcagcagttaccgtaactcatggcttccagcagactcatcggcatgccctccaagtcgcttgggagcacataaatataagcattgctatagagctctttgagtgcctgcccttgtatgaagccggtcaaaataacacgagaatcctgattagccatctgctgaatatgctggtaatactcgttggagtcggaagcgcctccagcgatgacaagctttttgttcgtattcagcttgttgaacgcctcgataaggtaatgcacgcctttctcgggaacaatacgcccgagaaacagtacatagtcgttcttgtgaagaccatatttttcggtaatttcctgcgccgaaaccggctcaccatattcaatgccattgggaatgaaatgtgtaccgcgaccatatttttcttgaaaatactgccgcatgctttcgctgagcactatgatttcatccgcgcatttcactgcggtacgttctccgaacttgagatatgtggaagcgaacttgccccatttggcacgctgccagtcaagaccgtgaatggtcgctaccgtgcgaatgcccgtccaatgcgccagacgcagcatgacgcagggaccttcggcatgatagtggatcacgtccggtttggccgcaatggctttcagcgtcgcaaagaatgaggaggtcaacgccgccaaacctttcgcttcaaaagtcggcactggaacaacacgcacgccgttatatacaaagggcttatttgcggaatgaacgtttccatcgaattcggcgcccgcaacattatgtcccttgcgattgtatgcgatgaccttatgcccctttgcggccatacgcgtagctagttcatctacaacgatttcgatgccgccttcacgcgaaggaatgcgcttatgacctatcatcacgatactaaccatcaccggtcgcccttagttattcagaatgccgggataatgccacaagcgttatgcatggcagcggattgcacagtctgaccactagccaaaccgacgtaacggccgttatcggctcttcttgcaatcgatcgacctgtggtcggcatgcgagtcccgtcctttccctccaaatgaaccccgaattggtgtttttcaagcgcaacgcgaaacgcgcaggaactgccaaaccccgttcattatctgccaaagtcgatttttacatccccctcagacacacccagccccccatcactcacttcgggggtattcttcacgggttttccatgaacactttgcttgttcgtgacttaaaaactgtgtttggaatctgcttcagtcggttttccggacgtttctaaatgagcgaaaagagccgataacggccgttatgtcggcttagtcccggttcgaggacggtaatccagtgccgattcgcgtagcccaggtcatgggaaagatgcttggcggtggtgtcgaatccgtagtgatgaactactaccgccatatcgaccgtagcaaagtgcagttcgattttttggtggatgccgattcgactcgcgttccagaagaggaaatcaaagcgttgggcggccgcgtttttcgcatccctccataccagcatccccttcgctaccgcaaggaattggtcaggcttttccatgaggaacactggccgatcgtgcacagccacatcaatacgctcagcgtattcccattgtctgcggccaaaaaggctggagtgccggtccgtatcgcccactcgcattccacgatgggcaagggcgagtttgccaagaacctgatgaagcttgcactgcgtccgctctcgaacctttaccctacagaatgtttcgcatgcagtgaatacgccggaaaatggctgttcggcagagacgctgacttcacagtgattcccaacgccatcgaactggagaagttccatttcgacccagtccttcgccaggaaacccgcaaggaactcggcatagccgatggtatgttcctgattggccatgtgggtcgtttcatgccgcagaagaatcaggctttccttgtcgacgttctcgccgagctccttccccagaagccggacacgatactcgcgttcgttggtgacggtccagacagaccagacgtacagcagcacgcccaagaactcggcattggtgaccacattctgttcttgggccagcgcacggacgtcaaccacctttaccaggcgttcgatgctttctgtctgccgagccgttatgaaggtctcggcatggtcgccatcgaagcccaggtcgccggatgcccctgtgtcctcagcaatcaggttccgcacgaagccgatatttccagaaaaacatctttcataagcttggaaaataaatcttcttggatttcaactgtactcaacatttcctcgcaaacagcgaatcggcagattgaaacatcaaacacatgtgctgaaaaatatgacatttcagccagtgcgaatcgtctgacctctctgtacgtaagcagtgcggaaagcgcgaatggatgggaggaaacgctgtgaatcctcgcgttgctgtaatcacttcaggctatttgccagtaccgaatgttctcggcggagctgtcgaagcattggacatgatgatggttcaggagaatgagaagactccgaattttgatttcactgttttttcttcttgggcacccggcgtagatcagatcgtgggtgaaggtaatttcaagcatactgatttctgctttatcaagacgccattgctggttcgcgcggcggatcgttgcatttattgggcagccaaacatgtgctccacaaaaagaagctcatgagctatcggtatattgcgcaacgcctgtggtatatcaacaaggtttccaagaagctcgcacagcccgcaaagaatggcggcccagctttcgacaagataatgatcgaaaaccacgcaacattgttcatgaccatgcagaagcacggtaattccgagcgatatgcgggaaaagtgtattaccacctgcataacgaagttcttaatgatttcggctgcattaaagagatttccaaagtcaaaaaagtacttggagtttccaaatatattgttggcacgcttgacacgtatttaagagagcatggtgagcctggtctgcgcgaaaatcagaaagctgtatggcgtaatggcgtcgacacaagccggtttggttcggaggaggctaatagcaaggcgattgaatttcgaaagaaattcaatatagccgagaatgatattgttttcctgttttccgggcgtcttactccggaaaaaggcgctgaagaactattgaaagcgtttactgaagtagcgcagaaagttcccaatgccaagctggttgttgccggagctttcttctttaattcgaatatcgtgagtccatttgaacagaaacttcgcgatttagcttcaaatcctgttgtgaaggatcgaatcatcttcactggctttgtgaattacgaagatatgccagctatttatgccatggccgatatatgcgtattgccgtcaatttgggacgatccagcacccctcgcggtaatcgaaagcttggtttctggtaagccgctcatcaccactcgttccggaggcatccccgaatacgccgatgggcagtcagccatcatccttgaacgtagcgatcaacttgttgaccagcttgctgatgctatgacaaagattgctcgagactccgacgaacgtgatgccatgggcgcgcataaaacagcattacgttccgaattcaataaagaaacatacatggcacaattagccattcgtctgaggtgactacgtgggtaagtacaagaatctgctagtcaatgtcggcatcttcggactcagcgcagtagccaccaaactgatggcattcatactgatgccgttgtataccctgtacctatctacagaggaatacggcatcatggacatggctaccatcatggtgaccacattattccctgtactaactctgctcatcagcgagggcatgctccgttttacgcttgatgataagtcaaaagctgcgttttatattaccgaaaccatgctggtcatgttggcaagctgtgtgcttttggcaattattctgccagtatttgatttgcctatttttggtggattaggtagatataaaatttggttcttgttgtcctatgcggcgttgtgttttccctctgtgatgggtactgtcgctagggctatggatcagatgaaactcattgcttacgcctcaatattgtctgcgcttattatgggcgtgcttgcttatgcgttgattgccggaatgaatctcggtcttatggggtatttctactcttatatcgtaggcaatggttcagcgatcctggtatatcttttcgccggtaagcagtatcagtttatcgattttacagtatggcgaaacaacgcgtctcttcgtaagcagctttggcgctactcgctgccattggctccgaattcattgtgcaaccagattcagacgacggttagtcgtttcatcattacaggcgtactgggtatttccgcttctggtttgtatgctgcagcttcaaagattcctaatttgcttaatgtgcttcaacagattgttcaacaggcttggcaactttccacgttccaagagtttaaaagctccgggctcaagcatttctatgatgtaatctggcgtgtgtaccatgccctgatgtcggtaggaagcgcattggtaatcacactctctccgttcatcgctagggtgcttatgcagcgccagttttactcggcatggcctcttatatccattcttgtgcttgccttttatcttagtgctatcaacaactttcttggcacgatttatcaggcttatatgcgtacaaagccgttacttgtggctacagttgtgggagctgcagcatgcctcgcatttaccgctatcctcgtacatgactggggtatttcagctgctgcattcggcgtgtttgtcggtagcttggtgattttcgtggttcgtgtgattgatgtgcgtcgtctgatggccatcaatatgaggccgattcctacggccattaccatgacgctgcttactgtccagtccttggtaacctcgaatcaatgtaaccattatctattctggtcatcgatttgtctgctgcttattgcattcgtgcaatgttatgaacttaagcctcttattactctgatattcacaaggaggaagtacacagcatgagtactaatccatctgccatgcctgagaaaacccgaactgaagatctccccctgatttcagtgattgttcctgtgtacaaggttgagcgctatcttgaccgttgtatacagtcaattgtcgaccagacgtatcgaaatttggaaatcattctggtcgatgatggctctccggacgcttgccctgatatgtgtgatgcttgggcggcaagagattgcaggatccgtgtcattcatcaggagaaccgaggattaggtgccgctcgaaatagcggaatcagaatcagcaccggagagcttatcggtttcgttgattctgatgattggttagaaccgactatgtatgaagtcctatatcgttctctcaccaaagaaaacgctgatacctccatgatcaccggtgtcttggaatatcctaacggacgacaaatatatctttatcatcctgatttacatctggtaatgaccacttcggaatcctttaaatacattaatctgccaggttattcgacaatctctgcttggagcaagctcatcaaacgttccactctaggaaatattcgtttcccggaagggtgcactggcgaagattggcaattcacctacgatatacttgcagcgagcgtacgaactacttttgattcaacgccgcagtaccattatcgacaagttgcgggaagcctttctaacacgagcacaaatttcaattttgctggttacgaagctaccaaaaacatggtgaaactggtacatcaaaaattccccgaacagcttccttttgcgttgtatggacaaatgagaagtatggtgagcctttatgatcaggctcttgtcacggggcatgctaaagaacagcaatggcgagatttcgcagaagacactcgcactttcgtcaatcaaaacatgaaagctgttactgaatccgtgacgctccctcgtgggcgtcgcctgcagctcaaactcatggccatctctccaacgctttatggcgtgtttttcttacttcataaacgtattcatccggaacggagcaagtgaaaaatgagcattaaacaacttgcgatgcggttagtttatggccacaaggcttcatcggagcaatacatatcatggctccgaagccagggagtacacgtgggacagcatgtgcatctatatacgccatggtccatcagaatcgatactcagagaccttggatgattgaaatcggcgataacgtacatatcaccgcagattgctctattttgcagcatgactatagctgggcagtaatacaacgccttacgggtgaagtgctgggatcatgcggaacggttcgtattggcaataatgtttttgtcggtcagaagtcgttgattctcaaaggagctgagatcggagacaacaccatcatcggagctggcagcgtggtgacaggccgtttggatgggaacgctgtatatgccggtgctccggcaaagaaaatctcttccttggaagcgtatatcgacaaacgccgcaaacttcaattaaatgaagccgtgttattagtacgtgagtacgagcagacatatggaaagcggccgccaaaaaagctacttcgggaattcttctggctgtttgagcctaggaacactcagctggatgaggtattccaaaaggttttccagcttgataacaataccgaacgttcacagcaagcgtttgttcaaagcgaacctatgtttagcagctatgaggcattcctcaaatacgttgaatcaaattcttaacagctagcacagagaaagaggcttctatgaaagactcaattacttcttacaccattacctgcagcagaccaactaattatggcgctgttctgcaaacttacggcttgaacaccgctctacgcaagatgggtgtggacgccaaggtgctggattacaaccccaaatactactacacgtctacgcggccgctgcctattcgcatgcttcgcgccatcgtacgcttccctgatttggtcaaggggcgcaaagtgttcggcaaattccttgaggactacatacctatgagcgccaaaacttaccgtacgcttgccgagattgaggctgacaccccccaatccgacgtctatatttgtggcagcgaccaaatttggaactgtaagaacaagcttaatggtaaagatgatgcgttcttcctgtcatttgcgcctgcgggcgctcgcaaagtagcgtatgctgccagcattgccatgcctgaaattcctgacgatcagaaggatcgttatcgtagactgatttccgatttcgatgccgtgtctgtgcgcgaaccgtcgtcggtgcccatgcttgaagatctcggcattagtaatgttcaatccgtcattgacccagtatttctgcttgagaaggatgattggaacgtaatcgccgatgccagcgatttcactcctactgaagattacgtactggtgtatggctataaccgccagaaagatgtatacgcttatgcacgtcggcttgccaagaagctaggcgtgaaagtctataccatcggtactgccatcgaagattacacacttgatcaggaccgttatttttggaatgcttctcctaacacttttgtgaacctgattcgcaatgcgaaagccgtggtgacaaattcattccatggcactgtgttctctattgtgtacaacaaaccattccacttctttacagttaagcagaccacaaattcacgcatgctcgacctgctggattcgctggcgttaaaagacagacatgttaccagtggcgacctgctgagcaaccacatcgactatacgcagccgaatactctactcgcttcattacgtaaacagtcattagcttatttacacagcagcgtatcggaaccactaaatcagcattaatcaagagtccaaaggaatgtcattatgaattggaagagcactgtagaacagtggatgccaaaaccgcttatcgctcctctcaagaatctgcgtcaaagcattcatctatatcaagattcgtgggcacaagccaagcggtttaatcgtagctactctcgcattatgccccatgaacgagtaagaatcgagacacgagtgatgtttctcagccatcaaattgaaaagggtctgagccatcacaattttcgctatgggtttgggaaaaaagtttttaacgagcttccgaccctgcttacacgtctggaacaagcagatctgaatttcgctaataacactgtgtacaaagaaagtcttgctgcgcttcatgagtacatgcagcgtcatctcgatgcggagaaagatatttcttggcagcaatcgttattcactacagatcagtggcaacacattatgaatgccgaatcaaacgatggtggaagcatttctatccgtaaaagtgacaagctcaataacaaagatctttcctttgctgcgttaagtgaaaatagacattcagttcgtgaatttgctgatgagccggtatccctagacgaacttaaccaggcaattcagatggccatgcgcactccatcagtgtgtaacaggcaacccaccagagtgcatgtcattctcgacaaggaagttatcgcaaaggctttgcacattcaaggtggtgttaatggatatccagcccctcccgcattgctgatgattacttctgacttgcgcgcgtttatgacatcttatgagcgcaatgagggatataccgacggtggcctgttcggaatgtcactactattatctttggaatctttgggaattggagcttgtccgctcaataccatgtttacggcaactgcagaaaagaaaacccgcaaacttttgcatttgcctgataacgaagtacccgtcatgtatatcgaagttggacatttcttggacgaaacacgtacctgtcggtccactcgattccaaggctcagatattacctcggtcttgcagtaaccacagactgatattcccgttcgcgtacttgcatctgcgtgatcagatagtcgcataatcagcaaggagtcttccatggatgcactctctgttttcgtcactacatcattgctcaaagctggagcgcaagttgccggattgccattgacgctgaatttgctacttactgcatatgtaattcttcgtcatccaaaccgaactttattgatgatgaagaggtttcgcggattggccgtggcttacggagctctgtttgcgtctggtctgccatacatgtctcaagggcggatgtctttagacatgtatggcaatggtttatgaagcgttagtcgtatttgatcaactggctatgctgtttgttctatgggatgaattttcttgaacaaaacccctttttgtgaatataaaacatcaaaataaggaaaagaatgtttatttatataacatctgttttctgctgcatacttttggtatgtgttgcagataaattaaataaaaaagcagaggttttaccttttgctattgtttttttgattttatttacaatatctggattccgatatggagttggaacagattatttttttacatatgttccaacttataaacagatatataatggcacacctccaccaatggagccaatatttctatggcttaacaagctatgcattgattttgcaggtagttggtatcaatctatatttattattacaagctttattttcataggtttaatatatattgttatatataatatgccatgttcaaaagttctactgactgtttcttttttgtgtggtgggtatttcttatactcatttaatgtggttcgccagacaatagctaccgcactattctgttgtgcattattgtttgtggaaagaaatatggatggcaaaaaacgattacagagtctttttgcagcttttttcttggttgcgatagcggtaggttttcattattccgctctaatttattttgttgttatcactctcctctatctaaagcttgacaaaaaaatatatttgtccctttttttcgcttcggctgttctcgtacctactttcgttgcagttattggcattttgctcaaagggacaaagtatgagaattatatatccggctactggccagatcccagcaaagcattttcattatcatctttactatttgtaggtttcttctttgtttatttgtttacggaatctaaagaggatgatcattggtttaatatttttagaaatttacatttcataggatccatagctattatgattggcctgtttataccactaggtcagagagtttctgcattgttttatttgcttaattttcttagcataccgtactatattgaatactatataacagaaaaaaataaaatgcttataaagatattatatttatctttttgttttttcatgttcctgcacacattggcagttaatggaaatggtattttaccataccatttcgctatatgataagttaatgtgaccgttggttgcgatgcttttagattgagaagcggggagtttaattacagtatgggattttgcctcaacgaagtttttgaataatgcttggataatgatgtattgtgttttgtaaagaaaagaaagtaaatgaggagattatactctaggctggctgcactcgattcgctacgaggcttcggcatactactagttgttttgggacacacatcatggtctgctggtctggtgtcgtggattttttcattccatatgccattgttcttcatcatttcaggaatgctgtttcacgaaaggcagtttctggattcattcaagaggagagcgataaggctactcgtgccatacgtgttcttcggaacggtgactcttgcgtattgggctcttatcgagcgacgtctcaggggagacgaaggatctgttccgaatgcgctggcaaatattgttctcgctcgcgcaggtagcgataattacccgcagaatgcggcgctttggttcctgccatgccttttcgttacggagatgcttttcctaggattcttccttcttgtcaataaagcgggttctgtcgagacgaaaaccgtaatggggggggctggcgtaatcggattgccgtcatggcgcttgccctggtcagtttcctttcgatcatcgtcatgtggtcccttgacctgccggtcgatcagttccgacttccgtgggcttttgatatcctgtccttctccatgctgttctactgcatcggttacttgctgagtgaattcattctccctcacgtgcaataggcctcccaaacgcaggcgttggcacatattgcgtttgctgttgtcggcgttgctgggctttatcttctttggctgttcgacggttggaccaagctggaggtcaatcttaatggagcatctaccaacaatccgttctggatgctatgtgccgcaatgcttggtttcgcatcatcgctcatgctttgcattgctatcgactgccggctgctgcagttccttggcagggcgtcgcttaccatcatgtgcgtgcatgaaccggtgaaacgagtgctgatttttgttatggcgaaaattcttgggatgaatacagatgcattgcgagcgaatcttgtatatgcgatgctggtgactgttgtcactgtagctatctgtgttgctgttcatctcattatggacaggttcgctcccgtgttgatcggcagttcccgtcacaatctggcttcgcaaggcaaggcaagggcatgatgggagaacatttgcggttggcatcatagttgcgatggaacgtcgctttgtcgttgtgatacctgtaagaagtcggcatctcgatttcgctttgcccgttaattgcattcatccgcaatggtggcgtcagtggtaacagatgatctgccgcactgacaccactagcaagctcagctaagcgttcgcccttcctgcagatgtttaatttgcctttcgactccgtcccacaccagttcgaaccagcggccacggttgcggtttacggtcactgcaaacagtccttgacgcatgaagtcaatcagagtgcagacactaaatagatcgtcaacaggatgccgaggatttgcagaatggcgaaaggctgctgataaaggttctccagcacgaacaggtgcttccaaagcaatgttctcgtggcgggataatcggtgatcaggtaaaccgcgaatgcggaccgggctatgcggttgatgatccgactgcggaaggaaagcgggtcgaacagtagaaacatgccgaagcccaccatgatgacgggcagcttgaacgatccggcgatgaagatgcccttatcgattccgaacaacgataacataacggaagcgcatgtgtacaagaggaagaatcccagtccggttccggtcatcagccaagtctgtttgagcgtgaacggcttcatgtaccacttgtacgcggagatgaggatgaataggtagatgaagccgaacacgctatcgttcactccaaaagttccgggaatgaagcttgtcagtccccagatcgccagcaccgttatggcaagcgcgtaatgcatatgttcgccgaacgcgcgtagccccttggaaaggaacggcagcagggcgaggaaggtggcgtatgcggtaacataccaccacattcccataatggtcggcgcgacgctacgaacgatcgttttcataccgaagtcagcacggtcgaaaaccagaaagaatgccatgagagcaaggctccaaaacagcacctcgcgttccagaatccatatgcgtttgaggttcgatttgatggtctgttccttgtcgaggaagaaccacgcggagatggtgaagaagatgacgacgcccactttgccatcgccctgcatgacgagctggaagaagatcctctcaggtcccagtgaaagattcttgacgtcatagccgttatggacgacgaaatggtgggcaagaatcatgaacattgcaacgatgcgcagcagttctatgctggaattacgccccccaatttgaaattcgggtcggcgggacggccttatgggaggccgtggtctttgagcctataatcatctttcccttcgttttctcttatcttttccaatacccccaattatacccgtccgaaaagaccaagttatgaagctggcctacggccatcgacaggcccgcaggccgcatcgacgacggatacgaacctcgatcttacaacagcaatctatggaaaaatcagagacgaaaataaccaagcaaacaccccacacatgtagacaacagctaacgtccagatcatacgggaaaaactctggtttgcttccgtatctcacttgcatatggaccggcacggaagcaagaaaccacaacacgcaccaccaaaggtgggtagccattatggccatccaccttcttcttaaggagcgcaaacgatgcaatcgacgtcaaacatatcggcaagtaaaaggcatacagaatccaaagctcacaataagcatgacgcgtttctcagctcgtccgtgcgagttccatccattcgtgaagctcacgcgggaaatccaagcccatctcccggtaaacagagtcgacgtacgcaggtatgtcttcacctaaatgcatgagcaaagaattaaattgctggaggaattccagataacgttttttgtcgattacgaaacgtaaatccttaacaagctggaaaaccgtattgttggaatcatgcggatgcgcacaataaagacgttcatcgtgcgcgcaaatattacgaaaatctttcattctgcgatatatcttatcgatacgttgtgcatcgatttccgtcttatgcctgtgcgaatctccatacagaactgtgaaactcctagcaattgaaccgcgaatcaatatattttgagactgaaagaaccaatatatttgtcccaaagttagatcattggtcaaaacccacaacggcacctctccatcgtgctcattgaggcaatgaacgagatattcttttctgccttttctctcgcaatcactgttgtcagtaagtatcttttgcaatcgcggaatgagctgacttgccttttcatgagcttggccggtacgagcataattgtcgatattaaggtaggggttcttctcagccggatttgccttggtgaattcgtatgcgcagactgttttcagaatcgcctcagcaatcgtgatcattccgaaaaggagaaaacggagctgcctatcaaacaggtacagcttatacaagtcattgtatgaggatccttcgcgatatttgtcttcttcatcttttttcgcgcttgattatcgagaaacggttttttgtatccattgacagtcgcgtaatatccttcgcgctcaagaatccatgatgtcctagaatccgtttgaagtcctcgtgaattgagaagagcgatttgatcttcgatcgtggtaaaaggtttatgcatgaagactccaatcaaagcacaaaggtcgtctttccaagaagaaagacgacctttgcgaactggacaccgcccagctttatcacaaatggttaatttatacgaaaaatggctgtttttcgacttcggcgtgtttcacatagtaagcgtccaaacagttccgcactgcccaatctcactccacattgatgaaaaactctttgctccgtgcaatacatctcccatcgcacacagccgaaacactcataactagatcatcgtagggagcgctttcctgcggaacaatgtcaatgtcaagattcgaacgcgacttgtgcggccaaccatagtccgtccacacaagtcgcgttccatgtctgcacaacccgagaaaagggcggaaaatactagttgtgcagacgcgacgactgcagatggaccgttgcgtatgcgcagattgcggaagcgatcaccagcagcagcgagatgatggcgagcgcctggactgcggatccggagcgaggcatttccggcttctctggcttttctggatcaccgggtttgccaggttcttctggtttttctggctcggcgacggctttgatggttaccgccacttgtgcgcttatgccatcatggtcggaggtgcgcaactgtgggcccgctcccccactcgagtttgtatctataacatcatccgcaccattgcgcacggcggtgatggtgatgttctggctcacggcttcgaaggctttcctcttctcaaccgcctgcattgcgcgatcgatctgatcgttcaacgcctgcaactggtcactatccaccacaagacggtagtcggcgatgccgttcagttgtgtttccgtcaactctagtaggtcgtcggcactcagctgctgaaggccgctcgcgggatccaattccaccgaagtctgcttgctggagatcgccagatcgccgacatggaacattccgtcacccataccatcaccgctagtgccgcctggaatcagcccaagcgagtcagccaagtacggcgcaagattcgacaagtcggagaacgagccgctcaacaaggcgagcgtgttcagtccagctggaatcatgccccggtattcgccaccgcgaacagtcacatagccaagatttttagcgtcatccagcaggttgaaaagcgtcggtgcggtgaatgttccgcccgaaaaactgccttgcgcggaagtttcatccgtttcggcaaaccgcatcaacgttgcatccgaggtgaacgtgccaccctccacgcgcaatacgccacggcaatcgactgcaggctgtgttccgcccgcaaccgttcccggtccgacaatggtgagctgcatgttcgcaggcacagtgatcgtagcaaacccagcagctccaccggattcagcggcttgcagcgtatgcccgttcaggtcaaacgttacgtttcgtacgcctttcggtggcgtaatcgtaacgctttccgtcacgtcggctagcaatgtgaccgtcgtgttcttcaacgttgttcgaccgatcgcctcctgtacgctcgcgtaggttgcgttgcccacttgcgcgaccgcctgagattcggcgacatcggcaactgcatcggcagagaacagcagcgttccaaacagcgacgcaatcgcgaaaacagcggtcagcaccaccgaaaccaaatacttaccttgcgttcgcgggcacacattcacccgcttctcatgactacgcatgattatttccttttataggttctattgcatatttcaatccgcaccgaagtgcgtgggaccaccctcagctgtgagggatgacgttacagaaatcatggcgccatgctgcattaattatctcacaatgcgcaaaggaaagcaaattacatattttgaaaatccaaatcttatatgagatatatcaaaagacaatctttagttatagtggacctcatcacataagttaaaactgtttcacatgagtatcacaatattcctcacacgaataaacgtatcccaataactgcaaaatatacatatgacgaataattgtttcccatcaagaaacaagcgagcccacaatcaaacaagcgaggtcgcaaccacacaaaaacacatttcccatctgcaccacgtgggaaagcaaaagagcgctccgggagggagcgctctgatttgcacgacgattcgtgcgaaaagtactgcggaatttagtaagatccggtgccgcggaagaccacgagcacggtttttgcgagaatcgcaagatcgcctgcaatggaccaattttcgatataggaaacgtccaaatattcgctctgctcctgcgaaagatccgaacggccggaaacctgccacggaccggtaataccaggcttaaccagcagtcgcgcggaataaagggaaccatagcgagcaacctcttccggcaaagccgggcgaggaccaaccaaagacatgtcgcccttcaaaacgttgaagaactgggggaattcatccaacgaagtcttacgaataaaacgaccgaccttcgtaattctcggatcatccttcattttgaagatgaaacgatcggtctgtccattttcttcggcaagtttcttcttcaattcttccgcattggtgaccatggaacggaatttatacatggtaaacggcttgccatgcaaaccgatacgctgctgcgagaagaaaatcgaaccaccgtcatcaagcttgatggcgatcgccgtacccaacatcagcggcgaggaaatcagcagcgcgaaagccgaaccaacgatatccagcaggcgtttaatcacgtacgtcgtattcgtatactgcggcaaactggccagcaataccggctgttcggccgtattacgcaagtacaggcggtggccgctcacgtcagccaaggaaacagccaacgcaagctccatgccaagcgactcgaccgcaagggaaatgccatgcagcatttcggaatcgcgggacagcacgtcggcaacatacacttcctgcgcacccaagctttcgcacgtacgcgggaaagcggcattgaacggaatcaccttcagcttgtcggcaccttcaatggaaggatcaggctcgaacgacgtgaccacataagcgtctttctcattgtcgtcagcttcgatcggacacacggcaatcggcgaatacccccaattggagtagtcccgcatggtgcgcaacgcacaattgataccgtcggaagaaccaatcaccacggtcttatacttacaggcgcccttctgacggctgcgatgctgccactgacgcatctgccaacgggcgatgacttctaggaagaatgcaatgatcggggcgacgataagcgcggttctcggcaaggaaagattgaaaataaaagcaagcgagcagtaagtgatgatggtgagcagcgacgcgttgatgattttcgcatacagctcgtagccttccgccatcacatggcgatgatacgttccggcaaaggtgaggctcaacacccagatgaggctgaagcagatgaggaacagccagaacggcatggccccattgatggcattatatgcggcatcgttggcccaaagactgatggatagcgaaatcagcatgaccgcaagatcgaccatcaccaagcagacgacaaaagaataacgccatgcgggcacaacctgattccgcctgcccttgcgctttccatcttcaccaacggaaaatggcgtgttcgaaaacatcatcggctcaaactgagggctgttgtcttgagactgatgtcgctcctgcttctgatcctggtgacgagagttagaagagacgatatggatttcctgggttctcactacttgatccgaaccctgctcagagctgcggaaaccgccttgcatgactcctccttctactaactacccccacccgaaaagaagggggcttccctccatgaagagatagtatcataagccctgttaacagagtagatctccaactcgcttttgcggttaaatgactattggaaacttgcttttgacgcgataccgcgaaacgcgcggcaagaacggatgaaaagttgacgtccgttccgtgaacgtgaggctacatgcgcatatacccacatattcccccatactcccctgttgcaagatggcttgtctagagccgcttgcttagctgcttaggttgcctacggaactgtctagcggccttcaatcagcggggtctggcggagggtgagcggctcatccgtatctggagcggactgcacatgcacggtgatctcataggattcgccgggctgcaaggtcacatcacccacgcccacggtcaggccatcgtgcaaagtcacacccttgtaatcgtcggcattctggaattcccaatccaccaaacgaccgttcgcaggcgcgtaaatgaacaatgccgtcttgatctggcctttcggaacgatatttccggcaccggtcacatagtcagcttcggaagccgcttcctccgccgtcatggtgttctgcaacttgatatgcaccgtatactggttcgcgccgtttcgcgcgaccttctggaattcagtggtcacttcgcgatgcaaataccagtccattttcgactcggtttcgtcggaaatatacacgccgacctgcggttttgcaccttccgtaatcaatttgccggaaatcgcggaatcggcaatcagatcctgctcatcctcatgcgcactccacaccatcacatgcccctgctcaacagacgtggaaagcgccttgacatacgatttgaaatcgtccacattctgcatgatatggtcgaacgcggcctgcgcggcaaccgcgaaatactcgtccgtctcctgcggagccatgcgcgcatacacgtcatgcagcaacgtttgggcagtattcgtgccatccaacgtcgaaccgtcaggcatggcaacgccaccggtcacagccagcatgttctgcaggaacagcggatcaatggcgatcacaccatcaaccgcaacaccgtactggcgagcccacatggcgctcacaatctcgccggtacgcggaaaatcaggagtgaaattcacgtcgcgaatatccttgccaagcttgtcggtgaacagcaaacgttcctcggcggtcaaatccacaaccggctcatcggcattctgaatttccgaatcggaaacgaacggctgcaagctcacgtgaccgccttgcaccgtgaccaggccgagcgatcccgtaagaccgccggaagggcgtacctccgcattcgtttgcgcaaggatcagataattgcgcggagcatcattcgcatggctttccgtacccaacatgctgggcagcacctgcacgatggaattcaaggaatgcaccatgctgtcaagtttttcgcaatacgtttccgcggttttcagggcgtccgcgatctgcgcgatatgcggggttttcacggttttcacttcccgcgtggccttgtcgatcgtatcgtccgcgatttggagcggctgctgagacgcttccaatccggaaatttcgatcgtgccgttttccacgtgaatactgttcagatcaacattttcggcgactttcaccagttgcggcaacgcctgcgacgaaatattctccatggcggccaccgtggtgcgtacggcggaaatgtcattgcccacatacggcacgaccgacgccacctgccacagcggcgaagaggtttgcttgtaggccttgcttacgtgatcggagaacgcggttgtctgcttctcaagcttggacgtgtccgcttcggagatggtctgctgcaagccttgagcactcgacaccgcctgctgcagctcgtttttcacgtgcagcgcagaccatacgaatgcgccggcgaaaacggcgagggctgcgactaccacaagcacgccgattaggatcttgcgacggcgacgtttgcgcttgatttggcgaatatgctcggcgctcatacggcggcgcacgcggcgggaatgcggggcgctggaagtggaatcttctggactggcggttgcgtcggaggttgaatcggcattagactgcggctcctcctgacggccttgctcaggctggacgccgaattcttcaggctgatcagacgcgccgttcatattccgtttcgctccctaattgtttgcaagcacttcggattccccagtgtaatagtagggggagtcgatgaaacttacggagcaaaaacggggcaataacggcggtgttactacccaaatgttgccggtaacgcaagaactgatgcaacctaaacgtgacctgcaaaccagtattgctacaactcaagcatgacccgcgacggcagcattactgaagttccaacgtcgccaataatgccttgtggtcggaaccttgaatccgcttggtttccaaatttctggcgtacacacccttgtcgtagatgatatggtcgatttcagcgatagggaataccgaaggatacgtcatatgcaatccctcgccggcactctcccccgcatccgtaaagcgatcgcccaacaaatatctgaagcttgcatgatcccacgtggaattaaaatcccccatcagcacatacgattccccattatcgtaatgctgtaattgcgctatggaatccaaacttttattccataatccctgattgcttggtcgtggagaaaacggatgaaccgacccaaatcgtacttttctgccattgaaatcaactgtcgcggcaggaatactactggattcaataggaatgagatcctgcgttgtttcctgcagaggatgcgcactatacagtacgttcacaccgccattgtcgtgccaagtgagttgcgcggaaacggaatacggaagatgatcctcaattccagcatcatgcaaccgatctaataatcctgatgaaacttcctgcattgcaagaatttcaacatgctcgctttggattgttcgcacgatttgctgcgcatcggcacaaccttgcttcgtattgaacgtcatgacacgcactgttgcagaaggttgtatggcacgatcattggtcggaacgacatacccccaatgccagataatctggatgatcacgcacaatacgcttaacgcgactaaaagttttcgtttgccgacagtgcgaaaaactgttgcaataattgcgataatcacggaaagcaagccaagccaaggcatgagtgcgacaatcaaaggcacgtaccgtttaccatcgagactgttcggcagcatgcgcagaagcatcgcgaacacgatgacggcggatgcgaaccacagcaacgccgtaagcagtgaagcgcgcgtttcacgacgcgtctcacttcgttggacatcgccaagtcgagtcatgcgcactcctctcccattccatcttcccgtttcacttcctattccgcgcaatccgcaatcgtatgcaatcacatgttgcaaccgatagtcttacgcatcgtttttcacaacatctctcacaacatctcttctcgtgaacgctacccgcgttcatccccgcatatgtttcccgcatgcattgagggtgatgctttcacaaaagtgccactatatggacactttccggcatttggaatcgttctgatacgttcatccgataatctataggttgcaaaacggtgcttaacaaaagaggcaatcatgagcgaagaagcaatgcgagaagaagtggcgcaagctgtggaagtggccgcaaacaaggccgccgaagaggaaatcagcaagctggccgaattcgaaagcgccatcgacgaaacgctcgcctccggatatttggacgatacgctcaccgtcaccgacgcagacggcgtggcgcaagtgctgccagtgctcgattccgagccgatctcacacttggtggaaggcttggaagccgtaggcgggagcgccaatgtgttcgtgcacaccagcgcaggcgtggtggccctcagcgtagtggaatacaagcccaacgaagaggagtagccgtcgcagcatgcacggtcaggcggcacgcctacggttgagggcgcgttgcacggtttcatgcgtggaaccggcaccctggccgcgcacgccgaagaacaccatcagcaccatcacgaagcagattgctgcactgatacgaagcgcccactgaatgccgaacacgttggcagccgcatacacggcttttgtgccaccaagcgcagtccaacgaagagacgtgaacgtctccatcaaaatcaccaacaccggagcgccaatcgcgcccgcaatctgacgaaccgtattcgtcaccgcggatccggcgctcacctcttccggttccaaacaattcagtgaccatgtggtgatcggcatcaacacgaaacccatgccgatctggcgcacaaactgccaaatcgacacccaccaaatccacgaagtcatggaaatcaaactcatcatgaccgtgccgaaacacaaggtaatcgtgcctatcaacgccaccggacgtgcgccgaaacggtcaagcaccttaccaccgaaaaactgcgaaatgcactggcccaaagcacccggaagcatcaccaggccgctaatcgcagcagaatagccacggcaatcctgaatgtacaggggcatgatcaccataatcgaactgaacgcgaagaacgagagcgcggccgtgatcgtgccaacagtaaaactacgattcttcaacacgctcaaattcaacagtggcggctgcgcttcaggattttcaatctgcctgcgcgcgccatgaatctggcggagcacaaaccaaataattcccacaacgccaatcaccattggcagccaaaccataggatttacaaacgaatacgattcaatattcgtaaagccgaacattagcccgccgaaaccgaaaatagacagtccaacggaaaaaaagtcagccttcgcggttttatcgttctcaccgaaattatgcaatccaaaataggcaagaagcagcgaaatcacgccgataatggtcaacgtgaggaaaattgaacgccaaccgttcaagtccgtctgcacaccgccaagcgtcgggccgatcgccggagccacgctcatcgccatgccaaccgtacccattgcgaaaccacggcgagacagcggataaatcgaaaacaccgtgatctgcaacaccggccacatcacaccagtgccaaccgcctcaagcaaacgcccgatcagcaccatcaaaaaagttggaccaagccaagcgaacagtgaaccgatcgtgaacacaaccatggaaacaagcacgatttcgcgcgtcgaaaaacgtctcgtaaggtatgccgtaagcggcaccatcacgcccatgaccagctggaaaatcgacgtcagccactgaccggtcgtaacggaaataccaaaatcactgacgattgtcggcaacgcggcgctcaactgcaattgcgtgaaattaccgacgaacgtaataaatgtaagaatcgcaatggaaataaacgccgtgcgcgttaaatgaccgtcctgatacgattcctctcgagtaagcgctcgagacatgctccgcttcgctgacatcaatcaccttctccacattcaaacgcacaaactatatgatagcccgtatgacagaggcatggatattcgcctgcggattcctgtttttgtcatttcggggtaacgctcccctatttagaggtatcatggcacacgaaagaggtaggcaagttttcgacgcaggcagcgtcgaggggggggggtgggtggaggataatgacagtcagggccatgttccacatctgcatggagttgtggggtattttcatatgcctgatttgcgcaggcggaattttcattgcaaccccacacaaaaccagacgaactcgcatcaaaatactcatgcagatcgcctgcatgcttcttcttggaaccgacgcgctcagctggtattttcgcgtagatgcagacgaaaccgcatactatatggttcgcataagcaatttctcagtattctgcatcaactatattttcatgagtttcttcgcaacctatgtttggttgacagtgagcaaacatcagcatcgcaaaccagccgcattgcgtgctgtctacgcattatccgtaattggaattctcttacttatcatcacacaattcactggtcttttctactatttcgatgaccacaatctttaccatcgcggtaatttctatcttctttcgcaggcaattgcggtcttgggaatcgcattatgcctcttcatgttgatctcatatcgcaagaatcttgatcgcattattttcctttccatgatgtcgttcttcgtgctaccagtattggcgaccatctaccaagcactggcatacagtttttcattgcaatgtttggcgatcgtgatttccacacagattatgttcgtcatggacaccgtggaaatgaacatgcgattccactcgcaacaggccgcctacgaaaaagcacggtacgaagccgaacatgacggcatgaccggtttgctgaacaaggaagcgggatggaaacacatgcgcaaatatttcgaccgcatggattcgcacgacgaagcgatgctgatgttcgtcgacatcgacgatttcaaaaccatcaacgacacatacggacacacggtcggcgatttctggatccgcgaggtcgcatcccaacttcggcacatctaccggcaagatgacattatctgccgatatggcggtgacgaattcttggcgcttattcgcaacaccgccagcgaacaggtgcttgaaaccacgctgggcatgttcttccaacagttggcacgcacctcggaacagcacgggcaagacgtgcattgcagcgtaggcgtgtgccgcattgcagccgctgacggtgccagccttggcacggggcgcgccgatggagacgcgatcggaagcgtggatttcgaccaatgcgtcgcacaggccgacttggcgctgtacgaaaccaaacgattcaacaaaggaacgttcaccgtctacaactacgaccgttcccagccagcacccgcaaatatccgcgcctaaatgagcagcttcagctttccggcaattcctgcgctgggcaaccgtgcaatacggaaagcatcgcccgcttttcctgcgaagtgacagtcagcccgtacttgtctttcacgccaatctgccgggccacgtaatcgcaacggtattcactgttcgtcggcagccagtatgcggccgaagcggaacccttctgctgattcgcgggcccatccacggccagcagattgtacatgtcgttgccgaattggtacagcttcgcatgatcccacgtgttcgcgcccgactgccacgcattttccaacgcgaccacatgatcgatctgcaccgccgaagacgttttcactccacgtacgaattggatggtctgaccggtatacggatcgtcaagcgtgcccgacgcaacctggcagctacggccgttcttatattgcacgtccgtcagatcgcgcgcgagcacgtcttcgcgcacgtcgcaaccgttgccatcgtcgtcggtttcgcggaatccgaacgcatcgcgatcatatccggccttgctgggattgtcgtcgacggtaagtttttccaacgtttccgcagctgtgccggttgccgtgtactcgccggtgatttcgcctacggtcggattgactttcggcagcagcatgccgatagtgacgccgattaccgcaacgactaccagcaaaataagaatacgttccagcggaccgtcggcgttgatccaactttttttgaaccgcttgccggcccgctggatatcacgcacgtcgcgttcaatattccgataattataagaattacgattattctttcgaggcataattattaaaaataatacgaaattatggaattacggagtatcaggcgtacgtgaacgtcatcggatcatgtccggcgcgcgtcggaccgtcaagcgcgtcgatcgcggcatgttcttcaggggtgagcacgaatccaaacaaatcgagattctgcttctgccgatccgcatgcaccgacttggggatgatgatcgtgccattttcgatatgccaacgcagaatcacctgcgcaggggtaaccccatgctccgctgcgatgcgctcaatcgcaccgtttccggcgttcaaatcagcaccgcgagccatcggcgaatatgcttccacggcaatgccgtgcgccttgcaatagtccacgacctcgcgctgctgccaagtcggatgcagctcaatctggttgacggcaggatattcgccggtctcctcatgcaagcggtcgagatgctcgggcaggaaattgcacacacccagcgtgcgcacgcgcccctccgcgcggaattcctggaacgccttccacgtttcgctggaacgccagtcgaacggggtgggccaatgcagcatgtacatgtcgacataatcgagctgcagcaagccaagctggcggtcgaacgccttgcgtgcgctgtcatacccctgctcggaatcgcgcagtttcgtcgtaacccacaggtttttgcgctgctcaccttccgtgaatcccgcattgttcagcgcgcgacccacgccggcctcattgttgtaccccgccgcgccgtcgatatgacggtagccggcttccagcgcactctccactacgggggtaacgccctcatcgtcgatgcgcagcacgcccaagccgatttgcggaatcagattgccgtcgttcaatgtgaccatgggggtatggaaggtttccatgcgttgtcctttcgaaggctgtgtttcaggcgattattctcaaccgttctcatgcttgttccagcttagccgcaggtcgccgcaattcggccatatttcgtggcacatgcctcgcattgcgtcttggaacggttcggacgcgccgttgcatgagtcgcgcatatgccgacagatgatatgcgcgtacgtaacataaccgcgcagtctcgtgcgctataacattgctcggataagagggcgacgaacatgaacagtacagacgacgcgaacgatatggacggcatgggaggcatggtcaatgcgggtgcgacggatggcgtggaatgctgggaaacggcacgggcgaatcacgatttctcttcccgccatgggcacgcgcttgccggcatgcttggacctgcttttgtggcggccgtcgcctacgtggatcccggcaatgtggcggcgaatatcacatccggcgcgaggtacggatatctgctggtgtgggtgctggtactcgccaattgtatgagcgtgctcattcaatatcagtccgcaaaacttggtatcgtcaccggaaaaagtcttcccgaaatcctgggagaacgacttggcgacggcggtcgattcatgtttttcatgcaagcggaagtcattgcaatagcgactgatcttgcggaagtaattggcggcgcaatcgcactgaaattattatttggacttccgctttttattggtgggtgcataatcggcattatttctacggtcttgcttatttttcaaaagagtgccacgcatcatatttttgaaaagctgattatcgcattgctgctggtgattacttttggatttattgcaggcctttttattgatccaccaaatcctgcgcaagttttacaaggtcttgttccgcatttcaaaggaaccgaaacggtattgatggcaacttccatgctgggcgccacggtgatgccgcacgcgatttgcctgcattccacgctggtgaacgaccattacgtgccaggagagcccaaaccgagcgtaaagaccctgctacacggaagcaaaatagacgtgttctgggcattattacttgctggatcggtgaatcttgcactattgattcttgcggcgaattcattgcatggcatgaccggcacggatacgatcgagggtgcgcaacaggccattcagcatgtgctaggtccggtgatcggcacgattttctcggtcggactgctggcttccagcctgagttccacgtcggtcggcacatatgcgggcgccgaaatcatgcatggactgctgcggatcaaagcgccgatgtgggcatgccgcgtggtgacgctcgtaccggcgttggtggtgttgtggtttgctaagaatccgacggaagcgctgatcatagggcaagttgtgctgtcgatcggcattccatttgcgattattccgctgatgaaatacactcacgatcgatcattaatgggcgattatgtggatggtccggtgaaattcgcgatcaatatggtagttgtttcgccgattgtcgcacttaacgtgattcttgtaattctcacgctctccggtcgttcctgatgtgggtcccatttcggtgtccgcacagtcgaccggcgcagctgcccgcgcaggaattgccggaacaccgaggttgattcgggtctgcacaacctcggttccgtgtctgcataagtctgattttgcgtctgcacaagtccggaattggccctgaaatcggagttgcgcagacgggccaggaaaccgaaaacgcaagttcggacgaaacctgtctgcctaagtcgcaagtcaggcctgaaatcagacttgcgcagacggaaaaacctgccaaaccggcaatacgggaatgaaaatcaagaacagataccccctaaaaaggcgtttggcaaggaaactgcacaaacatcgcgagctgcgtcgcgaagccaacgatacgaaaccaacagcacaaagggcgatagcgcgaaatcaacggcacgaaggacaacggtacgaaaccgatggctcgaagggcgacggcacgaaaccaacggcgagctacacgcgcgtggtggcgcgggcgatcacgtgcgactgggtggtgatgtaactcggctccagcacacgcgtgccgtcgatccggtcgagaatgcggctgaccgcagtcggcgcaatccagtcgagacaagaatccatggtggtcagcggaggctggaaatatgcggcttcttcaatattgtcgaagccgatcacctgcatctgttcaggcacggaaatgccgttcgcagccaaagtgaacagcgcacccaacgcaagctggtcattgaacgccacaataccgtcgaatggaatcccggaatcaataagctgctgcgtaatgcgagcgccggaaccaatcgtccaatcctgcccagtgctcattaccagtcgggaatcgaatgccgctccccgcgcggcgcacgcttcgagcacgccgcgaagtcgcagttgcgcattgccttccactgcttcacgcacggaatcgatatgctccggttcggttcgcgatccgaccaccgcgagccgggttgcgccatggtcgaacaggtattcggctgcgagtcgggcttcctgaatatcgtcgggggtaacatggtcggctttgccgtgtgtggaacgcgcgcccacgcatacgagcggatagtccacgtccaagtccgccgcttcaaggttttcgacttcggagatcgacaggatcatgccgtccgagacggtggtgttgaagttgcgcaggagtgattgcgctccttgtgcggatccttcggcgtaggtggtgacgtatacggagtagccgtagccgcgggccgcgtcgattacgcggttggcgagctccgacaggtatggggcggtcaatgttggtacggcgagtgtgatgaaaccggttttgccgcggttgagattgcgcgcggacacgttcacgcggtatccgagtcggtcgatgacttcctggactttttctcgcgtggagtcggtcatacggccggaatggttgatcacgttggatgcggttttgagtgaaacgcctgcctcttcggccacgtctcgtagggtgacgcgttttttgtccggcttcggctccggctttgactcgcccatgttcgtctccgtgattgttgaatatgccggtaaaaagtttaccagttatggcaagcccgccattcttgagtttcagaatggcgggctcaggttgtgtgagattgttgtgttacgcaatcaattgcgcgaaattatgcggaattatgcgcgctttacgacgagtacgccgttgcgatgcacggtgtagctgcccgtctgttcctctgcttccgcttggaacaggtagattggttcgccttcgatgccctgcaatgcgatttctttcttgccgcgcggcagatagaaatcgaaggttgcgtcggcggacttgcgcacggtgtgcagtacgtcggaatcggtcggattggcgacatttgcggaatcttccacgatattctcgcgcacgaattccgtaagatcggcgacgttgagatcgcagccgacgaagtatgtttcgccggaaccgtacggattgcgggtgattgcggcggtgccgccgagttcccattcgtcggcttcttcaccttcgtaggtggctaatacctgcgcgcgttcgccgtcgacgttcacatcgttctgccacaggcgggtgaccgcaccggagctcaaacgaatttcggacggttcgccttcggcttccgcgccgagaatgttgaattcctcgccgcgaatacccagcatttcgcgcagcaggccgtctccggctcccgggtatccgccgagccaggtgtggaagttttcgtcgattagtccggttgcgtaaccgatgaccacacggccgccggcagctgcgaaatcggccaaacgctgcgtatcttcggcgctgagcatgatcacggtcggcagtacgacggtcttgtatgcgctccaatcgtatttcaacggcacaatgtcggcacgggtgccggcgttgaggaacgcacggtaccagtcgcgcacgtcatgccaatggttgagcttcatgctcggcagggtttcggagcgtgtggcccattcggattccgcgctgaacaggatcgccgtatcggactgttccagttcggcaccctgcacgccagcgtcgccgagggttttcagcgctgcgcccagttcgcacacttgacggaacagtttggtgtcttcgcccgcgtggggcacgagtgcggagtggaaggattcggctccgaatgcggaggcacgccactggaagaagttgatggcgtcggcacccatggccacatgcgcaatggagtcacgcacggtttcacccttgcgcttgcgtgcgttgagcggcttccactgcacggccgaagtggaatgttccatcacataccacggcttgccgagcgcgagggaatccatcaaagcgtcggagcagaacagttcgtcgatatgcgattcgccctcatggaagtaatggtcgttcgacacgaaatcgacttcctcggcccagtcggcgtagtccatgcagcactggtcggtggagaccatgaagttcgtggtgaacggcttgtcggggcagatttcggcgatggcgtcgcgttcggccttatagaagtcgagcagcatatcgttgccgaaacgctcgaaatcaagcttttgaccggggttcaccatggagtcggcgcccatgaaacgcgggatgagcacttcgtggaaaccgttcatttcctgaccccagaaggtggtgccccacgccttgttgaggttttcgatggtaccgtatttgcgttcgcaccacaggcggaaggcattgagcgcgttgtcggagtaatcgtaacggttgttccagccgtattcgttgcccatatgccatgcggtgacgtacgggttggtgccgtagcgttcggccagtttgcggcacagggtgagcgcgtattccttgaacaccgggcttgtcgggctccaggattggcgcgatcccgcgttgacgggatggccgaatttgtcttgcggcagcacttccgggtgcttttcgtacagccacagcggcgcggtggcggttgcggaggccagatcgaccgcgatgccggctttgccgagcttgtcgatgatgcggtcaagccagccgaaatcccaacggttttcttccggctgaatgcgatcccagctgaaaatggccacggccacggtattgacaccggcctgtttcatgaggcggacgtcttcgtcccacacgtcttccgaccactggtcgggattgtaatcaccgccgtatgcgatgcctttgccgttgtcggtcagcagttccggccatttgaacgtgcgatgcatggattactcctttgtgtgcgtatggcatccgctataacgccgaggatgccagctcgacagcttcccttcgaaagctctcgtaaaatctttttataaaatctagtatatatatttactaagatatttgagatggtcccggggatgtccacgatgacacccccgaggtcttatttttgttcttttcggacgattgccgaaaaatcggtatgcgctttaccgaaatttcagcatgcgaccgttgcgatcattccttgacggcgcctgcggcaaggccggactgccagtacttctgcaggcacaggaacgcgatgaccaacgggacgatcgtgatcaacgaacccgtgaccaccaggttctggatcgcctggccgccagcggtgctcgcctggtccttccactggttcagaccgatcgtgagcggataccagttcgaatccttcagcatgatcaacggcaggaagtagttgttccacgtcgccacgatcgtgaacagggccgtcgtcacgatccccggggcgagcagcggcagggatacctggaagaacgtgcggaactcgccggcgccgtccacgcgggcggcttcgagcagctcggtcggcacggcctggtcggagaagatccacatcaggtacaggccgaacgtcgacaccaggctcgggatgatcatggcccacggggtgttcgtcaggttcagcttggcgaacagcaggaactgcggcacggccagggcgatgcccggcaccgagatggcgccgatgatcaccgcgaacacggccttgcgtcccgggaaacggaacttcgccaggccgtacccgcccatgatggcgagcagggtcgcgccgccggcgcccacgaccacgtacaggatcgtgttcaggaaccagcgtccgaagatgccgtcctggtaggtgaacacggtcttgatgttgtcccacaaagcgaacgtgcggccgaagcccagaccgaacgtggacgtgaagtccgcctgcgtcttcgtggcgttgatcagcaggtacacgaacgggaacaggcagtacaccgcgaacagcgcgcacacgatggtcagcagcgtgctcctgcgcgggttcgccacgttcgcgaagccggacttcgcagccctcttgcgctcggccttctcgtcgcgcgcgaccctcttgaggcgttccttctcggtctttttcgcggccttctcctgggctttgagctcctgagcggtgagcctctgctccgtgcccgcggcgattgttgcgtcactcattttcgatgctccttagcgtttcttcccctatatgcggatggttcgcgccaccgggcgttacttcatctgctccttcatgctgttgagctgcaccgcgtacgcgatcgccatcgtgatcacggccatcgtgatcgccagggcggcggcgtagttcgactggttgcccgcgaagctcaggttgtacgcgtacatgttcggcgtgtagtacgtggtgatcgcgttgcccggcaccatgttctgcaggatgctcggctcgttgaacagctggaacgagccgatgatcgagaagatcaccgtgatcgcgagcgagcccttcagttccggcagcttgatggacttgacgatctgccattcgcccgcgccgtcgatcgaggcggcctcgtacagcgaatgcgggatcgtggacagcgagctgtagaagatcagcatgttgtagccggtgaactcccacgtcacgatgttgccgatcgaagcgagcagcacgcttgggctcagcacgtcgaggttcgtgcccagccagtcgttcagcgagccgaccagaccgtacttcgcgccatacatgaagccccacaccaaagtcgacaccacggccggcaccgcgtacggcaggaacgtggagatgcggaagaacttcgcgccgtgcagcttcatggaatccaacgccagggccatcgccgccgacaggaacagcatgatcggcacctgcacgcaggtgaacagcgcgaccctgccgaccgagctccagaactgctggtcgtggaacagacgaatgtagttgctgattcccacgaacttcgtgccgccgatcatctgcttctggaagaagctgatgtagatcgcgtacagaatcgggatcacgaacacgaacacgaacaccaacgcgaacggccacatgaacttccaaccacgccaatccgcacggtgacggttgacgcgaacctggtccgcaggcgtatgcagcgcatccgccgcgactgctgcttgctgagacatgctttcttctttctgtatgctttttgctctattgatcgcacaaccatgtgcaattgttaatccgcaaaatcttttattgtttgaattacaggattgctatttttttgaaatctttttctattgtaagatttcgtttttaaaattatttttacgaagtgaggcaggcgggtcacgtcagacgattcccacctgccgtcgatcttcatggttgcgatggtgcgttgcgtatgtcggatcgcattatcgcgtttttcgttgtgccgcacggcagcggctgggcgccgtcagtccttgctggtgacggtgtagccctgctggttgccgtgatcggtgagcgccttgctgtagttgacgaaggcttcctccagagtgatgtcctcgctgtaggccttggagatctgatcgccgaaggtggactgcgcgtacgggttgtacggcaggtactggaaggcggagaccttgcgctgggcggcttcggagagaatctcgttcacgttctggccgccgaagtagtcgttgaccttcttgttggcttcagtgttcggatcggtgaaggagtcggaggagaggatcttcttcaggctcgggaaggtgccggtgtcggccatggtctgggcgccgtcgccgtgggtcaagtattcgacgaacttgtaggccgcggcctgctgcttggactgggagacgaccgcgagtgcggagccaccgtcttcagcggagacctcgtcaccttcgttccactgcgggagctgggccacgcgccagttgccggcctggtcaggagcgccgttcatgaggttaaccggcatccatgcgccgatggtgagagtggcgatgtcgccttcgttgagcgcacggttccagtcgtcggaccagttggcgatcttggtgtcgacgaggtcttcgtcgatgagcttctgctggaattcgatgtacttcttcatgccggaatccttggtcatgtcaatggtgatgttctcgccatcaaccttccacggctgcgcaccggcctgccatgcctgggcggtgaagggctggtattccatggaggagccggaattgttggtcatgtaggcgccgatggccttgaccttcttggctgcctcgtaataatcgtcccaagtcttgatctgggagccgtcgacgccggccttcttgagcacggcatcgttgtagaagaagacttccgggccggaatcaatcggcagcgcatacggcttgccatcatactgtagcttgctccacgggcctgcggagaagtcgtcttcgagcttgtcggcaccgtaggcggtgaggtcaacgaggtcgccggtaaccgcgaactgggtgacggtcgggtcttccagcatgaccacgtcgggggcacccttgcctgccgcgacggcgttgctcagtgcggtctgggtgtcggatgcggtgccggtgttgttgaatttgacggtgattccgggattggccttttcgaagtcggcgatcagggccttcatggtgttgccggtgtcccagccccagaaaacgagatccgccttgtctgcgtctccggcgttggccttggcgtcgttgccgccgtcgctgccaccgcaggccgcgaggctggcgagggttgccactgctgctaccgctgcgagagccttcttcatgttgcgcatgttcttttccctttctgccatccgcttcgcatgctgattgcatgtcggtcgcatatgtttcggaacatccgccgcggaatgcacatgccgtgctttccacttggtgatgtttgtatgttcgcgacctgccaaacaatacccccgtggtgatgtttggactggtaggatggctttgtttcctttctgatacaaccgtgtaccattagctccgatgatacacggttgtatcaaggtgtcaagcaaaccggttcgatagcccccctgcaactgttgtgcgctattgaagcgccaacgaaatcatcggcgtttcgcacaaacagaatgacatcgtttgcacaataatctgcgattgtccgcgcatctcaaccaaaaaatggatcgcaagaaagctacctcacaagagaaaacatataaagaacatataaaaaggaggtctgcgaatcgcaaacctcccaaaacaacgcatacgacgaagagacggactccgcaccgctcgatgagcctacaaactgaggaacagctcgtgaatgcgggtatcgtcggtcagttcggggtggaacgccgtagcgagaatcttgccctgacgcaaaccgaccacattgccgtcgaccgacgtttcgaccgtggcccgctcgccgacctcggcaacgaacggtccgcgaatgaacaccagagggaaatccttgagcaccaccgacgtatccgaagcctcggaagtcccctcctcaccagcagccgcggaaatcgcagaagagacagactcccccgacgcaaccaccacagcatccgcatcgtcggaagcgccgaaatcggcggacgcagcgaacgaaccaagctgacgtccatacgcattgcggcgcacgaccgcatccaacgcgccaaaatagacgttctcgtcgttatcgagacgacgagcgagcaaaatcacgcccgcgcaggtgccgaataccggctttccagcggcgatatgcgcggcgatcggatcgaacaagccggtcgaacgcagcaatttgccctgcgtggtgctttcgccgccaggcagaatcacgcggtcgatcgaatcgtcgaaatcctcggcggcacgcagcagtttccacggcgcaccaagccgatccagcatcgccgcatgctcggcgaacgcgccttgcaccgcaaggatgccggtcacgccatgctgcgcggaagccgcaccttcggcaacgtcagtcgattcttccttcgaaatgtattcaacggcaacaaccatcggatctccttacccaaaccatcgcgaatcatgcgaaacgggctgcgcgcggcgcatcgaacagacatgccgacagccgcgcacagcgcacagcgcacgaaatgacagcgcaatcactcgccgcgagcggccatgatggtttcgatctcgtcttcgttgatgccgaccatggcctcgccgaggttctcggaaaggcgtgcgagcaggtcggcgtcctgccaattggcggtggcctgcacgatggcggcggcacgcttggccgggtctccggacttgaagatgccggaaccgacgaacacaccttcggcacccagttccatcatgagcgcggcatcggccggagtggccacgccaccggcggcgaagttgacgaccggcagacgaccgttgtcgtgcacatacttggcgagatcgtacggcacggccagctgcttggcggcctcatacacctcgtcgtcgcgaagggagacgagctcgcggatctgcttgttcatggtgcgcatgtggcgcacggcctggatcacgtcgccggtgcccggctcgcccttggtgcggatcatggaagcgccctcggcgatacggcgcagcgcctcgcccaggttcttcgcgccgcacacgaacggcacgtcgaactggttcttgtcgatgtggtacacgtcgtcggcgggactcagcacttcggattcgtcgatgtagtcgatttcgatggcctgcagaatgcgggcttcggcaacatggccgatacgaacctttgccatgaccggaatggacacggcttcctgaatgcccttgatcatggccggatcgctcatgcgggaaacgccgccggcagcacgaatatcggccggaatacgctcgagagccatcaccgcgcatgcgcccgcgtcctgtgcgatcttcgcctgctccggggtggtgacgtccatgatcacgccacccttgagcatctgcgccagattcttgttcagttcgttcctgttgttggccatcgccagcctttcgtcgaatcgtattccaccctgctgcagagcggatatctcttgacacagatactaacgatttttcgttacaaaatcatgtgaactgaatatttgcacgtcttaaaaagttgcttttcttaaattctgactatcattttcatgattgtttcattttcttacgatttcgattctgccgacgattccgcaatttcattcgcttttcttgcctgatatgcgccattcgctttcgattcgcgcgcacggctcctttcgaccgcactttcgatgcacgctataagaaatacgaatgacgcatgattttcatacgaccacattgcggacgggggtgcagatggattcgcgtattgcgcactacatacgcagtatgcgatcagcgatgcgcatggtggaatcgcggtgcgacaccagcacgacggcgctcccccgctcggcaagatcattgatcgacccgagaatcaccgactcgttataggcgtcaagacggctcgtcggctcgtcgaacagcaccaaatcggcgtcgcgaaggaacatgcgggccaatccgatgcgttgcttctcaccctccgaaaggcggccacccagctcgccgacccgcgtatccaagccgttcggcagcgcatcgaccagttcgagcgcggacgccttggcgagggcttcgcgcaatacggaatcgggaatgtcgtgcgcgagatccgaatcggaggaatcagcggaattaccaccagcattactgctggaattactacagaaattactgccagaattactgtcagaatccgaaaaatcggcgtcattgcaggcaatagcgagattttcgcgaatcgttccgtcgaacagatacgtctcctgccccatcatcgtctgcacgcgccgacgccatccggcgtcaacctgcggcaatggaacatccgacagcgaaatcgtgccggaatccggatcccagtagcgcatcagcagtttcaacatcgttgattttccacgcccggacgggccttgaataccgagaatgccctgccgtgaaacatcgagtgaaacatggtcgagcaccggttgcgaggcgatgccggcaccttgttcgccggaggattgcgcttccgcggggcgtgccggactcatgccagtcgcatgctccgaccgcccgtttggcgtgcgttcgacggaaatacgggcgccggatccatagccgaatgtgacatcgcgcattgtcatgccctgatattccgggcgttcgctcccctgctcgaccacagcgggagcctcatccatcaacgcgaacaggcggcgtgccgaagcaaacgtttgcgtcagattcgccggcaacgcactcaacgcaagcgtcggcccaaacgagctggcgagcagcacgaaagccgcaaccaacgctggggcgttcgatcccacggaacccatccacatcaggccttccgacatatcggcggcagtggaaaccgcagtgcacaacgtcatcgcaaggaaagccgcaatcgccgtgaacagcatcaccaataccgcgccaaatcctgcaaaatcgccatttttcacgctcagacgcacacgtttgacccacagcgagcgcgtgcgacgctgaatggacgcaagccgggcatcgccttggccgaagcggatgatttcgccgatgccacgcatatcgtcaagcatttcgtcatcgagggcggacgactccttgcgcagttccggaccgatgccgcgcaccgcggatgcaaaaagtttcggcagtatgacgccgataatgaggtgcgcgatgatgagcgtcgccgcgaggggcggactgagggtgagtagcgcgagcgcgtagacgacggtagtcacgatggcgatgacgaccgggctgatggtgtgtgcgaagaagatttccagcagttccacgtcggtggtgaccagtgcgatcaggtcgcctttgcctttgcctgcaagcttggcgggggcgagacggcgcagggccgcgaaggctttcgcacggaatagcgcaagcagacggaacgccacgttatggttcatgaactgttcggcgtaacgcatgccgccgcggatcaacgcgcatacggccatggctgcgagcgccgcgagaacgctgaggttccagaccggcgagccgactgcagcgaaggccgccgcgatgccgaacaccggcaggaaagtggcggcgagatggccgagcgtgccgcagacgcacgcgacgatcatgtacttgcgctgcggcccaacttccttcaacaggcgcgcaataaggcgagacgtgggtattgtcttcgcgtccgattctgccgaatcggacatccgaacgcccgttttcgcaccctgtgcgtccgtttctgcagaatcggacacttggagacccatttccgcacgctgcgtgactgattctgcagaatcggacgctttaagtgcgtgggatgcagaggtggaatgggttgcgttattgcgtagacctatgttttccacggtttgttgggcgtggaacagtttggcgtatgttccgttggcacgcatgagttccgcatgcgtgccttgttccgccacgcgcccgtgttcgaataccaccacatggtcggcgtcggctgcattcgccatgcggtgcgtcaccatgatcacggttttgccccgatccgcaagcgcccgaatggtttgcagaatcagggtttcgctttccacatcgacgctgctggtggcttcgtcgaaaatgtagacggcaggctcccgcagcaatgcgcgcgcaatggcgatgcgctgcttctgccctcccgacaggttgcttgcgccctgttcgatggccaggtcaagttcttgcgattgcgcacgcacgaaatcgctgatatgcgccgcttccagcgcttgccacagttcgctttcggtggcatccggcttggccatcagcagattgtcacgcaacgttcctgcaaaaaggtggctttgcgccgccactatggcgatttccctcgtaagggattcgatggaaagatcgttgatttggtaccgttgcgtcgagttgtttcctgtgtttccggattgcagccacatacatccttcatatccggaaagatttccggagagcagttcgacggcggtggatttgccggatccggacggaccgacgatggcggtcacctgcccgcgccgcgcagtgaaagagacgccatgcaatgcgacgaccgaaccatcatcatctttcgacatgcctgtttttccagcaccaaccacaccggactttcccccgatttgtccagtttttccagtttccatatccgccgtcacagccgtatccgcagccacactcacagccgccgcagcatccgtattcacgtccacatatcggaacgacacgtcatcaaagcacacgtccacaccgttatcagaagcgccgaattccggcatttcctgcatcccatgcgcaggaatcggcgtatcaagcaatgcgaaaatacgcttggtcgaagtcatgccgttcatcgcaacatggaagaacgaccccaattggcgcagcggaatgaagaaatccgcggaaagaagcactatcagcagcacgccggcaagcggcaatgcggcaccactcgcatactgccagatcgatacgcccacgccggccgcggcacccccgtatgcgacgacgtccatggcggtgagcgagcgcagctgaatttgcagaacattcatggtcattacgcggaattgttccgcttgctcgcccattttcttggcggcatgcgcatccgcgtcaaaagttttcagcgtttcaagaccttgtacattgtcaagaaacacagatcccatgtcggtgtattttccccaatattttttgaatactcgggctgcgcgcattgcgaccatgccaacaatcaatacaatcaaaggcgcgcatacaagcaatgtaacagccgtcggcatattaatcggcgcaactataaaaaataatgttaccggtgcgagaatcgcataaaacagttgcggtaggaataattcgaagaagctttggatttgttcgatgccttcaccggcagattgcaccacgtcggcagtgctgatatgttgcgaatatgatggtccgatcgcaagcattttattaaaaagctgttcacgtaacgcgagtttgacacgctcagccgcttccgcgccgaaataggccgctgcgcgcatcatcagaaaacgcagtaccgcacagaccacgatcgccagcacgcatccgacgtatgtttccgcactgaatccgccgtagccaaagccgatgaacaggcgggaaatcaggccactatcacccatggagaacatggggtcgaacgccgattccaccacggcaagcgccggcgaaagcatgaccaccaccgtcaccacgaacacgacgttggccagcagtccgacccattggcagagcactttcgccgcaaccaaccgccccacgccgggagcgagggaaaacagcctcttgtcaaacataaacaccttccgtccaatgagcgcactcgcgttgccagctcgcctacggcccaaagcgcaatcgccatgcatccaacaaacgaatcgcaacaggccaatacgggaaaaccggtgcgtggcaaaccgttttcagcctatccaaggcagctcgcaatcgtcaagggcgcattgcatacagcgaaccgtcgcaatcgaattgccataatcgacctcaaatcagcaacgttgaaaagagaaaggctggatgttcgccgttgagcaggcagccctctgacgcaaggggtaaattgcgtcactcgtgagtgtactcgataaaaaacgctcgcaccaccatttcttcgcatttcgctggttttacggtcctttcggggatatatgggaagcatggcgactcccccgcaaccgttacgtcaagcctttttttcgaacggatacagcgcgacaccaaacacttgatttttgacggaatagcaccatttgtcagttcatacaaagttgatgaaatatttcttgtcgcttctcacaatgcagacttacggccccgtaacttagaatgtgcaaggtgcgcaaggggtaggaaacgcggacacacggtttgtatcgctcccgcacgcatcacaagcagaaatacgcggaaacaacgcaaaaaccgcgagaaagagaacgcttcatgctcaccgagtacaccaccccgggcgaatccgttgaggtgcgcgacgacgaatccatctattccctgcttactggacgcatagcgcgcactggcgaagataccgtgatcgcggaacacaaaaccgcccccggccaatggacgaaggtcactaccggcgaattccacaatgccgtgctcgccgccgcaaaaggcctcatcgcattcggcatcaacaagggcgatgccgtcaccatcttctccaccacccgctacgagtggggcgtgctcgacttcgcactggccgccatcggcgcggtgaacgtgccgatctacgacactgattccgcggcgcaggccgagcgtatcctcaacgattcggatgtgaaactggccatcgccgacaatcgcgagcgcttcgaccgtctcgactccgtaatcgaccgctgcccgtctctcaagcacattctgatgctcgattccaacgccatgggcgcgttggaaggcttgggcgtcaccgtgtccgacgaggagctggaagcgcgcatcgattcggtgcatgcagacgatctggccaccatcgtgtacacgtccggttcgacgggagctccaaagggtgccgagctttcgcaccgcaatttcatatcgatcacgcgcgcaggcagtctggcgttgcatgagatcgttctcgaagatcatccgcgactgcttctcttcctgccgctcgcccactgtttcgcacggttcatccagtacgcgtcgattgcttccgacgacggcgtggttggttatctgccggacacaaagacgctgctgcccgatttgcgttccttcgaaccgacatatctgctgggcgtaccacgagtgttcgagaaggtgtataacgcggcctcccgcaaggccggcacgggttggaagggacgcctgttcctcaaggctgccgaagccgcacgcgattggtcgcgcatgcagcaggccggcgaacgcccgaccgccaagcagatcgcgcagcatctttcgtatgaggcttccgtataccgtaccgtgcgtagcgctctcggcccgcgcatccgctacgtggcatgcggtggtgctcctctggacgtgtctctggcgcatttcttcaacggtatcggcctgccgatgattcagggttacggtatgacggaaaccgctgcgccgttcgccgcgacccgcgtcaccgacaatgtgatcggcactgtcggccaaccggctccgggatcgtctgtgcgcatttccgatgatggcgaacttcaggtgaagggcccgaacgtgttcaggggctaccacaacctgcctgagaagacggcggaagcgttcaccgaggatgggtggctgaaaacgggtgatttggcgtcgattgacgacgagggacgtattacgatcaccggccgtaagaaggacatcatcatcaccgccggcggcaagaacgtttctccgattccgatggagcaggagattgtgaaatgtccgattgtggagcatgtggtagttgtcggcgacaatcgtccgttcatcggtgcgctgatcacgttggatccggaaggattggaggcttggctgccttccattggactgtctgccgatacgccgttggatcgcgtggctgcgaccgccgccgttcacgacgaaatccagaagtacgtcgacaaggcgaacgcgaccgtttcccgcgccgaatccgtacgtaagttcgtagtgctggatacccagttcacgcaggaaaacaagtgcctgaccccgtcgctgaaagtggtgcgtccggcagtgaaccgcgtgttcgcacaggtgatcgatcagcagctgtactccggcaagcgctgaatcgcataatacataaaagcgtggggtacgagagaacgtttgtattctctcgtaccccacgcttttgttctgtctgtacaactttcaaggaatgcaaacgagcgccggtgatcggaagcgatccgacccgccggcgctcatatggcagagattagtgatgaatccagaatggctaacgacactccatcagccattgtcagtaaagcgacaatcagtgacggttccgtcagtgcataacgcgtgcggtaacggtgcgacagaaggcgaacgagggtacgtcgagtcttctgctgtgccgttaacgctccgttatgttagtgacggttgttgaggcggtggtacatttcggagatctcaaggtcgcgctcgaattctgcggccttggtgttcgcgtcgatggtggcgagttcgacaccggcgatgcgggcgaagtcttcccaagcctcgcgaccgacggaggtggtcatgcaggtgtggtgggaggcgccggaacgcagccagcactcggcggaggtcttgaggtccggctgcggcttccacaggccacgggcgcacggcaactgcttgagctctccgagcggctcgaccacgtcgaccaggttcatggtcaggcggaaacgttcgcgcacgtcagacatggacacgacgacggcgtccttcttcggggcgacagtgaagaccaggcgcaccggatcggccttgccaccgatgccgagcgggtggatttccagcttcggcttggcgatggtgccgacggacggggagacttcgagcatgtgggagcccatgatcatctcgttgcccggggtgaagttgtaggagtagtcttccatgagggaagcgccaccttcgaggccgtagcccatcactgcgccgatgcgcacgagcactgcggtcttccagtcgccttcggcggagaagccgaagccgtactcggacgggaagcgctgcgggccaacgcccggcagctgcgggagagcacccaagtcttcgaagttgtcaacgccggcggtgcagccattggcgcgcatcatgttgaccatggcggcttcttccttggccgcgatgaacagggaatcgtacttggcgtcgagcagagccggatcaacgtcgtacttaaccttgtagtcttcgatgatgctcttgacctgatcgtccttgacggcttcgtaggctgcgacgagctcgttgacggcccaagtgttgatggatgcgccgaacacgcgctcggcttcggtcttgtcgccttcggtgacggccacgttgcgcatgttgtcgccccaacgcatgaccttcatgttgttggaagcatcccagccggcgcaggcgcgtgcccaggtgccgatttcttcggcaacggccggatcggtgtagtggccgaccacgatcttgcggttgatgcccagacgggtcaggatgtaaccgaactcacggtcgccgtgtgcggcctggttcaggttcatgaagtccatgtcgatggtttcccacgggatttcgaagtggtgctgcgtgttgagctgcagcagcggcttggtgagcacttcgaggccgcggatccacatcttggccggggagaaggtgtggcaccaggtgatcacgccgatgacgttcgggttggcggaggcttcgaccatgaaggccttgacgccgtcggaggacttcagggtcggcttaagcaccaccttgaccggaatcttgccggttgcgttgagcgcgtcgacgatttcgccggactgctcggccacctgacgcagcgcttcttcgccgtacagatcctgggatccgacgccgaaccagacttccttgccttcaaacgggttttccattgccatgtgattgttcctttacttcgttgtttatggagtttttaattatttattgcgattgcgaactcgcgcttcgcgttgttctgttgcgtagcgcgagttcgtacgattgtgaaattatgtaggattacggaatcgtaggattgcagctcagtgctggccgtagacgttggtgtaacgatcgttcagcttcgcgatatcctcatccgaaatcggaatgatctcacccaactgcctcgccgcccacatcgtatgagcgacctcctccgtcatcgccgcggccttcaccgccgactccgcgtccttgccgatggtgaacggaccatggttctgcatcagcaccgcaggagacttcggatactccctgagcgtctcgaccacgccctcgccgatcgcctcggaaccgatcagacggaacggacccaccggaacaggaccgccgaactcgtcgcccatcatcgtcagaccgcacggaatgttctgccccgtcgccgcccacgccgtcgcatacgtcgaatgcgtatgcaccacgccgtacacgtccggcatatgacggtagatgtacgcatgcgacgccgtatcggaggaaggagcctccgaaccgtccaccacgttgccgtccagatcgcacaccaccatgctcgacggcgtcaggtactcgtaacgcaggcccgacggcttgatcaccatcagatccgccgtatgcagacgctgcgacacgttgccagccgtccacaccaccaggttccacttgatcagctgctcgtgcaaggtcgccacgacctcgcgcacctgcttgacctcggcacgaacctcaggaccataatcagccaaagtagccataatcatttcctttcaaattgaaataagtttttaaaatatttatttacttggtttccagcggaatgctttcgattgcaacatgctcaatcggcagtcccttgcggaagcgatcgaagaattcctcgaatcctgcgacatcgccttcatccggattttccgtggtcgaagcggcatcggcgaacacacgagcgtcaaggaattcgtcgagcggctggtcggcgtgccacaggtagtcggctagcacggccatgccccatgcgccgccttcggcagcggtggacattaccttgatcggcgtatcgaatgcggctgcgagaatcttctgggcaaccttcggggtggtgaagatgccaccgtggccgacgagggagtcaacggcaacgccttcgtccttggtcatcacatccatgccgatcttcaccggggagaatgcgctgaacagctgggcgcgcatgaagttgccgaggctcatgcgggcttccggaccgcgcgcgaacagcgggcggccttcgggcagtcctgcgaggaattcgccggagcggaacgggtagttgatgagtccgccgcagttggagtcaacatcgtccgcgatggcggcgcggaacagcgtgccatacagggtgccggcgtcgaccggagtgccgattgcagctgcgaactgtccgaacagaccaacccatgcgttgaggtcggaggtgaagttgttggcgtggctcatgcctgcgagatcgcctgccggagtggtgacgaggtccacttccgggtgcaggcgttccagcttgcgttcgagtacaaccatggcgaagatggaggtgccggcggaaacgttgccggtgcgcacgcgtacggagttggtggccaccataccggtgccagcatcgccctccggcggagcgaatgtgattcccggctgcagcgtgcctgtcggatcgagcagcttggcgccctcttcggtcagcgtgcccgcaggagtgcctgcaaccagcggttccggcagcaggtcggcaagcttccacggctgggctgcgacttccggaatcgcattgaacttctcaatgaattcggtttcgtaggtgtgcgtggtagggtcgatcgggaacatgccggatgcgtcgccaacgccgagcaccttcttgccggtgagcttccagtgcacgtagccggcgagggtggtgaagaaatcgaccttgccgatgtgctcttcgttgttgagcacggcctggtacaggtgtgcgatggaccagcgttccggaatgttgtactggaacagttcggaaagcttctcgtgtgcttcggaagtgttggtgttctgccaggtgcggaacggcaccagcagttcgccatctttgccgaaggcgaggtagccgtgcatcatggcggagaagccgatgcgtcccacgcgggtgagcttttcgccgtaagcgttttcgacatcttcggcgagcgccgcgtatgcggtctgcagcccggtccagatttcttcctgcgaatagctccacaggccgtcttccaagtggctggcccagccgtagtcgccggctgcgatggtggtgtacgtgtcgtcgatgagcacggccttgattcgggtggagccgaattcgatgcccagactcgtcttgccagcgcggattttctcggcggtcagcgcgatgcgatcgtcaagtccctgctcttgcgccatagtttcaaactccttgcatccgagcgcctcacaaccacattgtcgacggaatgttagcgctcactgttaacgctcactattctaaacagaaagtggcgactatacaagttcgacgtgtcacgcaatcgtaaacgtactaccggcagatcgtcagccgattttcttgatataccggcattacgaaatccggcaatcgcagcacatgcggcaaaaagagatacgagaatcacaagaaatacaaaaatcgcaggaaatattcagcgacggctggcggtgcccaaagaagtgcggccgatcaccttcgcgggaatcaggccgacgccatgctgcgacgaggcgaacgaattctcatcgccctcccccagcaaaaacagcgtctcacgcatggcggcaacgccaagctgttcaaaatccgggcgaaccgtggacagcggcgggtacatgttgtccatggcgggcatgtcgtcgaaaccgaccaagctcacatcctgcggaatacgcatgccatgttcatgcagcgcacgagacacaccaaccgcctggctgtcgttcgcacacaccatgcacgtcggcagatttccgccggtacgaccgatgttttcgagaatatggttcatcttgccatacgcttcggtcgattcccaggtttcgcattgcacggtgacggaactcaccgcattggccgcacacagcttattccacgccatcaaacgcgtggcggcgtcacgccattccttcggacctgcgaaataaagcacggaacgatgcccatgctcgaccaccaaatgcatcacgtcggccatggccgaccattggtccactcccactacggatactcggcgacggtcggccggtttcatcaagcgcaaaccatcctgcacgctgatgctgccgtgcgtggaggtgacgatgacgcgcggctgcgtgatctgcgcacggcaggcggcggaaaacataacatccgtcggcgtgaggaaaatgaacgcgtccacgttcatctcatcgaacgttgagcacaattcgtcgaattccgcctgcgagcagagcgcctcgtgcaccatgctcaccgacatgaacagtccatgctgcctcgccatcgcctcaatcgaggaaatcgcggaaatcggaccataaaagcgttgcccgcccgcaaccaagccgatggtgcgggagcgatgcgaagcgagggcacgcgcggaattgctgggacggtatccaagcgcgtcgatggctttctgtactttttcgcgggtggcatcagacacgtcgggggaatgattgatgacgcgcgacaccgtttgatggctgacaccagccattttcgccacttcgaacatcgaggggcgtttgtttgccgcattgcgcttgcctgccatgctccgtcgccttccgcacactaccgttgttactttcgactattctacacgcaacttcggttagcgctaacagacgctatttttcagccatttgagcgagtcgcgcagcgaaattcggccagtcggtacgcatggcggtcaacagtttacgattggggacttcctcaatcggcacccattcgatttccatgctttcgtcgtcgttggccttcggctccacgcggtgccccggcttttcgaaagcgaacacggtggtgtaggcccacggtccgtggtcttcgcagtatgatccgaccacgtcgatatcttccggcgtgatgttggcttcctcgtacgattcgcgcagcgcgccctcgatcgggctttcaccgtcggcggtggcacctcctggaatgccccatgtgccaccttccgcgctccacaccgcgcgatgttgcatgacaacgtgcgtcacttcgccggtctgttcgcttcggcgggccaagagcacgccggacgcgccgttcgtgccccaatgcttgcggccgcaatcgcaatcaatccaaccatcacccggctgatgcacgttttccttgggaggaagcggcttcgcggcaccggttcgcgaatcgtgttcgacgttcggttcttgatcggctcgcgtcacattccacagatcggtccattccacgccgagctcggcggccaaacggcgcgccagcggaaggctcaggccgataatgccgtgcggatcgccttcgatggagtcgatgaatgctccgccgaagccctcaagcgtgaaggaaccagccacttccaacggttctccggtggcgatgtaccgttcgatatcggtgtcggaatattcgcagaagtgcagcgttgccctgctcgcgcctcgcgcgatacgcccggtggcgaagtcgatcaggcaatggcccgtccacaattcaccggtggcgccacgcatggcacgcagtcgttcccgagccacctcagcgctatgcggcttgccgtaacattcgccgtcaagcaggaacatggaatcgcagccaagaatcagcggaccgactttcgcacgggtcaggctcggcttgccatcaacgaaatcagcaatcgattcggtgatcgtaggaatggtgactcccgaaaaatcgcgggtcttcacatcggaggcggactgcacttcgtccgcacgcaacgtaacacgatgatgttctaaagatgcggaatccccagtattttcagcattatccgaatgttcggaagattcggcaacggctttcagcggaaatccgaccacacgatcgccgtgcgccgccgcagcggtggcggcaacgttccgatacgcctgatgtacggcttcggctttggccgtagcgagaatcatcacccgctgttccacgctcagatcgcttacggcaacgcccatggcggccgcctcacgttcgagcgccgccggctcgtccacgttcgatacgcgaatcgtggggcaaatgcccgccgagaaaagcacgtcacggcgaggcttggatttggaagcgagaatcagcggaatggagttgttcatgcgcgttccacctgcacacccttggtgtcgacgcccaaatgcagcacacgccaatgaccggaagcgagctcttcggaagcaagctgtcccagctgttcgcgagcgtcgccatgatgcagcacgagcacgcatgggccagcgccggaaaccatggaagcaaaaccatgggaacgcagcttttcgatcaacgtccacgacggttccatcaaaggagcgcgatacggctgatgcagacgatcctgcgtggcggcgaacagcaacgcgttgacgtcctgacgctgaccagtcgccagcatcgcaggattcatggcggccggcagcaggctcacgcgagacacattgtgcacggcatccttgaacgccagctggcccggcagcgcctggcgtgccttttcggtggacagctcataatccggcacgaacacggcggcggtcagatcgtcggcaacgcgatagttgatggtatggaagcccttatgcagcggttcgccgcccggaatcggcacggaaccgacaccttcgggggtttccatgtcccaagacatggtgagcccgccgtacacggccggagccacgttgtccggatggccttcgatggccgcagcaagctcaaacacggcatcacggttgagttcgtcgtcctgcgcgaaggcggccgcggctgcgatgcccgccacaatggcctctgcggaagagcccatgcctcgtgcctgaggaatgttgttgtgagcctgaagaatgaagcccacacggcccagaccaaaggtctggcatgcgcggcggaacgtggaaaccaccaagtgggtttcgtcacgcgggagagtatcggcgccttcgccttcgatcatcacctgagccgcagtgttcaccggatcggcgctcagcgtgaattcaagttcgtcgtggtagtccagagcaagtccgaccgtatcaaagccagaaccaagattggcgctggtagccggaacacgcacacgcactttacgagtaactggagtcatatctcgtcgtccttcgtcacatcttctttacaaatgtagcaccgtatacccgaaagggtacaagagtcaaattcaagcccataatcagcgggcgattgagtaaacaatcggcaagcaattgcccaacacagcagccggaatatgaataaagagacggccgcccaatcgcaacgatttgagcagccgtctcataactgttagttgagcacgcggaggatggaaggctcgccaaccacgcagtcgagtgcgcacacgtctttcacggtttcacgcagggtaagctcgtcggtcatgtgcgtgacaaggcgcagctgctgcagttcgccgtcgtagcccggatccttcagcgtgggcttgagatcctggttcacaccattgatggacacgccatgctcggcgaacctggccgcaatggccgcaagtacgcccggattgtcgtgaatcacgaaacgcaccgcgaactcggccttggaagcctcgatcggagccttcttcaaatccttatacaacggaatggtcgggccagtgcagccctgtgcgatgtgacgcgcctcggtcaccacatcgccgaccactgcggaagcggtcggagcgccgccagcgccacgaccgtagaacatcagatcgtcagccgcttcggccttcacaaacaccgcgttaaaggaaccatgcacggaagccagcggatgctcgttggaaatcagcgccggatacacgcgggcagacacaccggcctcgccattctccaccacggccagcagcttgatgaccttgttttcggcggttgcggcagcaatatcgtcggcggtgatcttggtgatgccctcaacggacacatcatcgatggtcacgttggtgtggaagccgagcgtggccatgatggccgccttgttggccgcatcgtagccttcgatgtccccggtcggatccgcttcggcgtatcccttggcctgagcgtccttcagcacgtcgtcgaaatcaagacccttggtggtcatttcgtcgagaatgtagttcgtggtgccgttgacgatgccgagcatgctcgtcaccttgtctccgacgagggattcacgcagtggcttgaggaacggaatagcaccgcccacggaagcctcgaagtagatatcgacgcccttggcttcggcggcggcatagatttctggaccatacttggccaacagcgccttgttggcggtaaccacggaagcgccggattcgatggccgcaagcacgaacttgcgggccacgccggttccaccgatcagttcgaccacaatgtcagcattggtggccacgctcatggtgtcggtggtcaccacggacttgtcgatccacgggaacgggtcggtttccgacggatcaaggcaggcgacgccggtcagttcgatcggtcgtccgatgcgtgcggcgagctcatccttctgctccaccagcaggcgtgcggtctgagagccgaccgtgcccgcgcccaacaatccaacgcgaatcggcgcaacatcttcctgtaccaaggcatcctcccttgaatgtgaagtattggtgtaaccctgcctattgtacggtcccgatatgacgtaagaccgcgaaatcatacgaaaatggacggtttccgagctttgccccgaaaaccgcccatactgcatccacgctgcatccgtaatttgagacgaatcgccatgaacaatacgaaacacgagcgaaacgccacgaatcgctattcgctcacatcccaatccagcagatcatcgaccgtctgacggcgaatcatcacatgcgcgtcttgctcggatacggcaacaaccgcaggaatcagcgcctgattgtagttgctggccatcgtgcgaccgtatgcacccgtaacaggcaccgccagcacgtcaccacgctgaatatcggcaggaagacgcacctcgttgacgatgatatcgcccgattcgcagtgcatgccgaccacacggcacagcttggtttcgctggaaccctcacgattggcgattctcgcagtgtaatccgatccatacaatgccggacgaatattgtcgctcatgccgccgtcgacagacacgtacacgcgttccgtaaccggattgccagccttgtctttcgcggttccggcaagctgcaccggcttgaccgtgcccacacgatacagggtgacgccggtcggggcgaccgtccaacggcccggctcgaacgagatgaccggagcgggcatgccgagcgcacggttcacggtggtgaccgcatcggcaaggcgggcaagttccgtatcgagatccatggaatcctcgccatcggtgtaggccacggaatagccgccgcccaagtcgacctccggcagggtgtatgcgtcggtggcgtagaaggtcttgcgcagcagcatcatgcgcttcgcggcctggataaaggcgtccgcatcgtgaatgttcgatccgatatgcgaatgcacaccgaccagttcgagcacgtcctgatggcggtagatctccttcaatacggcgagcgcggggccatcagccaccatggtcatggcttcggcgagtttgcggtcgccttcggaaaccttctcgtggctcatgtcatacgggtatttgatgtcgtactgcagttggcgttctgcgctttcgcccggagtggcttcgctttcgcctaggcgtgcgttcgaccctgcgggggtcacgtcagccaaatcgtcgagcacgttcagcttgcttgcatcggcaccaaccggcagcaaggcgacaccgaacttctggtcctcatgcgcggtagacacgaattcgtggccgcccgcatgaatgccggacgtaacacgcaacatcacgcgagcgcgcttgccgagacgcttggcgatttcggcgatgcgggccggctcgttcggctcgtccaccacgattttggcgaagccttcggtaatggcgagttcgatttccgcatcggacttgttgttgccgtgcagcacgagtcgccgtccgggaacgcccgcggcgagcgcgatgcgcatctcgcccatggtgcaggtgtcgatcagcatgccggattcggtgacgatacggcagatttccttggaaagcagtgcttttccggcgaagctgacgtgggttacggtgttgttgaacgcatttgccgcggatttgacgaatttggcggcgcgggctcgcacgtcatcggtgtcgatgacgtagagcggcgaaccaaattcgttcagcaggctttcggcagtgcggccatggaacgtgatttcaccttgctcgttcacgttggagccggccggccagatgggggtgactgccatggcgatcacatcctgtctggggctgcaacgccaagcaggtcaaggccttcggcgataaccgtcttaacggcgtcattgagcttcaaacgtgcggctgcacgagccggttccggagccttggcgatgcgcagggcttcagcctgttcgccgcgagcttccggatcggtgagctccataggcaccacgcgttccacgttgtaccacttgtggtaggtggcggcgaggtcttccaagtaatgggctacgcgatgcggggcgcgcaggtctccggcttcgcgcagcagggccggccactgggcgagcgcggcaagcacttcgccgtcggcggcggtgtcgagcaggctcacgtcggcaccctcgtaggtgatgccggcagcagccgcattgcgatccacattgcaggagcgggcgtgcgcgtactgcacgtagtacaccggattctcgttggaatgcgaagcgagcaggttcaggtcgatgtcgaccggggaattgtagtcggtgcgtgccaacgaataacgggaggcatccacgccgatagcgtcggtcagatcgtcgatggtcaccacattgccggcgcgcttcgacatgcgcactgccttgccgtccttcagcacgttgacgagctggccgataagaatctgcatgttttcgccaggttcgtcgccgaatgcggcgcacatggccatcatgcggccgatatagccgtgatggtcggcacccagcatgtaaatggcgatgtctgccggatcgttgtcacgatgacgcttgttgcgatagtaagcaatatcagctgcgaaatacgcgtagttgccgtcggacttgataatcacacgatccttgtcgtcaccatgcttggtggattcgaaccaggttgcgccatccttttcgtaaatgtcgccgcgttcacgcagatcggcgatcgccttgtcgacttcaccatcggaatacaagctgttctcatggaaccacacgtcgaaattcacacggaaatccttcatggatttgcggatttcgtcgaacatcatcggcactgcacgcttgcggaattcctcacgctgttcggaatcgccctcacccagcggattgccatcgttgtcaacgccaccgtcgacgcgcggcaggtcgagaatcgcaataccgtcggcatttgcctcatcgatgacgcgacgtgcgatctcatcgatataagcgcccttgtaaccgtcgatcggggtttcctcaccgtgggcggccgcgaccagcgacttggcgaaacggttgatctgctcgccgtgatcgttgaaatagtattcgcgcaccaccttggcgccgttcgcctcaagcacgcgggccatggagtcgccgaccgcggcccaacgggtgccgccgatatggatcggaccggtcggattggcggacacgaattcaagattcagggtcttgccggaaagatggtcgttcttgccgtagttcgcaccctcgttaagcacagtgtcaaccacggctgcggcggacgcggaatcaagcacaatgttaatgaagccggggccggccacttccacggacttgatgccatcggcattggcgagttccgcggcgaacagttcggcgaaatcgtgaggcttcatgccggccttcttggccagctgcatggccgcgttcgacgcccaatcgccgtgcgcgcggtccttcggacgcatgacggcgaatttggcctgcggagggatgagatcggtggtcagggtgcctgccttgccttcattcacaaggttgttggcaatattgaaaatcagttcactaagcgcttctggactcattcctccaagtctaccgattatgcagacagaatcagccttgcgtatcgccccgcgtatcatcctgcagttcgccatgcttcctgcgccaagccaccgaagcgtaatagccgatatagcagatcgcaacgaacggaatcatatacagcaatgtggaacgctgcgacgaatcgcaaatcaccaaaaccaacgcgccgatgcacatcacaatcgcagcaatcggcacgaacgggaaaccgggggcacgatacttcaaatcgtcagccgaatgcccttgatcaagccactgcttgcggaaacgcaagtggcagacggaaaccgacgcccacaccaccagtgtggccaagccggaaaccgcaaccaacgccaaatacaccgtcgaagcggcaaccacggaagacaacaacgccaacagcgatccagccatgctgaacagcaccgcgaacacgggcacaccatggaaattcgtcttgccgagcacgcgcgggatcataccctcctgcgcaagcgaccagaccatgcgcgagcacacgtacaagccggaattcgcagcggaaagcactgccgtcaacaccacgaaattcatcacatcgccggcaaacggcatgccgatcgactggaacacgagcacaaacggactcgtgtcgacgcctgaccgatgccacggaatcagcgcggacatcaccgcaatcgaaccgatgaaaaaaatcgcaagacgcaacaccgtggtatgcacggccttcggaatcgcctgcgccggatccttcgtctcccccgccgcgacaccaacaacctcagtgcccgaaaatgcgaacaccaccgtcagcagcgtcgaaaaaatcggcagcacaccattggggaaccagccgtcattatagaaattctcaaacagcggtgcgtgatcgtaaccggcaatcggaatcgcaccaaacatggcaagcaagccgatcacaatgaacacgataatcgcaaacaccttaatggatgcgaaccagaattccgactcgccatacagcctcaccgacagaatattgagcatgaacaccaccgcaatgaaggcggcggaccaaatccacgcgggcgaatcaggaaaccaacgttgcatcagcagaccggctgccgtgaattccgaagcgagcgccaccgcccaattcagccaatacagcacggcgatggtgaacgcggtgccggggccgatgaaacgcttcgcatacaggtgaaagctgcccgcatacggcatggccaccgacagttcgccaaggctgagcatcacaaaatacacaagcatggatccgatgccatacgcgatgatcgcgccaagagggccggcttggtgaatcgtgtagccggagctgaggaacaagcccgtaccgatcacaccacctagcgaaatcatggtcagatggcgggtttccatcttgcgttcaagaccgccctgcttggcttcagcggattcagcggcgtcagtgtctgcagtggatgcgttgacttgcgattcggccatgcgcgactgctccttcatatttggatgggcgcgttcttgcgttcttgcgtttgcatgcgtttgcacaatacccaatcgcattactatacggaaatcggtggaatcatgttgcctgccgttcacttttagcggcaatcctgagattgcataaacaaaaacaggctcgcatgcagcgtaagaaaccgcatacgagcctgaaaaaggattttctggagatttgcaatcagcgcactgaaatcagagcacagcgatggcgtcgatctcaacgagagcgcccttcggaatgttgttgccgccgaacgcgacgcgggccggcttcacggagccgatgaaggtctgcgcatacacgtcgtcgatctcgtggaagtcttcgacgttcttcatgtagatggtggcgcggcagacgtgttcgatgccggtgcctgcggcgtcaagaatatgcttgatgttcttcagtgcctgggctgcctgctcgccggcggtttcgccagccagttcgccggtgactgggtcgatgcccagctggccggagacgaacacgaaaccgttggccttcacggcctggctgtatgcgcccagcgccgccggggcttcagaagtcgcaaccgcttccatcttctcgctcataatgttctcctttgaagaatgtgttatgcatgttgcttgcgttcaggccgcggcaaaccacgacaacgcaatctcaagcaatcactgtacccatggaatcgacacgcattgtcccatgttccaaataccggctccctgccccggctcttcacttgtctttgtggtgggcttgatggggatcgaacccacgaccttctgttccggagacagacgctctatccactgagctacaaacccgtgcgtcaaactactttacactgccttgagatgaaagcgacactttttacggaaaaacgatcttcgaatctcggatcattattgcgaaaacatagctacggcgggtctttcgacagcacacccaaccctagaggggaaataacgggcatagaacggggaaggaacgagagatagcgtgcgccacaacgaaatttgtagcaacataacaccatttgaagcgtcttttccactaaactgaaaatatggttgaggattcaggcagaaatataggcgatttcgaatacacgcgccgttttttctgccgtgccctgccgacgcagttggatgataacgacagtccgacgctgatcatacaaagttattacgtgcatcaggataattacgcgctgcgcgtgcgattgaaaacaaagtccgtccgcattgccatgactccggacctcgacccgctggctgtgctcgaaaagtatcgcgacgaattccggcttggatcagtcaccgtgaaagggccgtccgtgggaggcacgcgatatgaggcgagccgcgatttggattcgcgcatcgcaggggagctcatcaaacgcggcggacacgtgaccatcaaaaaccgtttcaccgactggatcgatgaggacggctggaacatcgacgtgttcggaggcaccaacgctcccctgatcattgcggaagcggaacgtatcgggccggtcaccaatctggtgatcccgaaattctgcaccaccgaaatcaccgaccaatcgcggttcagcaatgaagggcttgccgcgaatccatattcacgatggaaatccgaattcgaagacgaactggaagcagacggaccgcaattcctcgactatttcggcaccaaccgtatggaataagtcttttttaaaaaaaaacaaccgtaggccgtaaagaacgatgtagttgcgcagcctacggttgagcggtacctaaacggtacctaaagtcaataaacgagtcagtacatgagcgtggcgaggcgacggcgggcgcgcttcaaacgctcgtcggtcggctcaggaatcgtgaaatattccagcagacgcttgcgcaccggttcaatatcggccttatggccggccgcaacgaaatccagcaaacgatcgaacgcatcctgaatctgaccgccgatcatatcaatgtcagcgacggcaagctgtgcttcaacatcatcgggattgtcggcagcggcggcacgcacctcacgcacgttcgcattggcggaacgggccaacagcaacgccttcgcacgctcgcgggcggcacgcgcatcgttcggatcggcttcaagcaccttctcgtacgcggctgcggcgccagcgtaatcgccctgctgtgccagcatatacgcctcctgatgctccggaggcacctgctcctgggcgccggcagcggaagccgagtttgccgcatcggaattcggatcgccggaatacggcgcggaaccggtcacaccggcctgctgcgcggctgcgaccagattcggaatcaccgtatccacgatctgctgcatttcctcagcggacggcaagccctgcaaaatcggcatcggacggccgttgatcaacgcgaacaatgcaggcgcgccctgcacttggaacgcctgcgcgatcgacgaattcgacgcgatatcgatacgagacagctgaatctggccgttcagctggttcacggcatcgcccagctggcgtgccatgtcgaacaggcgatcatcggtcggcacccacagcagcaacaggatcgggaacgtggccgacgtctgcaccatggcctggaacgtgttctccgtggtgtcgatcacataaccgcctgcggccggagcgcctccagcctgccccggctcagccttcacctgatgcttcaacgcttcaagatcgacggctcccgccaaggaaactcccggattaaacggcctttgacctgccatgcttgcctcctagatatcaacaatcaacaacattaagcgcccggcgtaacacgcattgcaaacgttcgccccaagcttacgcgcattcgtgcgactgccacgatcacagtgcctcaacacgaaccggctggcgctcggaaccgactgcagtgatcttcgcgtcagaatttgccggaggcacgtacagcgcgaccacattcacatacgtggttttcatggtgctggtggcctgaccgtcgccaaacagcgctttttccgcatcggaagcgggctgcgactcacggccggagccagctgaacgcgtccattcggaattgatctgcgccaccaccagatcgccaccatccgcggaacgcataacgctgatggcatcgtcaaccggtgtgaacacctgctgctgcgatccctcgttcaactccatggccttctgcacctgttcggtcagatcggcaagcttcgtacgcaaatcgtcgtcggcaaacttctgcgcatactggctggacgcaccattctgcaacacgtcggcatacgcggcgaccgcatccttcggggtcatgaccagaccggtgtctttttccgttccctgctcgctaccggttttggaaatctcaaaactcggcattttcacgcccgaaaacagtcgtgccacaccccacaacttgtagttctgacgtgcggaatcctggcggaacaccagcagacgcttggactgctggtcatccgtggtggaagtgatggaaaacaccgaacgcggccatccactgtccgtggaaatcacggcctgcgcaagatcagttggaatcgtggtcttgcggtcaagattgcccgtgacctgcgccacatgaagttcgctagtgcgaatctcaagttccggcccctccaaaatcgaaccgagggcgtcgatattgcgatcgttattgcactggtcaagcgttttgagaatattcgtacggatggttttctcttgcttggcggtcagattcggcgcatcttgacgttgcgtggttttcggctgcggcagctgcccctcgcatccgcacatgccaacgaccattcccaatgcgagtacggccgccgcgattacgttgaaacgcttcttcatcacttggcctcctcgttgtcaggttcgtcggacttgtcgttgtcggattcgtcgttttcggatgtttcgttggatccgaccgactcggtcgttacggccatttcgtcaacttcgttgggcacgttgatttcatcggataccgcgaattctacagatcccgaggccgctgcggccgcactgctttcctcttgtgcgagacgtgcgaaatatgcggcaagctcgtcttgcgaaatcacggaagtctgttcgaaatcgtcgttttcttcaacaccatcagcggcagcgttctgctgatcggcaacgagattgcgcgcgccgggatcgacaatcgtaggctgcgcaacttcgttttggctattttccgaaccactcgcgcgatgcccagcatgacggcgacgcttacgcttcggcccgctcttttcgctacgggcggcactcgcttcggcgttcttcacccatgcggcaacctcgtcatcgtcaccctgcgtggaaccgatgccgtcaaccatggcaaacgcgcgcttgttgcgacgcttatgcggaggcatggcaaacacggaagccgaaagcaccgcaagtattgccagcaatccgccggaaagatagaacggcatggcgaaattcagcatcgaacgacggttccaatcaagtgtgaccgaacctcccttgcgattgccataatcgataatcgcaacggaatcctcggcattattcgtattagcacccttgaactgcatatcaacggaaccggcattgcatttgacggtgcgccacatgtcggaatcctggaaggcgacctggccttcggaattatcggcggtgccctgagccgtggtcttcagcgtggacagggtggaccagtcggacagtccggtgacgcgcgtgtatttggatcccgcgatccatccggcgatatcgcgggcggaaccgatggcgatgcacacgttcgcggatttgtcgcgcgacttcgccgaaatggtgacgcgatcgtcaaccaattgcagcacattcggatcggtgaccacatactgcgatcccgtaaccgaggcggacgccgtgacctgtgccgagggcttccaaatcgtcgcgttcaagacgccaagcacgatgcaagcaatggcaagcaagccgaaaataggcgtgacaatgccgcgcataatcttggcgtgtcgcgtgggacccgccttggactgcggcttttcctgttcttcctgcaataaagtcatagcattcactattctacattgcctctctgcaaaagcctgaaaaaactatgaaaatcaatgattgccactaaagtggaacctatgcgcaaatctactcttttcaaagccgtcgcagccgcctgcacaacgatcatgtgcttgggtttcgcggcatgcggaagttccgacacgaagtctgattcctcctccgattcatcttcgtcttcttccgattcctcgtcgaagatgaatcagatcgccggtgtgaccgccacaggtgagcccggtgagaagccgaccgtctccttcaaaacccctatgacggtggaagacaacagctacgtcgtattgcagaaaggcaatggcgaccagattgaagacggcgaccgcatatgcacgcagggtatcgccatcaatgtcaaggatggttccgaactcatgagcacctgggagaaaaacacccccgattgctctacgatggtcacctccgacaccagtcagatgactgaggattattacaacattttcaaggatcagaagcttaacgccacgcttgcgttcggtgtgaacgattcgaattccgctggcacctcctatttgatggtgctcacgatcgtgtcgaagtcgaaggatctgacgaaggcaacgggcacgaaggtgcttgacgttcctgccgatctgccgaaggtgacgcttgcgaaggatggcaagccgtcgatcgatatgaacggatacaagggttccgacacgttgatctcgcaggatttgatcaggggcgaaggcgccgaggtcaaggatacgcagaccgtgatcgcgcactataccggatggctgcttgacggcacacagttcgattcctcgtgggatcgcggtgcttcgtcgagcttctcgcttgatgaggtgatcaccggttggaagcagggcttggcagggcataccgtcggctcgcaggtgctgctggtcgtgccgccggaccttggctatggagacaaggattccggcaagattccagcgaactccacgttggtcttcgtagtcgacatcctcgccgcctactgatctacatcacgattcgcttataaaaactccctgcataacaacagggagttttttataagctagaagagtcgtagggagtcgtcttcggcacctttcatttcgtcatagtcgaggatcaggcagtcgaagccgcggtcctgagcgagcacgcgggcttgcggcgtgatggtctgcgcggcgaaaatgccacgcacgggggccaacagcgggtctcggttcaacagctcgcagtaacgggtgagctgctccacgccatcgatgccgccgttacgtttgatttcgatggcaacatgcttgccactgccgtcgatggccataatgtcgaccggtccgatggcggtcgggtattcgcggcgcaccaatgtcgcaccttctccgatgcgttcgatctgttcggccagatacttctgcagatggtcttcgacaccgtctttgatcagccccggatcttcgcccaaatcgtatgtttcgtcggaataaatatgctgcaatgtcacttcgagcacgtcattggatttatccgccgaagcacgaatgactttctgcggaacctccgtagtcacgtcgtcgtcggcatgttccggagtgatgtctttgatggtgcagggcgccgccatccagttgagtggcttgtacgaaccaagttcggagaaaatcagcagactgttatcggctttgataagcaacacacgcttggcgagcggcaaggacgcattcaaacgcccggaatattcggcagagcaatcagcaacaataattcgcacgaggcactaccctaccatgattgtcgtaagccatgaatcccacgatatgtacaatcctatttttgttttgattaatcttttttgaaaaaaaacagtccgtctgctgcaactacagaatcgcaatcatatgcaattgctgcaatcgcaacagacggaccgtcagaagtatgctaccgagtgctactctgccatcttgacgtcacgtccacgctcaaccgcaacggtgagcttgttcgaatcgaaggagatgaaaccgtcggtcacttcgaaggagcgacggctgccatccggatccaccacaacgatggttccttccttgattacggtcaatacaggctcgtggttgggcaggatgcccattccgccttcaaaggcaggaatggtgacggacttcgccgtaccgtgccacacggggtggtcggcggcgacgatgttcacctgcattgtcaatccggccatcacgcaccgtattccttctgcatgtcgtgccacttcttctcgagatcgtcgatgccgccgataccggagaatgcctgctccggaacgtcgtcgtacacgccgtcgcaaatgcgggtgaacgcttcgatggtctcatcggccggcacgtaggagcccggacgaccggtgaacttttcagcgacgtagaagttctggccgaggaactgctcgatcttacgagcgcggttcacggtggtcttgtcttcttcgccgagttcgtcgataccgatcagagcgatgatgtcctgcagctccttgttacgctgcagaatcgccttgacgcggttcgcgcaatcgtagtgagcctggcccacgtaacgcggatcaaggattcgcgaggtggagctcagcgggtccactgccggatagatacccttggaagcgatgtcacgggaaagctcggtggttgcatccaagtgggcgaaggtcgttgcaggagccgggtcggtgtaatcatcggccggcacatagatggcctgcagcgaggtgatggagtgaccgcgggtcgaagtgatgcgctcctgcagggcacccatttcgtcagccaggttcggctggtagcccactgcggacggcatacggccgagcagggtggacacctcggaaccagcctgggtgaaacggaagatgttatcgatgaacagcagcacgtcctgattttgcacgtcacggaagtactctgccatggtcagtgcggtcagcggcacgcgcagacgggtacccggctgctcatccatctggccgaagaccagtgcggtcttctcaagaacgccagcctcatccatttcgccgatcagatcgttaccctcacgggtacgctcgccgacgcctgcgaacacggacacaccgccgtggttctgggcgactcgctggatcatttcctgaataagcacggtcttgccgacgcctgcgccaccgaacagaccgatcttgccgccctgcacgtacggggtcagcaaatcgatgaccttgataccggtttcgaacatctgggtcttggattccagctgatcgaatgccggcgggttgcggtggataggccaacgctcggtgaccgtgatggtttcgtcatccttcttgttgaggatgttgccggacacgtcgaacacgtgacccttggtgacatcgccaacaggaacggagatcggaccgccggtgtcgagcacggtggcgccacgaacgaggccgtcggtcggcttcagcgccacggtacgcacggtagagtcgccaaggtgctgttcgacctcaagcgtgatcttcttcgtggtttcgccctcttcgttggcggtgttggtcagctcaacggtaagtgcgttgtaaatgtcgggcaggtggcccaccgggaattcgacgtcgataaccgaaccctggatacgcgtgacgcgtccagtggtcggctctgcagccgtctcgggagccgctgtggtctgattctcagccatatgcgttcctactcttccttcttattcagcgcgtcggcgctgccgatgatttcggtaagttcctgggtaatcgaagcctgtcgcgaagcgttgagcttgcgggtcaggtcgtcgatcaggctgcgggcgttgtctgtagccgtatgcatggcgttctgtcggcttgcagtctcggatgccgccgcggtgagcaggcattcatgaatacgggactggatgtacttcggcagaatcgcgtcaagcacttcgtcgacgctcggctcgaacgcataaagcggggtcgcggcatcggcatcggattcgggcacagggccggagtcctgctgttccggaagcacgagttcaacgggcagcatacgcagcacgcgcaccttctgaacgaccatattcacgaattcggtgaacacaatgtaaagttcggaaactccaccttcgctcgccggcttcatgtaggcgtccatcagtgccttcgagatggactctgcgacttccacgccgggctggtcggtatcgccttcccaagtaccggcaacatcacgattgcggtacttgtagtacgtcacaccgcgacgaccatacacatacagttccggctgcttgcctgccgcatcgaggcgggccagcagcgattccgtttcgcggatgatcgaggaggtgtacggacccgccataccacgatccgaggtgagggcgaggacagccacgcgagggttgtcctcgtccttcttcacgatcggatggtcgatatgggtgtgggccaccagcgcttgcacggcgtcgaaaatcgcatcggtatacggcttcgcgttcaaggcgacgtcacgtgccttggcgatatgcgaagacgcgatcatctcctgcgcgttgaagattttctccaacgacgcggtggaggcgatcctagatttcaatgcgagttgcgagcccatggatcacttctctcctgcgacgatcttttcctgctcgaccggggtggcgttcttgacgttaggcttcttctcgaccagcggcttgcccgcgctggtcacgaaagtctcacggaacgcttccacagccttgtcgagggcagcctcggtgtcggcggtgaaatcttcggtctcgcggatggtcttgagaatatcggtgttgtggtccaggtagtccagcatggccttctcgaacggcagcacgtcgttcagcggcagatcatccatcttgccatgggtgccggcccacacggagacgacttcctgttccatggaatacggggagaactgcggctgcttgagcagctcggtcaagtgggaaccacggttcagctgggccttcgaagccgcatccagatcggaagcgaacatggcgaaggattccagggaacggtactgggccaaggagatcttcagcgtgccggagaccttcttcaacgccttggtctgtgccgcgccaccaactcgggacacggagatgccgacgtcgacagccggacgctggttcgcgttgaacaggtcggactgcaggaagatctgaccgtcggtgatggagatcacgttggtcggaatgtatgcggacacgtcgtttgccttggtttcgacgatcggcaggccggtcatcgaaccgccgccgaggtcatcggaaaccttggcgcagcgttcgagcagacgggaatgcaggtagaacacatcgcccgggtatgcctcacgtcccggcgggcggcgcagcagcagggagatcgaacggtaggcttcagcctgcttcgacagatcgtcgaagacgatgagcacgtgcttgccgttgtacatccagtgctgtccgatggcggaaccggtgtacggtgcgatgtacttgaaacctgcggaatcggaagccggggaggccacgatagtggtgtactccatggcgccggactcttcgagggactgcttcaccgatgcgatggtggagcccttctggccgatagccacgtagatgcagcggacctgcttcttcggatcaccggattcccaattacgcttctggttgatgatcgtatcgattgcgatagcggtcttaccggtctggcggtcgccaatgatgagctggcgctggccacggccgataggcgtcattgcgtcgatggccttcagaccggtggacattggctcgtcaaccggatgacgatgcataacgtcaggtgcctgggcctcgagaatacgacggccttcggtcttgatctcgccaagaccatcaatcgggttgcctagcgggtccacgacgcggccaaggtagccgtcgccgacgggcacggagagcacttcgccggtacgacgcacttcctggccttcctcgatacctgcgaagtcgccgagaataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcagtcgcgacataaccgacttcctgagtcggggtatccgacggcttgtacgactcgacgaactcatcgagcgccttgcgtatcgtggtgggatcaatggtaagttctgccatgatcactccttattgttgtttataaattcagtcaagtcttgtttcaggcttgttcaccgtgcggcgaaccgtcaggcggttgccttcaccgtgcgctgaagatgctgcagctgtgcgaccaccgtgttgtcggtgacctcgtcgcccacctggatgcgcatgccacccatgacggtcggatcgaccaccgagttgatgtgcaccggatgaccggtcttcgccgagtaaatggcgatgagcttttccacctgctccttgctcaacggcgttgccgtggtaacagtgaccatcgattcgcccatatggcgggagaatttgttgatcagccactgaatggtctgcaagtagcggcgattgcgcagattgcaggtcgcgtgttcggccaggcgcttggtcaccttggtgaaatccgcgtctccaatcaggctgtacagcagcttgacacgggcttcactggaaacggttgcgtcatacagcttggtacgcacgaccggaaggttgagcagtgcggaatgcaactctgcaagctcgatggagacctgcaaagtcgtattggtgtaatccgcgtagtacatcatgccatcaacgccgaaatcctcaacggcattggcgatatcagacacgcggctccaacggcgagacaccagatcggacatgatctccatcacgagcggatgggcctggtctccgatcagagtcttgactaccgcaaccttgtcttcgactgggcgcgacgggtcggtgagggcacgttcaagctggatattgtggtcaagcgcgctggtgatcgtgaacagttcgttcccgatacgccatgcgtcctcaccgctgtcacgcagcttgggggccagcgagtcacgcgatacgcggtctgcgatacgcgatgcttctcctcgcattggtcacctccctttcttgaaggtttcgatcacttcttgtcgctgtccaagtcggcgatcatctggtcgatcatcgacgactgcacatcgtcattctcgagcttgctacccaggatcttgccggccagtgccgttgccagcacgccgacctcacccttgaggctcaccagagcctgctgctgctgcgattcgatggaacgctgggcggtggcggtgatctgcgccgcatcgttttcggcacgagtgcgcgcgtcagcgatgatatgcgatgcctccgtacgtgcgtcgtcacggatcttggatgcctcgacgcgagctttgctcagctgagcctcatacttcgccttggcttcatcggcatctttctgggcctgttcggccttggcgatgccaccttcgatcttggcagcgcgctcatcgaacacggcctggaacttcggcaggaagaacttgtagaagaacacggcgacgatgatcagaatgaccaacgaccagaaaatgtcgtagcttttcggaaggaacaattccatttcgctagctgcggtcaccatagtgtcttcctcctttcatgttcgtttgcgtcttcggtgttaccttgaatcaagtcttacttgatgaaggcgagcacgaagccgagcagtgccagcacctcgacgaatgccagacccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacaattaaaaagccggcggtcagtcgatctccggatagctcatattgatgtatgcggtggtcaggatggcgaagatgtaagcctgcaggcaagcgaccagcgcttcgaacaggaacatgaacatgccagccgcgaaggtgacgacgccgaatggcatgaacaccttgttcaccacatcaatgaggaagtactgcgtggccgaaaggcacagcgcaagaatcaagtggcccgaaaccatgttggcgaacagtcggatcgtcaacgagaacggacggataatcagcagctcaagcagctgaatcggggacagcagaatgtagatcggggccggaacacccttcgggaagatctcatccctcaggaagtggccgaggcccttttcacgaatgcctgcaatccagtattggcagaagcaccacatggcgaataccagcggcagcgtaatggttgcgcttgccgcgatattgaagcctgggatgatgccacacagattgaagaccaacaacgtgcagaacacggtggtgatcatcggcacataacgcttgccgcgcagctcgcccatcacctgatagacgatgttgtcacggacgaattcgatcaaccattcgactgctccctgccaacggctggggatgagctttgcacggcttgccgtaattccgagaaccagcaacatgatgacggtcgcaaggatgcgaacgaggatgatgcggttgatggcgaacggcgtgccctgaaaaacgaacggatcgggaaggaagtcatcgacactgggcatttcgggaccatcagcgatggtcagcatgccctttcccaatgcaccaatcattcacgcctcctgctcttgtgtcagctgttagtttaacccaacaaccgagtcgaatgtgacgttctggttacttaaccaaagcgtacttcgaagtgcgcgtcgacgcgaacggagtcccgtgcgacgcattcgactccgaatggctggataggattattagcccgtgtctagacaacatccacacacttgggcttttccatactcccatttggttttaccggcgtttcgcagcaagctgtactaactagacacagctttgtgaatcgtcggatagccgacgcaaccaatagtttgttttacgaaaacagcatattgataaaacgtttcaccaagtatatcacatataacacaggtgctgtatataaagaaagaggggccgcatacgcaagcccccaccagtaaacagccgtaaagtcacgcgccaatcacggccgcacgtcaatcacatcaatatgcggatcaatccacaaatcaatcgtgaatcacgccataaccgtcacgcacgaacggcgcaaacgcgtcgacacgcggcgaacccggctgatgacgaatcgaacgatccgtgccaagacgcttctgcgcacgaagctgcggaacctcgctcaaatcgtatggcgtggtctgatacacccaattcagccaattgcgccacaggagattggcatgggcgcgccacgcgaacaccggctccaactgcggatcatcatgcgggaaatagttttcggggaacggcacattcgtcatgcccttcttcatatcacgctcatactcctcggccaaggtgtacttgccgtactcccaatggccaagcgcgaacacttccgaaaaatcacgggtggcgatcagcccaggaccggacttcggaccccacgtgagcacctgcaactccggattgcgcgcgatatcaccctcgtccacccccgcaaggcgagaatgcggctgcaggcaaatctcatcgaagccgttcgtcaaaaagcagtattcatcctgcaaatactgcggaaacacgccaaaaatcttctctggcaaattctctttacgcacgttatagcgataattgagcgcacccatcgcgccccagcacaaatacatagtggagaacacatgcgcggaagcccagtcaagaatctgcttgaactcatcccaataatcgacctgttcgaaatcaagatgctcaacaggggcacccgtcaccacgaagccgtcgtaatagttgtcttggaacgcctcaatggtctcatagaacttcaccagatggtcggcgctcacatgcgtaccctcgtgcgtggaggtcttcatgaaatcgatctccacctgcagcggacttttcgagatcaaacgcagcagctgcgtttccgtctcgattttcttcggcatgagatttaagatcaccagcttgagcggacgcacgcgctggcgctccgcttcaggcttttcaagcgcgaaaatacgctcggagtcgagaatgtctctggccggaaggccgctggggatcttgataggcatgcttctattatggtgcgggctcggatatggcgcacttccctgcccccacgatcagccgaaaccgttataggaaaaatgaataacgcgctatttgcaacgcggttttgcatggccggactgatgcgacacgccgatttgacatatttggaagtaatcgtaaagttaatagagctgtcttaaagacaagccgacgcggggtggagcagctcggtagctcgctgggctcataacccagaggtccatggttcaaatccatgccccgctactgatgaaagctaggaattgcaacaattcctagcttttttgttttccgtcaaatctcaccaaaaccaatttccggacaaaatctggacaaaatccgacaaaaaccgggtatatcagccgagttcatcaatcgcatgtgccgaaagtatggagaaaatgcgccggatccgccaatcgcatgtgccgaaagcgaagattgccgctcaaggctgaaaatccaacgttctccaaggttgcacgcgctacgttgacctcgccaaccacatatcaccagatataaggagaacaaggcaatgcattatatgaatcaagcgaacgcgcacaacgcgacgcaggacaccacaatgcaagacagcgcaacgcacgatacggcaacaaaggcaacgcaggacaccgcgccgctgaaaggcatcaccgtgattgactggacgcaggtgcagtccggcccgtcgtgcacgcagatgctcgcatggatgggcgccgacgtcatcaaggtggagaaggtgcagggcggagatccgacacgtaatgaaatgaacgacgtggatggctcgtactccctgtacttccttcagctcaatgccaacaagaaatccatcacgctgaacatgagagatccggaaggcaagaaaatcctcgccgaactcctgaagaaagccgacgtgttcgtagagaatatcggcccgggagacgtggaaaagcttggtttcggatggaatgacgtacatgcgatcaatccgcgtctgatcatggcgtcgctgaagggcttcaacaagggcagccggttcgagcatgtcaaggcgttcgagccggtcgcgcagtccgcgggcggtgccgcttccaccaccggctggtatgacggcgagcgcaatgtgcccacgcagtccggcgccgcattgggcgattccaacagcggaatgcatctgctgatcgccattctttcggcgctgttgcagcgcgagcataccggtgagggttgctatgtgtaccagtcgatgcagaatgcggtgctgaacttgtgccgtgtcaagctgcgcgaccagttgattctcgaccgtttgggcaagctttcctactatgactgctacccgaattatgagtggggcaagcaaggcaaagccattccgcgcgcagcgaatgcggagggtggtttggtgcttggctggtgctaccgcgcgaaaggctgggagcatgacccgaacgcttacgtatatatagtggttcaacagtccaagaagggcttcgagaatttctgccatgcgatgggattcgaggattggctgaccgacccgcgtttcaataccgccaatgcgcgtgacgagcataaaaccgaggtgtaccagcgtgttgaggcgtacaccatgcagttcgacaagtacacgctgaccaaggaattgggtgcgaagggcgtgccggtcggcccggtgttggattggtatgagttggagaacgatcctgatttgaatggggatggcacgattgtgaccattgaccagcaggatgcgcgcggcgatttcaagacgatcggcatgccgtttacgatgagtaatttcgtgccggattaccagcgtgcgccgaagctgggcgagcataaccgtgagattctgcatgcgttgggatatgacgacgatcagatcgcttcgctgcgtgattccggtgtgatcggcggcaacgatggcgtgcaggctgatttgaagtaacgcacgttagcgcgcactggcgcacgaataagggcggatcacaagattcgcccttatttgttatgcgtcacatccattgcagtccacgccccgcacttccgcacacaaccacatgtcttacgtcttacggtttaccgtcacaaaaagcgcatgcagtaacggaacgttggaatttcaacgttccgttactatatgcgcttcgtgagctacagtgaggatactgaatcagcccacgcagaaggggacgagccagatccacagcagacaggtggccgcgaatgccaccgtggcgacggccgtggtcgaggcgccttcttttacataaatgttgtaacggctggaaataatgatgcctgagaacgccggcggcaacgcgaccgccatcaccagcatcgaaatcttgttcatgtcaccgcccatgccacacaacagcgccacgccaaggaacactgcaggcgtcagaatcaggcggaagaacgtgttccagatggtttcccaaccgagcgagaatttcaccgtggaaagcgcgaggcccgcggaaagcacggccacaccggaattcgctttggcgatcagatcgaaggtcggcgccacctggcttggcacatgaatgcccaccaacactaggaaaatggccaataacgacgcccagcagatcggttgcttcagtgcgtcgagcaacgcctgcagattgccgttgcggttctttcccgtattcgacgtgccatgcaccataagttcggcggttttgtcggttgcggcatctcgcgccgggtcaagcgtgatatcgccttttgcattggcctttgcattgaccgcgttttcggcctgcacgctaaacttcgctcggtctttggcctggccgaggttgatcagatacatgccgatcggaatggtcaccacgttgaccacgatggaaataatggctatgacgagattcgtgctgacggtgttgccgtaaatcggatcaagcacagcgaatccaaggaaaccaatcgtcggagatcctgcgatcagagcacagacggccgcctcctgaatgctgcggtggaacagcaaccggcacagataatagctcaccataaacatgacgatgacgccgatgaaactgatggcggtcaatgttgcgtctttcgcaagcattgcacgggtcgatttgatgatggacacaaataacgccgcaggaagcgcgatattcaacacaagtttattaagtccctgccgctgatcgtcatcaaaataactgaattttccacaaatataccctaatgccataatgacaataattggcacgatgtcgtcaacaagtatgtttatcactgtcgttctttctttatattttttctatctgcaatcttctgcaatattgtttgattgctgatattgcagatacgttgatcggatcattggttttcaggcagaaaaagtgggcgcacgcattccaccgttcgcacgcccacatgtcataccgacaaccgatgcgctacatgcgagcgccggtcgcgtagtcgtacatggtgacttcggaatcaacgagggctccgaccaccggcttcggattcaacgctccgatattgccggattccttgcccgcatactgcgcgatctgcacatgcacgaagcttggcttgcctgattcgaccgcctcgccgaccatgcgttcgacttcttccggagtgctggcatagtaacctttacccccgaacgcttcgaggaccttctcgtaatgcgcgttgtaagtaagcgtcagcggcgacggatcaccgtccgctccaaggttttcgaagtcgccgcggtagataccgccgttgttgagcaccacgaaggtgatgggcagctggtagcggcaggccacctccacttccataccatcgaagccgaatgcggaatcgccgccgatgtacagcactttcttgccagtggaaagcgccgcgccaatcgcatagccggtgccgcagcccatcacaccccacgtgccgcagtccaaacgatggcgcggttcgagcatgtcgatgatgttgcggcaatcatcgagcgaattggctccctcattggtgagaatgagatcttcatggtgtttgttgtacacctttttgatggctcccaaggcgttgaaatggctcatgggcagctgatcggattgttcgcgggtttcaaatttcgccacgtttttcgcgctggcttccttcagcatgttcagccaggtttcgtcagctttgaacgggtattcttccagagatccgttgagcagcgtcatggcggaacgaatatcccccacgattggtacgtcgatactgcgcgtgttttcgatttcttccggattgatgtcgatttggatgaatttcacatgttcgttccacgttttgccctggccgaacgacagcatccagttgagtcgcgcgccgaccagcaataccacgtcggcgttgcgtagcgcgatggaacggcagcttgccgtgctgtgtgggtcggtatcgggcactacgcctttggccatggacattggctggaatggaatatccgttttcttgacgaattcgcggatttcctcttcggcgcgggcgattgcggcgcctttgccgatcaccatgagcggacgttcggcctgccgcagcaatgcgagcgccgcgtcgatggatttgcgtgccggcaccatggcgggggccgggtcggttgccgtccacatcaggcggtcggcttcgctttggctcagggtctgcgccacggtgtcatcggggaaatcgatgtacaccgcgcctgggcgtcctgaagaggcgatatgcatggcacgggccaccgcgagcggaatatcttcgatgcggtcgatgcgcagcgaagccttgcagaactgcttggcgtagttcatctggtcgaggccttcgtattcgccttcctcaaggtcgaccacatggcgggttgaggagccgccgatcatgatgaccggatagccgttcaccgtggcttccagcagtgccggtagaccgttgaggaatcctggagcggataccgtcaacgtgacagccggccgaccggtgatgaatccgtcggccgcggccgcgttcacagcgtcctcctcatggcgcatgcccacgaatcgcatacccatgccctgcgcgatgcgcgcgaaatcggtgacgggaatgccgaccacgccatacatgtttcgtatgccgttggccatcagcacccgcgccagataatgcggcgcatcggtgaccttccgatcatcggctccctgccgttcggcatccgcacgcatgctcgcgaccatcgtttcatctgcatgttcttctgtcatcgcaacctccattcgtatcgacgacgccatgattgtagatacgtgaaaatgggagttcgtcagcagaaaaatatgttcgtctgcggcttaatttcaacgttttcagcatgatatagccgtattctcacgcacatgcggaatatattgcagctgaaatatcgcaactctcatcgagaagcatcacctccgcgagacgacatcatcgccgcatatcatcgtcgccgtaccgcatacagcatgaacgccccgcagcacatcacggcagccgccaaacccaacaccagccccatcggacttcctgtctgcggcatttcctgctcgggggcataaaggttgtcgacattgaacgtcagcaggctatcctcacgttccaccacatcgttcagcaccatcattttctgcgcggtgacggcctcatccaatcccacggactggtatccgaccttgatattgacctcgccggcacccgttgcatgccaatacacggtggttccctccagttcggcccagccgactgccgtgggctcgtcgtcctcgtcgaacacggccggaccttcgatcgtcgccgtgaatacgccctcgatcggctgtccactcgaatccagcaactgcacgaacaggcttccggaccgcaatccctgccgatcatcacgcgtcaccctcgaagaaaccggcagcttgttcgcggcctcctcccaaagctcgttgaccttgctttccagcccgtccatcaccgagaagaggtattgctcatgcctgacccacaccttttggtcgtcatagttgcggtgcaccagcacgccgatcgccgcatacgtgagcaccggttccccgtcatgttgatattcggacagcagccatgcgaggcgccgcgccgcttccgtattttccacggtggtggtttcggtgaccttatagtcggtcatgctttcgatttgccggcaataatagaatttgcccgatctcgattccgcgttcaccccgatcacatacggttttccatcgagaaaatagttgtaatgcttgccgttcgcgcgcagcagctgttcggcggccagcgcggccgggcaggtcattcccacgattatgatgcaggccgccaataccgcggccagaatcgcaagcgtatgtcgtttcatcgcattcatcgcatcgtcctttcgatatgcacatcgttgttgtcgtaattcaacaggcttgcatacttgcgattgccacatggcctttttcaagggttgtggtcggaggacgttctttttgccgtttttgtggacaacttcgcttgtcagcaaacgtaacttatccacaaaaaacgttttaccaatcgtaggtaaacaagttatccacaaagggtggaaatcgctggtcggaagatagttcacccaaatccaccttttctcctctataatcggcggtatggcagaagaagataagagcgcggaaccgcgcaccaccgcaaccaagcaaccagccgtcaagaagacgaccgccaaaagcgcggccgccaaaacggcatcggcaacgtctcagacgcctagcaagcgcaccgccgcagccaaaaagtccacggcatccaccgctcgcaagcgcaccaccaaagcgaaggccgccgcaccgcaaacggtcggcgaagccccagcccccgtcatcgaacgcaccagccccgaacagttcggccgcgtgaacgtgctcgacatcaccccgaacgttgagaacggcctgttcccggcacgcgtggagctcggcgaagcattcaacgtcaccgcccaagtgttcatcgaaggccgcaccaaggcaggagcgaccgtgtccgtgcgtaacgcacgcggccgcgaggttgaacgtttcgccatgacctgcaccaatccgggcctcgaccgctgggaagccatggtcaagatcggcgaacacagcgatctgaagccgtgggatgccgattatgccgccgtcaagcgtcagctgggcaaatggcagatcgtgatcgaaggctgggaagacacctaccagtcttggctgcacgacgccgccatcaaggttaaagtgaatgacgacgtggagaatgcgctggaatccggcgcacagctgctcgcacgttgggctgacgcgaaggattccaagctttccgcagccgacaagaaggtgctgcgcgacgccgccaagaccatggaaaacaagtcgctgagcgccgaagagcgtctcgccgcagtccagagcagcgacatcgagcagctgcacgaaaccaacccgttgcgcgacggcctgtccgagtcgaatccgcagcgtttccgtgtggaacgcccgaagtccagcttcgcctcctggtatcagttcttcccacgttccgaaggagcctactacggtgaagacggcaagatcgttcccggcaacctcaagacgtcgatcgccggcttggaacgcgccgcagccgaaggcttcaacattgtgtatttgccgccgatcttcccgattggcgtgaccaaccgcaagggacgcaacaattccctggtagccggcccgaacgatccgggctccccgttcggcatcggctccgaactgggtggccacgacaccgttgacccgcagcttggcaccatggacgatttcaaggcattctgcgagcgcgcccacgagctgggcttggaaatcgcgcttgatttcgctttgcagtgctcgcctgaccatccgtgggtcaaggcgcatccgaactggttccgcaccaagccggacggcaccatcgcattcgcagagaatccaccgaagaagtatcaggacatttacccgatcgacttcaatgccgacatggaaggcatcgaaaaggaagtcgaacgcattatggatctgtgggtcaaggcgggtgtgacgatcttccgcgttgacaatcctcacaccaagccggtgcgtttctggcaggatgtgattgccgccgttacgaagaagcatccggaagtgctgttccttgccgaggcgttcacccgcccgggcatgatgcgcgcgctgagctatgtgggcttcacgcagtcgcactgctacttcccgtggcgtaacaccaaggaagagctcgaagagtacctcgaagagaccaacggcaatggcggcttctaccagcacaacacgttctggcccaccactccggatattctcaccgcctacgtgcgcgacaacggcattgccggccatgcggtgcgtgcggtgctcgccgctatgggcagcccgagctggggtatttacaacggctacgagctgatcgaaaacaagcagcgtccgggcttcgaagagcagatcgacaacgagaagtacgaagtcaaggtgcgcgattgggacagcaccgaaaagtacggcatcgccgaactgctgacctcgctcaacaagatccgtgacactcacccggcttgccgcagctaccacaacctgcacattctgccgagcgacgacgcgggcgtgatcgcattcctgcgtcagactccggccgaactgaccggtaccggcaaggcagatacgatgatcgtgatcgtgaacctcgacggacacaacgcgcaccagtccattgtgcacatcgagcttggcgacttcggtttcgccaccgacaagccgctcaaggtgcatgatgagctgaccggccgcgacttcgaatggggttacgacaactacgtttcgctcgccccttgggccgacgtggcacacgtgctcaccgtagtcgaagactgattgagtctcaatcgatctgattaatctcggtcagctcgactagaaattcgtttcgattcataccacaataccggttccacttcggtggaaagcggtattgtggttactgataatgcaaactgcccaatctcaaggagaaatgacatggcagaaaccttcaacgtcgtggtggaaattccgcgcggctccaagaacaagtacgaagtggaccacgagaccggccgcgtgttcctggaccgcaccctgttcacttccatgggttacccggatgactatggctacatcgacggcactctgggcgaggatggcgatccgctcgacgcgctcgtcatgatcccgaactccgtgttcccgggctgcgtggtggaatgccgcgccgttggcctgtaccacatggtcgacgaggctggcggagatgacaaggtgctgtgcgtgccggctgacgtacgtttcgacgacatcaaggatgtcgaagacgtttccgagtaccacaaggctgaaatcaagcacttcttcgagcagtacaaggctctggagccgggcaaggaagtgctgccgggcgattactggaccggtgccgccaaggccgaggaagaaatcgtggccgcccgcaagcgcctcgaagaatccgagaagtgatttccacgcctttctagatagctttaggtagcaatccgaggaaagcccgttgacgtacgcactcgcacacgtcaacgggcttttgcataccttccaacgtccagattccgccagtcactggaagaaaatgcccgcaaatcaacttctcagcgggcagattcctccaccgattggaggaaaacggacaaaaccataccctccaagtgcccagattcctccagcgagtggaagaaacagcccgcagacgggatacactcatactgcacgcgcatattcgccggggccgctatagtggaacacgtaattcacggcatgcgaacagtattcgcagaattcaaagcccgctggctggcgcggcagttctatgtcggtacccctaggcgtaggcggacgtgagactccgtcgaggcccatcccgtgggaaaccggcgggatgaacctatataccagctatgttgattcaaacattacttattgccgtttccgtatcgatggacacattcgccgtttccatcggcaaaggtctcaccgtcaaaaaactacgcggcctcgacgcgttcaaaaccgccctctggttcggcggatttcaggcgcttttcccactgctcggctatttcgccgcctccacgttcagcaaatacgtgaccgccgtcgaccattggatcattttcggcctgctcgccctcatcggcggcaacatggtgcgtgaagcattcgaagaggatgaagagaacgccaaggaaaccgctgatttcgattggaagcacatgcttccgctcgccgtggcctgcagcatcgacgcattcgccgtcggcgtcagtttcgcattcatgtcgttgaacatttggatttcagtgatcatcatcggcatcaccaccggcctgttctccgcagccggtctgtatatcggtcgcgcgttcggctcgcgctggcagaagcccgcacagatcgcaggtggcgtcgtgcttattctgatcggcgtgaaagtattgctggaacatctcggattcctcgcataataatcgcaaatcagatatacaaataaatatacaaacttacagtaaaagcccgtaatcgcacatgattatgggcttttacattaccgcttgccgcaaatacttgcgattattttcctgcgctttcgcgttttctcgcgattgcaggaatcacactattagaacatgacggtcgcgtacgatgcgataccgaccacaattccggaaatcataaccggcagcagcgcaatgccgatccacggattcttggattgcggatcgggatcggcatcacgattccaccaatacgaacacgcgtcaagcgcgataatcagcaacaacgccacaatcaccgcaacagcccacgccgtcgtcgagccataatcggtggaagccgcgttttcgccggaacgaatcggcagcagcgtcgataggaagcaccagcccgcgctgccaatcatggcaacgccttccacaacattgtgcgacagcgaacgaatcagatgcgtacggttctcacgcgccatctgacgcccgaacgaaaccacaatcagcaggatcagcagaccgccgacgccggcgatccagccttcctgcatccaaaacgtgtcttcgtcacccaaaccggcagggaaaatcgcacgtccgagcatcatcgtcgtggcacacaccacggaaagcaagcccgcaatcacggaaatcgcatgccccgcaacaccatcgcggaacgggttgaacacggcaagcagcgcaatcatcgccacggaagccacaaccgtgaacgacacgattgcgggctcttccgcattcccataggaaatgccgggaatcagagcaagcacaaccagcaccacatatgcggcgatttggacggcaaacaccttgccgaacgaggctttctgagccgacttgacggcaactttttcagaggcggtcatttcgtccccttttcatgattttccataatgtggtcattacgtatgcgataccattaaatgtagccgcaagtgtccacatagttcagataaaattaatgaaacgccgacaacacacaacaagagtacaatcgcggcaacgatacaaaaccagtacaagagacaaagggagctaacgtgacggatctgacgcttatgacgttcgctagcgacccagctaccgtgcttccttctctggcgctgctttcccaccgcgtacgcgtgctaccaatggacgcggcaagtctggtgaaaatgccggaaaacaccattctttttctggatgcgcgagatgatctggccacggcgaaaacattgtgccgcctgattcatgcatccggactgtccacgccgatcgtgctcgtcctcaccgagggtggcttcaccgtggtcaattcgcagtggggcatcgccgacgtggtggtggcgtccgcttccccggccgaagttgaggggcgtcttcgcttggtatccgagcgcggcaactcgccggtcaatgcggtttccggttccggagaatcgggcgtgcagaacgaagacggcatgatccactccggcgacctggtggtggacaccaacggctatacggcaagtctgcatgggcatccgatcgacttggcatacaaggagttcgagcttctcaagtacctcgtgcagcatccgggacgcgtgttcacccgcgcgcagctgctgcaggaagtgtggggctatgactattacggcggcacccgcaccgtcgacgtgcatatccgtcgtcttcgcgccaagctgggcggcgaatacgagcatgtgatcggtaccgtgcgcaatgtcggctatcgttttgatcctccggaagaagaggaaggcgaggcggcagccaaggacgccgcagcccacaacgcttcgagcgaaaactgattgtcgcactattcgcattgcaagcattgcctgcgatttgcgatgcttgcgattgccacgatacttgcgatctgactgtcggctatctcactttcgtacgcgcgattgcatattcatgcgacggtagactggtgccatgccccgggaatcgaaacaagcgcgactgtcacgcatgcatcaggaatacgccgtattgtgcgaggagattccgcatccgaaatgcgcgctgaatttttcaaacccgtttgagctgctggtggcgaccgtgctaagcgcgcaaaccaccgacaaacgcgtgaatatggtcacaccggaattattcggcgaatatccgggaccggccgcacttgcgagcgccaatcccgaacacgtggaaagcatcattcattccatcggatttcatcatacgaaggcaaagaacatcatcggactttcttacgcattgtgcgaacggttcgacggcgaggtgccgcaaaccatggatgctttgacaagtctgcccggggtcgggcgcaaaaccgcgaacgtggtgcttggcaatgcttttggcgtgccgggattccctgtcgacacgcatgtgatccgtgtgaccgggcggctgcgctggcgttcggactgggcgagcggctcccccgaccccaaagccatcgaacgagagatcaccgcctgcttcccgcccgaagagtggacggacctgtctcacaggctgatattgcatggtcgtgccatatgccatgcgcgcaagcccgactgcctcaactgcccccttaacgacacctgtccgagcgcattcgcagcgtaacgcgcatgcccgctgtagcctgtgccaactagactcagcaccatggaagacaccatggaagaagaaaacgggcgggaagccaagctgaaagccgaaatcacgcgatggctgatctttttcggcgtcgccatcatgctcagcgtcatgacctggctgggctggtcgctgacgaaccgcaaaaatccgattacctccttcaccacgctcgtttccgactcctccgtggccatcggcattcagggcagcgcgccggaatcgctcgacatccgcaccgaacagggcaccgcgctggagcaggcgctgctcgaaaacgtgtacgaaaccctggtgtcacgcagcgaaaccaacaaactgcagccgtcaatcgcgaaatcatggcagatttccgacgacggactgacctacacgttcacgctcaacagcaacatgaccttcgccaacggacacaagctcgactcgtccgacgtggtctggtcgctgcaaaacgtcatcaacaacaattacgtgggatccgaccaacttggtagtctcaaggaaatcaccaatcccgacgaaaaaacggtggtcatcaccctcaatcagccgaatccgtgccttctgcgcgcgttgagcgggcgtgccggcattgtttacgatgaggaaagcacggcgaattacggcaagaaagccgtgggatcgggaccgttcaccgtggaagcctcgtcgaaaacacagatcgtgctgcagcgcaacgactcgtattggggcaccaaagccgccgcatcgcaaataacgctgtattactacgcttccgaagattcgctggtcagcgccatggaagccaagaaaatcagcatggcattgccgttgagcgcgtctgccgccgatgagctcaaccagcaaagcggcatcaactccgacagcggcatcagcttcgacaaagtgatgctcgccttcaataacggcaccgaaagcccgttctccgacgagcagatccgcaaaatgacgagatacgccatcgacgcgcagaccatcgccaaagacgctccggacgcctattcgccgctcggaggcccgataagcccgctggaagacgggtatgaggatctgagcgaactgttcccctacaatcttgagcagggccagcagatgcgcagctatttcggcgcatactatatcgccgatatcgatctgctggtgcccaaggaatatgagcagatcggcaacaccgtgaaatcggcgatcgaacagctcaatatcggcgtcaatctggaagtgctcgattccgcggcgcaagtcacggaacgcatgaacgcgggcacctacaatatcgcgctcaccaccatgagcggcgaaaacgatgcgagcgtattcaccgacggccagagcgtgttccattatgagaacggcgatgtgcagcaggcatatgcggacgcgatggcggccaccaatgatgacgattatcaggcacgcatgcgcacgtatgcacgcgccgtcagcgaaaacgcggcaagcgactggctgtacacgcgcaagaatttcatggcggtaagcgaccaattgcagggatatccgaaaaatctgaccgaccgtctgctgccgttgagcagagtgaagttgcagtgattttcccgcgattgtcaatcaatcgccgaacactgcggacaatccgtgtgttgcgctgattttcttgcgatttcggcattcggctgcagttccgtaagttgtcacattcgctttctagactagcgtttatgactgaaagccaagataataccatcaacgcgaacctcacgccgctgcccgacaaggtcggcgtggacggtctcgaagacaagtggcgcgaagtctgggacgaaagcgaagtctacaagttccagggcacccgcgaccgcaaggccgtgtattccatcgataccccgccgcccaccgtttccggccacctgcacgtgggccacgtgttctcgtacacgcataccgatgtgatcgcgcgattcaagcgcatgaacggctacgacgtgttctacccgatgggctgggatgacaacggcctgccaaccgaacgccgtgtgcagaactattacggcgtgcgtgtggacacctccctcaagtacgatcctgatttcgtgccgccgttcgaaggcaccgatggcaagaagatcgacgccaaggatcaggttccgatctcccgtaagaacttcatcgaactgtgcgagaagctcaccgcccaggatgagaagcagttcgaggcgctgtggcgttccctcggcctgtccatcgactggacgcagacctaccacaccatcggcgagcacccgcagcgcgtggcccagaaggcgttcctgcgcaatctggcccgcggcgaagcgtatcagaaagacgctccgggcctgtgggatgtgaccttccagaccgcagtggcccaggccgagctggaatcccgcgaatatccgggcttctaccacaaggtggcgttccgcttcgaagacggcactccgatctacatcgaaaccacccgtccggaactgctggcagcctgcggcgcactgatcgcgcacccggatgacgagcgttacaagccgtatttcggccagtacgtctactccccgctgttccacgtgaaggtgccgattctggcgcacaaggccgcggaaatggacaagggcgcaggtatcgccatgtgctgtacgttcggtgacgtgaccgacgttgagtggtggcgtgatctgaacctgccgctgcgttccatcatccagcgcaacggacgcatcgtgatggacaccccggactggatcgaagacgaggaaggcaagcgcatcttccaggaaaccgccggcaagacgacattctccgcacgcaagatcatcgtcgacgcactgcgcgaatccggcgatcttgacggcgaaccgactccgaccaagcgtatgacgaacttctacgagaagggtgacaagccgctcgaaatcgtcacttcccgccagtggtacctcaagaacggcggcaccgatcagaagctgaacgccgaactgatcgaacgcggtcgcgaactgaacttccatcctgatttcatgcgcgtgcgttacgaaaactgggtgaacggcctgaatggcgattggctgatctcccgtcagcgcttcttcggcgtgccgttcccgctgtggtatccggtgaaggaagatggcaccgccgattacgatcatccgatcgtgccgagcgaggaccgcctgccgatcgatccgaccgacgatgtgccggaaggctacagcgaggaccagcgcgacgtgcccggtggcttcaccgccgaacctgacatcatggatacgtgggcgacctcgtcgctcaccccgcagatcgtgacccgctgggaagagccaggcgaagagaaccaggcgattttcaacgccaccttcccgatggatctgcgtccgcagggtcaggacatcatccgcacctggctgttctccaccgtggatcgcgcgcatctcgagaacaagtgtctgccgtgggccaatgccaccctgtctggatggattcttgatccggatcacaagaagatgtcgaagtccaagggcaacgtagttgtgccagacaagccgatcaagcagttcggcgccgacgcggtgcgttattgggccgctgcggcacgtttgggcctggatgccacctacgacgaaggccagatgaagatcggccgccgtttggccatcaagctgctcaacgccaccaagttcgcactggccatcggccgtgaggatgagaaccaccatgtgggcgctccggcaaccgcaagctggaaccctgccgacgtgaccgagccgctggaccgcgcagccatggccaagatggccctcgtagtgcgcgaagccaccgaaagcctcaacaactacgagcattccaaggctttggaagtcatcgaaaactacttctggcagttctgcgacgattacatcgagctggtcaagaaccgtgcatacggcaccgcagactccaccggccatgtgccgagcgagaaggccgtgaagtccgctcgcaccgcgctgggactgggcttggatgccttcgcacgcctgctggcaccgtacctgccgtacgccaccgaagaagtgtggagctggatgcatgagggcgaaggctccgtgcaccacgccgcatggccgaaggctgaaacgtacgatgcggccgcagcagccgtctccccggagctgctcacccatgccggtgaagctctggccgcgctgcgtggcatcaagtcgaaggccaaggtttcaatgaagaccccgatcctttccgtgcagctgggcgtttccgatgaagcgcgcgaatccatcgaaagcgcattgggcgatatcgccgaggccggtcgcgtggtcggacgcatctccttcatgggagcggccgccgcactgaaggccgtcaaggaaaccgccgaagcagccaaggaagccgtcaaggaggccaaggctgatgccgaagccgccatcgacgtgattgtggccgacagcgaacttggagagccgccggctaaaaagccgaagaactaatggcaactgtaggtgaaaccggcagccttcgtggcaaagccgttcacttcacctacagacagtccacaggactgtctgcttaacggctcagccggctaaaaagcctaagaggggatcttccgcgattggaaggccccctctttgtgtatctggatcctatgttcatacttttttataaaacgggaactgcaagcagatattgagattgcgcggccttagcaggctgcgattgcacaggcatatccggatacagcttctgcaaagcctgctgcaatatttcggcagcggccgcaatttcaacggtctcgtcaatcaaatcgctattatcaggcacaatcaacgtgcgatttccggaaccagcaatgccgtatgctgcaatcggcaacgcacttgtcatcaacatttcggaagatgcggtttttcctgttgttccagtattttcagatgcggaatctaccgaatcgccatcgctggatttctttgattccactcccccgactttcgcaacgttcttcgacgtggtatcggcagccgcgccaaatgacgatcgcaggccgcccgcgtagctcatcacatcatccatgctgatggcgttcttgtcgtccaccaagctggccgcagtaccgtcggaagcgttctgctgattggccgcatccgcctgcgcgcgttcctctttgcgttgggccttgatacgcgcccgctcggcacggcccgcaagcgacgtctccgaagccgaggcaagtcccatagaccccttcaacgtaacttccgaaccatcgacagtatcgtcggaactggtcgaatcatcacctgcatcaagctgatccgcaaaacgaagcacgatctggtggaacgcactggcctgacccgtgtgctcgctcgcatccgccaacgcctgcatcgcatcgtcaaccctgcttgaagccgacttcaacttctcattgccgtcaatgctgttgcgcacatccgcaatcgcctgagattccaagttttgcgccgaacctgcggaagcccccaattccttaagccgagcggtgtacgcgtcggtgaaatccatggaatacggaatcatcgccgaagaaagctgcgactggccggcactgtaatccttggcgccacgctgctgctcctcgcccgcacgcttgttgagttccgccaccaaaccggatgtgccacgctgttcgatggtgcgaatcacctcgttcaccgcgtcggcggcacccgtatgtcggtatgcggcgctcacatcgttgaccgcgttggccagatcgaccacggactgcgccaccgcagtatcgccgttcaattcggccgcggtgccgagaatggcggtaagttgcgtggtatcgccaatcgatccggaaagatgcgtcgtatacgagccgacgtacgcgtcgatatacccgttgaacgcctgctcatgttcctgctcacgctgggcgatggtcgtttcggcaagctccttttcatgatcgcgcagttgttcgagctgcgcgatgagctcatggttgcgttgcgatccgacattcgtcaaaccatccaccaatgtggatgcgcgatcggtcaaactggtgagattgccatagcagccagttctttcggaatcgcaggcaacagcggcgacagacagcgaactcatggtgaagtttttcgcagtcacatacgtatgaatcgtaagatcctcacccggcttgcctaccgcagcgaccaatgtcgacgaattgccggcagacacaagcacgccttcgtctgaggtcgcgtcattgccgacgcggttgggaatggtgaacgcgacgatcggcgtcagatcagccgtttcctccggtcgttccgatttcagatcgatgcggatgccgaccacgcccgatgcaccggaaatcttggatgcgctgacggtcggaccgtccaaagtaaaggtcgccgttatatcccacggcagttccacacgctcttgcggcacgcgctgcgaagacgtcgcgccctcatctgcattcatgtccgtatcagttgcagaagcggcgtcactcgtcaaatacaagcggcccggctcatcaacggactcatatgcgctcatcacatcgtgcgaggccaccgccgagacgtactcgccgttccgacgcaccgcatcaaccacattcgaaaccccgaccgcgcatacgggagccgccgaaaccagcgttaccgcaatggacgcagccagcatgtgccgcagatggacactcgccacacgcatatcacgctcaccacgcgtgctatcggcatgatgggcacaagatgcacgaaacgcaacagaacgacgcatgccgagcctctcaatcgcaatcaaaacaacgttccaaagcaatcaatgtagcgcgcggcatgccccggcaagaaacgatttcgcggaaaacagacaggtcaggcgaatacgtcgagcacacccggatcgacgccgttctcggcgatgcgcttatgcctgcgcttggcttcggtcaccacgaattcgcgatacatttcggcgatgtcgggatccaacccggcatcgacagcaatgcggtgcaaccgttcgatctggtaatcctcacgcttgtaatcggccggcgcgaaacccgcgcgggctttcagcacacccacttgggacgtgtatttgaagcgttccgccagtagggaaacgatggccgtgtcgacattgtcgatcgactggcgcaatgcagcgattttcgccacggcatcggcaacctcgggattgctttgcgcggtgcccgcatcgatgacggtttcggtttcatgctcttcttctggccgaagccagtcatgttcgctatcgctcatgcgtacaagactaccgcgcgcatgtcacttggagaagtaccgttgcagcacaatcgtggtttccgtgctcaccggcaccgtttggtggatgacgttcagcagatcctcaagcttgcttggcgaggctgcgcgcacggtcagcatgtagctgggtgacccagccacggaatcgcacgacatgatgccttcgatatcctgcaatttggcgggaatctcggcttccttggaataatcgatcggcgtgaccgcaatgtaggcacgtacggcgaggccacgcttttcatcgtcgataacggccttgtagccgagaatcacattacgacgttccagtttctgcacgcgcgattgcaccgcggaaatcgacagtcccgtagcatccgaaagctgagacagcgtagcgcggccgtctttctccagcatgctgagaatggtctcgtcgatatcgtcgaattggcccacgctcgcatgcgtggtgtcgggttcgttgccattgcctgtcatagatgcccctttccaacaagcattctgcatcagtccggtaggaccgactcccctatgcagctcacgtttccgtccattaccatacccaccccaacacacaatccgtcaactgcattttcgtaacatttccaacgaatttcgattttcaatcatttttctcctatttttttcatataccccctatatagcaatactattttcgtctttttactttcgatttcgtattttttcgtgcgtcgatttttacataccgtatgtccacaacgtgatcatccacattgccgaatcgtgcggaactttcgaaaaacaatcgaaacgcattcgaaagtagttgaaaactgcaaaacggaaaaacagccgaacagaaagacagccgaacagaaagacagccgaacgaaacaaaagggccgcatggcgattgtcatacgacccttggatgcgtaaccgcagattgcgattacctgcgattagctgttgccgttattcgcggtattgccgctctgctggatcagcgacgccatgaaatcacggttggtcgcggtcttcttcagacgcggcacaagcgtctggtaagcctgctcaggctccagaccgccaagcagacgacgcagacggtagatgatcggcagctcctgcggatcggtgatgagttcctcgcgacgggtgccggaagcgttcacgtcgatggccgggaacaggcgcttgtctgccagttcgcggctcaggcgcagctccatgttgccggtgcccttgaactcctcgaaaatcacctcgtccatcttggagccggtttccaccagtgcggaggagatgatggtcagagagccgccgttttcgatgttacgagcggcaccgaagaacttcttcggtgggtacagcgcctgggcatccacaccaccggaaagaatacggccggaagccggagcggcgatgttgtaggcacgggccagacgggtcatggaatcaagcagcaccaccacgtcctggccaagctccacgagacgcttcgcgcgttcgatggcgagttcggcgacggtggtgtggtcggaggccggacggtcgaaggtggaggaaatgacctcgccctgcaccgtacgttccatatcggtgacctcttccggacgttcgtccacgagcacgaccatcaggtggacttccggattgttggtggcgatcgcgttggcgatgttctgcagggtgatggtcttgccggccttcggcggagacacgatcaggccacgctggcccttgccgatcggcgccacgatgtcgatgaggcggccggtgagcttgttcggcgcggtttcctgcttcagacgctcctgcggatacagcggagtgagcttgttgaactgcggacggttctgtgcggcctccacggtcatgccgttgatggagtcgatggactgcagcggcacgaacttctgacgctggttgcggcggtcgccctcacgcggggtacggatggaaccgtgcacggcatcacccttgcgcagcccatacttcttgacctggcccatggaaacgtacacgtcgttcggacccggcaaatagccggaggtacgcacgaaagcgtaggaatcgagcacgtcgacgatgcccgcgacaggcacgagatcctctttcggctcctcgtgacgctgttcgcgttcaacattgcgatccgtgcgctcgttgcgctcgacgcgatcgttacgctcgttgcgatcattgttacggtcgccggtacggccacgacgctcgtcacgctcgtcataatcgcggtcacggccacgcaggcgacggccacgacgatccacgcggtcacccctatcgctgacgcgaccgcgaccacgacgcgcgaaatcaccgtcttcagcctcgtcacgacgttcgtcatcatcactgccctgcgaaggcaacgtggcgagaatgtcatcaagatcgcgcacaacgtcctcatccttcggcccttccaccgcacgacggcgacggcgcggctcaacgtcggacgcatcatccttacgatggcgacgacgatcatcctgcttcggcgaagcatcgtccaatcccagttcggccagcagatcggtggcagcgtccgcatcacggcggcgacggcgcttcggagcctcatcgatgctgtccagggcgttcaccgcggccatgacatcggccgcctcctcgctcgtcggagcctcagcctgcttgcgacggtcagcacgctcggtgcgctcggcacgttccgtctgttcggagcgctccgcacgctcagcgctatcagcacgtccggcaagggtcttcctaacggttttggccgtctgcttttcggactgctcagcctcgttggctttgctttcggcagcctcgttggacttgccggattcctcagccgtgttcgccgcgacctcagcgtctgcggtttgggcttcagcaggagccaccggagcggccggtgcagcggacttcggagctcgcacggtcacaccggcaggcgcttcaccgccggaacgagcggcctgaagcgtcgcgataagttccggcttacgcatggtggaggtgccacgaaggcccatctgcttggcgagctccttgagctcaggcagtttcatgtcttcaagattcgggctggttgccactggtttttgcctttcccctagcttccgcaagcacacgcctgcaacagctgtaaaaagagatacggaaatttccgccactgaaagtccgccgcgaaatatcacggttttcgaactttcctaaccatacaacgtcatccagaccaacgcaacgtaggcgtgccaacgtattcatgccaatcaagcattcaagtcaatgacaaatcgcaaatcacaatgcgaaagacccgccatgcgatcacatgacgggtctttcgctttaccacatgctttacagcaacaggtgcaggtcttgccggaacctacttttcctcgtgatagctcttgtcggtattgacggaccatacgttcttcttggacgtcttgccgttcttgatattgccgacggcctcgattgcggtggccatggaatgatccatgttgttgtaacgatgctggccgttgcggccgacgcaatacagattgccgaaggaatcgaggtattccacgagctcaggcatgcgatcgtaggtgtcgaaatatgctggatacgccttcttcacgcgctcacgatgggagtcgatcacgtcttgcggaccgttgatgatctgcatgcgcgtaagctcctggatggcgaacttcttcgcttcctcgtcagacatgttccagaaggaatcgccttcttcgcagaagtattcaagaccgatccacacggtgttgtcaacgtccttgaccaggtacgggctccagttgttgaagatctgcaaacggccgaccttgtagcccggatcctgcacgtaaatccagcaatcaggcacgatcggcgggttgccgagggtgggaatgtcggtggtgttcgacaggcgtaggtgcttgacgagcagaccaacggtcacgaagtcgcggtacggcaggccgttggcgatttcggtcatgtccttcggcgcgggctggctggaagcgtccacggcgttgatgagatccttgacgggcatggaggagatgaagtcgtccgcggccatttcggtgcggttgccttcggaatcctcatataccacggatgcgatcttgccgtcggcctggcgaatctccaccacgttcgcgtcggtgatgaccttcacgcccgcggcctcgcagttggcctcgacggtttcccacagctggcccggaccatacttcggataccagaattcctcaatcagcgaggtttcaacctcagcattgctgcgcttcttcggcaggagcttctggaacgcgttcttcagcacgcccataatgctcaggcccttgacgcgctgcgcaccccaatcggcggaaatctgggacggatggcgaccccacagcttctcggtgtacccctcgaagaacatggaatacagcttgcggccgaaacgattgatgtagaagttctccagattgtcttccggcagcttgtgcaccatggacttcaggtagctgaagccggcaacaagcgtaagcttcggacccatggccttcaacgtgttggcgctcagggaaatcgggtagtcaaagaagtggcggttccagtaaatacgagacacgcgatgacgcttaagcatcaccttgtcttcgacttccggatccggtccgcccggttccatatcgtgctcgcgaccgagcttcttgtcatcatagcttggcgcgccctgcagcggcaggacccccttccaccaatccatgatgcgttcgtccttcgagaagaaacgatggccgccaatatccatacggttgccatcatgcttgacggtgcgggagatgccgccgaattcgcgggtcgcttccaacacagtcacgtcgtagttctcggagccaccgtccttgacgagctcccaagcggcagtcaggcctgcagggccaccgccgataatcaccacggattgcttttgcgtcactttgaggtctccttatgaaaacaaaaatccctgatagtctacccgagggtagggaaacgaacaccgcaacttgtgcgaatgcttacaaaatcaagccaagtcagccggatatacggctatcgcatcatgcaaaacgcaatcatcaaaccggccgatgcacgacccgactgcgcggccaaagcgcgcaaccacattacgcgatccaactacgcgaccagcaaccgcacaactggcaaccgcgtgaccggcaactgcgcaactagatggaatcaggaatgtcaatatcggttttctgcacttcctcaacattgacatccttgaacgtgacgatacgcacgttcttgacgaaacgactggaacgatagacgtcccacacccaagcatcagtcaggcgcacgtcgaaatacacgtcctggcctgcggaacgcacattgaaatcgactttattcgccaaataaaagcgacgttccgtttcaacaacatacgtaaacagcttgattacgtcgcgatactccttatacagagccagttccgcgtcggtttcgtaattatcgagatcctcggcgctcatcacttaccttccgtatcgcgcttgcgaccacgaccaagcgtgcgccaccaagcttccttcgacgtcttacgctcgcccgccgtgtacggccagctgttttcggcatcggcatcgccagtaacggacttgcgatcatcatgctcgctttgtcgcgcaggttccgcgccttccgcgtccttccgcacagcctcggccacgtcaccagcaccatcggaagaagctttctgcacggattgcgcagctgccgcggcatcgttgacatccgtaccttccgcatcatgcttcgaagcattcttctcattcagtcggatggcaatggaatgctcgcgcgcgctcaacgcttccttgacgcccggattatcttcgatcacatgcatgccgaacgcgtcaagcgaacggatcgggtcgaactcgtcaaccagcgtgtccataacgatcagatcctggtaacggttctgcgaagcgttccacaaggcgtcgcgcgaacgaccggacggcacgaatcccaacgactggtacacggacacggaacgcgtgttctgctcgggcacggcaacccaaatgcgatgcatgccaaggcctgccggttccggcgcaagtccgtacgtcatcacgcgcggcatgatgtcacgcgaatagccacggccgcggtaatccttgccaagcaccacctgaatgcgcgcggaacgagcccaaccgtcaatatcgatcaggaaaatcatgccaatcacattgtcggaattcgcggcatcgatctcgccatcgccatcatggtcggcttcggtgatgatggaccatgcgatcgtgcgacgcgactccggatcccccacaccggattcggtcggcgtttcgccttgggaccatgccacggaacgacgcacccacgcatgcaccgcgccacgctcggcaacccgatccttgccggtgattccggaagcgccgatgtacgccccaatggcgtccatacgttcaagatcttcgatcacggacggacgcagatgcaccatctcgcccttgatagacggaatgacgatgagatccggcaattcacgcgactgctggtccaactgctcctgtgtcgcagcctcaacttgttctggcattattcctgtcccctacatcattgcaggcacgaccgtcgccgcacccataccgagggtattgtacccgactgtatgtcagctgtgaatccgcgcggcggcaatcgctgtacatattcctctaccagcataacctgatgttgaaggacatgtcggcaatcgtaagaaaatgcgcttcgcgattatgcattctctttctttgaaatcccttttccggaataacgaaaagaaaacgcacgtcccaagctttttggaacgtgcgttttcctgcgattcaacaatcggctgtaatcgtcagcaatcgttgtaaacgttacttgatcttgctcatcacgatcttggtgacggcctttgcgtcagcctgaccgcgagtggcacgcatgacggcaccaatgatggcgcccatcggcttcatattgccgctcttgagcttttcaacgatgtcaggattggctgcgagagcctcattcacggccttttcgagagcgccgtcatcagacacgacctggaagccatgcttcttgacgacctcatccggagtgccttcgccagcaagcacaccggcgacggtctgcttggccagcttgtcgttgagcttgccatcggcgatcagcttctcaacctcagccacatcggccggagcgatcggtagctcttcgaggctcacgcccttgttgttggcttcacggctcagctcgcccagccaccacttcttggcacctgcggcggtggcaccagccttgacggtctcctcaagcagatccagagcgtcggcgttgagcacgtcacgcatctccaaatcgttgaagccccactcgcccttcaggcggttgcggcgctcgcgcggcatttccggcatctgagccttcatctcttcgatgtgctccttggtgatgtgcagcatcaccagatccggatccgggaagtagcggtaatcgtcggcatcggacttcacgcggccgcctgcggtggtctgcgaagcctcatcccagtggcgggtttcctgcagaatctcgccgccttcgctcagaatggccgcctgacggcgaatctcatactgaatggtcttttcaataccgcggaacgagttcacgttcttggtttcggaacgggtgccgaacggatcggacgggctgttgcgcagcgacacgttcacgtcggcacgcatgttgccctgctccatgcgagcgtgggaaatattaagcgcacgcacgatgtcgcggatggcgcgcatgtaggcaccggcgatttccggagcacgatcgcctgcgccaacgatcggcttggtcacgatttcgatcagaggaacgcctgcacggttgtagtcgaccagggagtggtcagcgccttcgatacggccgtcagcgccaccgacgtgggtgttcttgcctgcgtcgtcttcgatgtgggcgcgttcgatcggcacacggaacacggtgccgtcttcaagttccacatcaagatagccgttgccgttggtcggcttgtcatactgcgagatctggtaatcgcgcggcatgtccgggtagaagtagttcttacgcgcgaactggctccactcggcaatttcgcaatgcagggcaagacccagcttgatggcgtaatcgacggcggtcttgttgaccaccggcagagaacccggcagaccaaggctcaccggggtgagctggctgttcggatcgccaccgaacgagacttcggccgggcagaacagcttcgtggtggtgctcagctcaacatgggtttccagaccgatgaccggatcgaacttcttgacggcatcggcgtacttcatcaacttttcagccattttgttttctttcctccgatgcttcctacttgttcaagccgtcgagccacggggtcttcagggactgccagatcggaccgttccagtcttcctcgagagccgcctcaagtgccgcggcaggcttgtacatggcctcgtcacgctgctgcggagcgaggaactggaagccaaccggcaagccgtcgtcgctcagaccagcaggaatgctcatggccggaacgcctgcaaggttggccggaatggtggtgatatcgatggcatacatggccatcggatcctcggtcttctcaccgaacttgaatgcggtgaccgggctggtcgggccaacaagcacgtcgaccttctcgaaagccttcttgaaatcgtcgatgatcagggtgcgcaccttctgtgcggaaccgtaccatgcatcgtaataaccggcggacagggcatacgtgccaaggatgatacgacgcttgacctcgtcgccgaaaccggcttcacgagtgtaggccatcatgttggcggcggtctgcggaacgcctgccggcggcatgacgcgcagaccgtaacgcatgccatcgtaacgagccaggttggagctgacctcggacggcatgatgatgtagtacgcgccaagggagtacggcaggtgcggcagagacacttcagtgacttcagcgcccatctcctcaagcttcttgacaccttcgttgaagcgtgccataacgcccggctggaagccttcgccgccgagctccttgatcagaccgaccttgaggcccttcagatcacgcttcatgccttcgcgggcggccgccaccatcgggcgaggactttccggaatggacgtggaatcgcgcttgtcgtggcctccgatcacttcctgcagcagggccgcgtcgagcacagtacgggagcatgggccgatctggtcgagcgaggaagccatggcgattgcgccgaaacgagagacaccgccgtaggtcggcttgacgccgacggtaccggtcagcgagcccggctgacggatggagccaccggtgtcggtacccagggcgagcggggcttcgaacgctgccactgcagctgcggaaccaccgccggaaccgcccggaacacgttcggtatcccacggattgtgtgtggtctggtaggcggaatgctcggtggacgaaccctgagcgaactcatcgaggttggtcttgcccagcagcggcatgcctgcagccttgagcttctcgatgacggtagcgtcgtacggaggcacccagccttcgaggatcttggaggctgcggtggtttcgatgcccttggtgacgatcatgtctttgatggcgatcggcacgccggcaagttccggcagctgtgccttttcctcatcggacttggcatcgaaggcgtcggcctgttcgagagcctgatcgccggacaccttcaggaaagccttgatgctcggctcggcggcctcgatgacttcgagatgcgcttcaaccagttcacggctggaaacttccttggccttgatcttagccgccatctcggcggcggaaagcttgacgagttcgctcatgtcactcctcccccagaatgcgcggtgcaacgaacatgccggcctcggaaaccggagcgcctgcggtcgcctcttcctgagtcagcggggtttccggcacatccgggcgcaggtaggcttccagcggaatcgggttcgcggttggttccacatcgtcggtagcgacttcctggaccttgttgatggattctgcgatgacgttcagatcgccctgcagacgggtgatctcctcgtcagtaagtgcaattcgggccaaatcgcccagatgcacgatttcttctttggtgaaagtaggcatgtccctaacattaacgcgtctgtgtgacgagcgcccgcccatttcgtctcgccccgcaaccacgtcacaccggcattgccggcacgccccgcacagtccaaaatcacccacccactggaggaatcctcccgctgacacgcccgcacagtccaaaaacctccagtcactggagaaaactggactctaggatgaacaatcctcccgcaaactggactgcctcccattttgagcaacaaaaagggaggcagtccaaaaggaaggtatcgtcacgcgaagtcaaggttgaaagccaaggttgaaagccaaggttgaaaatcaagactgaaagccagaactagaaatcaaaactgaagccagaactggaagtcaaaactgaaagtcggaactggaaatcaaggctgaaaatcaggaacggaaattagggttggatggtggcgtgttgggcgatccaggcgtgcatggagactgctgcggcagctccggcgttaatggaacggactgagccgaactgagaaatgtagaccacgtcatcggccagctcgagcgccttttcagacaaccccggaccttccgcgccaaacagcatgaggcatcgcttcgggaaatggtaggtttccatcggcaccgcgccgggaatgatatcgagcgcaatcacccgcgcggccttcaactcggcgatacgctgattaatcgccgccaactgcgccatacaagtggactcgtttccatgttcaataccactcgtagctgaaacgtccattgaaataccagatggagcgcacccagcaacacggatctcagctaacgaagccgcctcgctcatgcaggcacagttcgctttttttgcattttcgcgcatgcggaatgcgattgcggccgcttgcgattggactgcggcgatttctccggcaatgcgcagcttccagcattcgacaagctcggctatggacgggtggttttcgacgtgctggtacagttccgtcatcagcgcgcccttgcgattccacttgtgcggtccgacgatatgtacacgtttcgcttggaatgcgttggcagtgcgcaccatggatccgatattgaaatcgtgcgtccagttttccacggcaacttcgaaatcatgccgaccatgatcgtcaagatcatctttaatggccgaaaccgtccagtagcggtaccggtcaagcacgttacgacggtcgccctcatcaagcagcacagtatcgaatcgacgatcataattcggtgattgcggatcatccggacgaggttcgccaggatgcgtttggccccacggacctacgcccacctcacgaaaagccggctctccggacgctttcgccgcaatatcaataggattaggctgatgcacgattttcctcacattcgtcgtccgatatttcgtcgacaggtaacttctgttatatcttccaccattcgcccacgatcaacatcggcaatcgcagcattgcccaccgcgattttggagatcgcctgccgtcaaccgcatccgtactgccgactttatttttcctttactcatgtcagcatgaacgtcagcatgattccaacagaacaatacccgtgaaacattccatgaaacacggcggatgacatcattaaaaaaaccgccggtacaaccggaaagtcgcgctggtcagtgaagctccgactccttgaagacctccacaaacggcagttcagcttcggacccatccaccggattgacgactttgatcgacgggtcggccatatcgacgccaccaatcaacgaagcgacagcaagcacttcggcgccttcgttcttcaccacggagaagtcaaggctcaactcattgccgttacgcaaggtgaccaaagaggacgtctgcacatatgacttttcagacagccaggaatccagcaacaccacacgtttaccggcaatcgaaggccccttgatggacggatacacaaaatccatcacaaaaccgttaaggttttcacctcgagaagcggccgcctggatcatagcggaaaccagcggaaccgcagccgcagtcagcgcaccaaccgcatcgaaatcatcaacggaatagccggcctcttccaacgtatccaacaaaatatgcccaacaatcgacgctccacgatggtcgaacaacactgaggaaagttccgagaacggcttatcggccatctcggcctgcagcagcgacttgagctgatcacgcggttcaagcatggcgaaatcaacggctgcgttcacagtatcgccagcggttgcggcagtggattcagcaaccggcttggtcttacggaaagtcttctcttcggtcatagtcccagcctaccgtttctactcgtcaaaagagtgacagtgttggtgtcaacaagcaacgtccaatatctcccatcaacagatggtcaacagaaaatcaacatttcaaaagtcaggccggtctcaccataaagatgaaaccggcctgaaccgaacccaagaaaccggcgagagcagcagattactcacttaagcgcgagaatccacttcagatctgtttcaaactccgcttccaggttcgcttccggactctcatctggtctcgcttccagccccgctgacgcaccggcgcaataccacacccgctcccaccagcaacaccatcacggcgattacgccactgacagccgaaccggtattggcaaccttgttgccggtcttggaagcagtattgttcttaccattgccagcagaattaccggaattaccaccagaattatccgaatccccaggtttgtccgaatctccgggcttgtccgaatcgctcttcagcgaagcctgcgccgctgtcaacgcttcagacgcctcatcgacgtccgcctgcgacagcccctcatccaaagccttagacagcgccagtttcgcagcgtcacgagcctcaacgaacgcatcccacttcccactgtcatatccgttgttgaccaccgccgcagcatccgcaacagcggaagacaacgcatcggtcttcgccatcgtgatcgacacgccttcatcggtaggattgatggtttgcatcagcccgttttcgtcgaaggtgatctcgtcgatcgcggtttcgcggtgaaagccaagcccggaagtaaacacgccaagcggagtgtagtgacggtgatacgccatgaaccagcgctcttcgccattcgcgtccaccacgtgcacttcggactgatgggccgtaccctgcaaattcttcgacgcgtccttttgcaggagcacgccatggttgtcgatatcagtcacggagccatcttccttgaacagcgacggcgaagtgccgtattcgacgtggtaattcgccgatccggcatcgtcgcatgaccacgtccagtgatagacgccatcgcgcttggacaccacaacggattcccggaagttgttcagaccgttgatccgtttgaccgttcccggcaccacgctcatcatgtcatcgctcaattgggcgatggccgccgaaccgttgccgtacaggatatacgacgtgccgtcatcatcggtaaaaatcgacggatcgatggcctgccccacagtcacaccctccatcgaacgcgtaacgatggggtctttggccgccttgtatgggccggcaggcgaatccgctaccgccacgccaatcgccgattcaccgctctcaagcttggcgcagtagtagaagtaatacttgccattctttttctcgatggtcggcgcccatgcggatccgacagaccaaggcgaaattgccgtattctcgtcgccattcgtggtcggctcgtgattcttatccacgtcgaggatcactccttcgtcggtccagttgaccaggtcggtcgagctgaaagcatggaagtaattcccactccatcccgagaagccatcagtcgtcgggaaaatccagaattttccgtcgaaataatcgatatccggatcggcatattgccccggcaaaaccggattatttgactgaaccgccttttcgagcgtccatttttcgctaacgataccaccgttgccgtccgaacattcgattacaagcgtatgcttcttggacatgtcaagcttgtcaccgctggcaaacgacttgccatcgaccgtgacactcgcatcgtcgtaagtcagcgcgaacgttaccggaacggcgttgatctcggcacgattgttcactacggaggtgatggttttcgcgtcgcaatccatgctggtacgcacgttgctgtgcttatcggtgccacgcaatgcatctgcttgcgacgaggtcggcacagtgcccacagtgatggatgcgagcgcgggcgcgttgttccgttgtgcgatttcgttggcgttcagcgttcgattccagatggtcagattgtccatcagaccggaatagtattcgccggatccccagttggctttgccgatttgcaggattcctccggtttcgccaaggatttccttgacgcccagcccggaaacgtccgtgctttcgccggcaagcacgccatcgatgtagacacgtgtcgtcttcgcgtttaccgtgacggtcacgttgtgccatccgtcgccgcttgtggtggccgatgcgttgcctcgaccatctcgactgccgtcggtgttgtatcgttcgacaacaacgctgccgaccttatcaagcactccgatgtagtgttcggattggttgtacgtcggggcagccgtggacggagccgcgtagaaggtccagccggtattgccgttggagtcgggcttagcatcgtaggagacggtgaactcggtggcgtccaacagcagtgcggcgccattggtttgcgtgacgctcagccaggaaccgctgcccagtcgagcggctttggtgccgttgttgccatcttcaagcttggccgttccgtggattccggcaactgccagatcgctggtgtaaccggtttcctcatcgtcaaaggtgaattgcgcgatcggattcttctgctgtgccagaggagtgttgggcgcgatatgttcgccgtaagctgcgagcacggcggtttcctcgtcgacgtttagacggacgacggtgccatggcggaatcgctgtccgaaattggctgaggcctttgagaatgtgcccgacttcttcagggacgacagttttgcgatggtccagccggcgtagcctccgttgtcgcccatcacaatccacgccccatcagtgccttggtacacggtcaaaccttcgatgcgggtgctcaatcctgattccgaggtcttgacgactttgtctccagtaattttcgacgtgccgtcggcattgacttcggagtcgcgttcaactagtcgggtccacttctgcgcttccagagaatccgcggtgtcgatcaccgtgtaccaatccgatgtggagaaacgatagtaggatccgtcatcgccttgcacgattgtggtgtcgatgatgttatgcaggtcggccgagctttgatcgatccagatttgaggattctcaaacgtggtgaagtccgaagtgtatgctttgtacactttcagcgcggtattgccagtagtgggattgtctccgcctgttgacaggtcgcggcttgaccaatacaccagatatttgcccgcttcggcgtcccagatcgcttcgggagcccaagcgttgccgactttgccttccaaaccggttgataccagttcaggatcggtccagatgacgagatccttggatttggcgaccacaagataggtgctggcgttgatctgattccaagaaccgcccgaagcgcttccttcggcgtgcagatcggtgccgagcatcacatacttgttgccgtccgcatccggctcttccaagcgaatcagatgcggatcgcggatgcctttggtgccttgcgtggaagacatgattgcctcaccatcgttcagcgcctgccatttcaggccgtttttgctgtatccgtaattgattttttcatagtcggatgcgttgaagtacagccacagatatccggctttcttggcagcatcgtcatctttgggatcatccttgccgtcatccggcttggataccgtcacggttgcctccacgggcatgcgggagtcatcttgggcggttcccttgacggtgaaggtgccagccttggcgtactggtccgcgtcgatgtcatcccattgcacgtcagcatcctgttcggagccgtcagccattgtcagatgcacggtttccggcatcgtcggagcggtcccggcgttagtggacacgtcaaccgatgccaccgacttgaccgcgatgctcggcgcataggcttcaagcacggtctgatactgggcgcgggtgaccggaaccacggtgccgtgacggggcttgccaccatcggaattgacggggaagttctcctcgggcatcttgtcgccgattaccgtccacttcgaagcgtcggaaatgtcggtggtcgccatgggcacgtaatggttcggacctccgtgatagctgggctggtcggcgaacagatagtattggtatccgttcacatcgccttcgttggctttgaacagcgaggggccttcgcctgcggagaaggtgccaccgtatccgttggatttgtcgttgccgatcgcggtgccgacttcgctccacgagctgccggacaatgccgtgctgtagtctttgatgccggcttttccaatggaatcggtcagggtgttggacttctcctggcgcaaggtcatcgacttttcatccttgtagatgcggtagtaggtgtcgccttccttctgcaccgtcacatcaatggaacccgctccagcttggcctctccgatccacgtcaatccacgtcttcggtttggagaacgtgatgaaatcaggcgtcgtcacatacatcatgcggttgtaacttggcgaggtacgagtgctcgaatcgtcattgtcgtacagattcgaggcccagtagaccacatattcgcccaactcatcatcccagtaggcttccggagcccacgtgttgcccgcgctgtcgtcgctgaccttgatatgacgctggttcgtccagttcaccagatcattggattcccaaacctcgatatacagcgaaccgttgtactgtgccgccgagaagctgcccttcctgccggagatcttcagatcggtggcaagcatgtagaaggtgtcgccgtcatgcgagcgcatgatgaatggatcgcgcaatccctgttcgccttcggtggaggtgaacagcggagtgccttcattgagcgtattccagtcgagcgcgttgttgcccttggaagcggcgaggcttatcttctcgcctcccacgccttcgccggtgaagaacgcccaaatgtatgcctcatctttgctttggtcggaaggcatcggcgaaacggtgatcgggaattcccggtttgcggtggcaccgttgttcgtcgccgtcgcttccaatgtcacgttgacggaatctttgccggcagccggccgattcaccgatactttggcattgttctcgttatatccttcggcgatagaagcgttcgcaccgccatcgttcttgacggaccatgtaatggcggagccattgtcaccgaccgtcggcaccacgaaattgctacgaatatcgtcggcgtccaagatattcacggcatcaagatcgctttggatcttctcatcgtccgatatgatgtgcggaaccgtaaccttaaacgtccgcaactgatcgtccgagccgttgagcttggcagtcaaagttgccacagcatcggcttcaccgactgcggggcgagtaacttgcgcggttccatcttccgtgaaccggatcgcgttgttatcgctcgaccaaacgatcggcacaccgttgctttccgtaatgacggagaagttttcggttgcctcttgcgcaacgctgatggcgttgaacgcatcggtcgccgcagctagggaactgtcgtaaatcttgaaattgtcgatcagaccggtaaagtattccgcgccccaattcgctttgccgagttgcagaataccaccgtctttgccgaggatttctgtcagatcatggctttctttggcctccacgctgttcacaagtgtgccgttgacgtacattgtggtggattcgtcggatacgactacatccacgtgcttccagccgacactggaagcaccgctgacattggctcccgtgcgaccgcccgtggtgttgttgtagcgttcgaatgtgatcttgtcggttttgtcaagaaagccgatgtaatgctcataaccataggttggtttcgccgcatcgcgggccgcgtacagtgtccagccgctgttgccgcttgatgcgggcttcgaatcgtagctgatggtaatggcatgcttgccttgaagcaccgcactaccatccgcggatgtcaggctcatccagaatccgctggacaggttggctgcagtggtgccgtcttcgccggttcccgtggccgtctggccattaatcgaagcgacgatatttcccgattggtaggttccggtttgtcctgccgtaagatcgttgaaattcagatctacaagcaggctgctttcgttcttgtatttgtcaagcgccgatggctccgatgccatcgtacttggcgcaacgagcagaacggcagtcatggttgcggcggcgacgatagcgccggtcaaccgtttgacggtgagatgttttctcgtattcataaatattccttgaagaattcagcattagtgcatgcgattcatgcataacaaggaggatgagaaaccgtccggaaaggaggtaaatagaaccggacggtttctcttacggggcttcgtcttgttttcacgcgggatggatggaatacgtggaaacggaataggcgaagcgttcatgtgaagtcagcgagctgccttccagcgacgcagaacagccaacgcaccaccgatggccaggattgcggcgaccagcgctatgcccttgacattggcaccggtattcaccacaaccgcagccttcttcgcagtcttcttggtggtggtagtaccgggcttagtggtcggagccggagtcggatcaggatcaggagtcgggtccggagtcggatcaggatccggagtctgctcgattgcatcgtcagacacgttgaccaagttatcggtgtacccaccgtaggccgccgtgatcttggaaactttgcccagcgcgccttctggagcggtgactgtggcgacgccatcagcattgagcttgacggtttcggtccagtcgccagcggtgaagacaaccgatccggccacattgccgccgtccttggcggtgacagtggcagtcagcgtgtctctaccgcgctccagcttggtcgtggagtcagtcgcatccggagtggtggggttggcggtcgtccaacgatgcatgttctcggcgatggcagcaggcacattgacgaacgcaccgtggcgggtcggggtcggcatgccattggcatacacgtagccgctcacacccgcgttctgatccttctgagtatgccatccatcggtctgcgacagtcggttgttccaatcgcagctcagcagagcggattcgctggtcatgtacggctggtatccaccggaatcagccatgatgaccatggcatcccctgcttcattctgatacttgtctccggcgttgagcttgatagcctccggaccttcgaacggcaagatgcgctggtcaagcagctgccagccggtttccggatcggtatcgggagatgcctcctcggtggtggccgtcagcaccttcgaacgctcaaggaacgtggacttgccgttggtgatgtagcttccggcagcgccgctttcctcgttcttggtgaagcggtagtagtagtcgccaaccttgatgaccgtggagtcgatacgggaatagttggtatcctgccacatcaccggttcggtgaaggtcttgaagtcgcgggtgatgcagtacagcagcacgttgtacgcgtagccggtattggtgctggtcaccgcggtggaacgggtgtcgtcggtgtacatacgtgacgagaagaacaccacgtaagcgccgagcgaatcatcccagtaggcttccggagcccacgtcatgcccgcattgtcgacattgattttaatgccggtatcgccgtcggccgcgttggtgcgagtccagttgaccatgtccttggactcccacacttcaaccttgagcgaaccatactgctggttctggccccatccttgtgcggaaaccttcagatcggtggcgatcatgtagtacttgtccccgtcatgcgacttgagcacgtaaggatcgcgcaggcccttggtatcggcgtaagattcgatgaccggattggaattgttgatttccttgaaggagaagaagttgttgccttccgtggcagacatgtacagcgcttcgcccgtcttaccattcgtcttgtcggaatccgacaggaaggtgactgcggcataagcttcgtcaggcacttcgcgagtcttttccttgactatcaccgacactttggcggttttggtgacactgccgtcagcgttggccgcggtggcggtcagctctaccggcgcggcatcgccgtcaccgtatgcagggcgggtcacaacgcctgcacccttatacgggtcagcggatccgaccgacggcgcctggtaatttgtatcggttccggtgatcacattttcattggaagacgtccaagtgatggtggatccgtacttcgagccggtggaaatcagcggcagattctcggtggtcgcctcgttgacggcagaaatcgcggaatccagatcgaattggaccacggtcgccggatccaacggcttgacggtgacgtcaacgcttgcggaaacgccgccggccttcgtagtcgccgtgattgtggtggttccttctccgacagccgtgacggtgccgtcgctgccgacggtggcgacggaagtcttcgacgactcccatgtcacatcggtgctgatggcgttttcaggagaaaccgtggccgttagcttcgtagcgctgttttcaaccatggtcagtgcaccgtcaagcacgccatcgccaacgatcgtcacgctgcttggcaacgtgacgtccgcaccttgatagatcttgatgtcatcgatcgcgccactccaataagcgtcgccgctatacagggatttgccgatggttgcggcggtgctgcccagatcggccatggtgatgccggtgtttgccttgtatccgacaagttcgccgtcacgaagcatggtgagggtttcgccgtcgacgatcagcttgtagttgtgccagatattgtcattgttagacagcgaagtcttaaatccttgctcattgttccacttgttatcggaaatgacgaacttcgtggacttggtgctcaggtaccagaacaggtatttctgctggcttccacccacagagaagctgaaatagttgccgtcatcagcatgacgtgatttggcagcgaattccatggtgaacgagttgcccgccttggcgaacagctcatccgggaacgaagcatactggccattgcctcgcagagacaacgcctggttattgttcctgtcgccgaacgcttcgaccttcgcaccgccgttcatggtcaggttgtacccgttgccggatgtgtcagtcgcagttccgtcggaaaaatcatagctggcaagcaggttcagaccgcttgaagcagagggggttgccgaaccgttaccggttccggcgccgtcttcagcgaatgcgaccggcgcgaacgaaaccatcatcggtaccgtgaccgcgatggcaagcccacgtctgagaatatcgcgcaatcgttggctatgtcgtttcatgcactctccttgatttaccaccgccgcacacggttacgacatagagtgatagctagcgctctgcttatgcttcattactgcatcaccgtcgttcgttctgagtcggcggcgctggtccgtatttattgtttttcttttgcttgtggccgcatggccggaccgtccatgtccaaccacgaaccgcgacgcgccctacaacactgtgaacgttaacggtctatgttctattcaaagctatggtgactttcaccacaatcccagccagtaacaattcaataacaattccagccagcagcccctttgcaacaaagacggcggaagccggacaatccccttaaaagagcctcatcaaggatttatagacccccatacaaagccaaatagcattacaacacccgctgcagcacttgctccaaagcacccataatacacccttttcacagcacctactgctcgttggtttcaggggcggtgagttcgcggatgtcggccttttctggcgcgatcatgtttacgggttcgatgattctgctctggtcgacgcgctgcagcttgcgtgcggtgaccagcacgcgcgattccagcgacgaggcgaacgcattgtaggcaccgaccgttttggtgatggcggaccccagcttggtggcgcgatcgcccaacaccgcgaaccgttcatacaattcgcgggacaggtcgaacagcattttcgcgtcatcggtcaggctttgctgctgccacgcgtatgccacggatttcagcaccgcccatagggtaatcggcgaggtcaaagccaccttgcgtgcaaacgcgtcatccatcagcgtcgggtcagtttccaaagccgcctgcagcagggattcgttggggatgaaggcgatcacaaaatcgggggcatcggcgaacgcgttccaataggccttgtcgcccaaggtcttcacatgttcacgcactgccttggcatgcgcatgcagcagctccgactttcgcgtcagctcctcgggcgtggcggtatcgggaatctcgcacgccttctggtagtcggcatacggagccttggcatcgattggaatggttttgccgcccggcatatggatgaccatatccggacgctgcgtacgcccatccacgtcggtgacgaccacctgggtgtcaaaatccacatgttccagcagtcccgcggattccacgatgttcctcagctgcgcctcaccccacgcgccgcgcaccttgttgttgcgcaacgcggacgacagggcgttggtttcgcggtcaagacgagcctgctgctcgccaaggcctttgagctgctcgccaagcgcacccatttcccgcttgcgaccctcttcgatctgcgaaaccttctgctgcagggcgtcaagattcttctgcacgggcgcgagcgcggacaataccttgctctgctcctgcagttttcgctcgttttcggcctgcttgcgttccgcttcggccgcggcccgctcacgctcccgctccactcgttcctgttcggcccgttgggcctgcgcgagctgcgatttgagataggtcaactgttgggccaacccttccgcctgcgtgcggtattgggtcaccgccgtggacaattcgctgatttcctgccgatcagcttcgatctgcgctttcgcctcgttaagatcagcggttttcgcatcacgggccatttcctgccctttggaacggcccgcaaaaaagccggccgcggctccaagcacggccacaaccaccagaagaatcaccacaaacacaggattgtcgaacatatgttctatataacagcatgaccaagacatcttggaagatcaaagttcgcaagacatccatgcccagctgcattatgcttggagccgaaagcatgctcacgaacatgcggcaacgcgagcacgctgaatattcgagaggcattcaagaggcaatccgggggttcggaaacacatgggattcgatttgtttatgacggtggcggcgattgttgcggcggccgtggccacttgggccatcctcaggctattcctaagcgaaaacgatgacatagccccctcccaccaacgcatcaccgatgacaagcccgccaagaatcacaccgaaaatcacaccgaaaatccagacgaggcagccggcgcaacacaccgaagcgacatcgccaagagtctcgccatcgcaaccatactgaccgctcccacattcaccgtaaccatgctgacattcggcggcatcacacttccccactggctgaccaatccatggctgcacgccatcatcgccacgccggtcatgttctactgcgccgcgccgatgcacaatcgcggtatcgccgccctgaaaagccacacgcccaacgcggattcgctgctgtcgctcgccatgaccattgtgtacgtctacagtctgctggcgtgcgtggtgtcgtggattttccccgcggggtcacgcaatcagtatttcgctttcgcaagcatggtcgccgtgctatcgcttgcgatttcgctgatcgcgcaacgccccatggcaaagaaagcatcggaaggcgatattccgaccgcacaatcgcaagaaaagcaagaaatacaatcgcaagaaacgcaagaaacacagcaaagcatggatacgcttatccaggccagcatcacatatgagattcgcacgcgggtaacgcagattaccgcgaccgtgacgatggtcatcgcggtgtggacgttcgctttgtggctgattttcgggcttcagccgaagcttgcgatcgccgtgttgatcggtgcgacggttttgacggtcgcaggcttggttttgcaggcatatgaccgccaaccgtcacggtaaaacggttttcgcaaaagaaaatcgcgcaatcgcacgaaaaatgggcggacccgcatgtgcgcagtccgcccaccgtcaacggttagaccgttttgtgactcggccaatcaacagtcagtcaggccaaaccgatcagccgaatgactccgaccgtcacttagcctctgccgaaaaatcgtcgtcaatctgccccggcgcccacgaggagagctccaaatggtcgccgccggtctgatccacaagcacggtgtcgccgtcgtgcacttcgccggccagcagcatgcgcgccaactggtcgccgacttcggtttgtaccaaacgacgcagcgggcgagcgccatacgccgggtcgtaaccggtgttggcgagccaatcgcgcgccgaatcggtaacatccagcttgatgcggcgatccgccaagcgggccgaaacctgcgccacctgaatgtccacgatgccgccgagctcttcgcgcgtaagcgggtggaacataaccagttcatccaagcggttgatgaattccggcttgaactgcatatgcacggcgtccatcacggccttcttcttggcttcgtcatccagttcggtgttcaccaggaactgcgagccaaggttggaggtcatgatcagaatcgtgttcttgaagtccacggtcctgccctgcccgtcggtcaaacggccgtcgtcgagcacctgcaacagcacgtcgaatacttcaggattggccttttcaacctcatcgaacagcaccaccgaatatgggcggcgacgcacggcttcagtcagctggccaccctcctcatagccgatgtagcctggcgcagcaccgattagacgagacacggaggccttctccatgtactcgctcatgtcaatgcgcaccatggccttttcatcgtcgaacaggaagtcggcgagcgccttggcgagctcggtcttgcccacgccggtcgggccgaggaacaggaacgagccggttgggcggttcgggtcggaaatgcccgcacgcgaacgacgtaccgcatcggaaaccgcttgaatggcttccttctggccgatcacacgtttgccgagatagtcttccatggtcagcagcttctcgttttcgccttgcatgaggcgtccgacgggaatgcccgtccagtcggacacgatttcggccacggagtcggcgtcaacgcggtccggcaccatcggaatatcgccacccaagccaccgtcagcaccgcctgccgcactgttcttggccgccgcctcgttttgttcggcttgcgcgatctccttctggatggccggaatttcgccatagttgatggcggaggatttcgccagatcgccttcgcgttcataccgttcggcttgggtgcgtagttcgtcgagcttcttgcgcaggtcgccgatgcggttgtgcccgttcttttcggcgtcccagcgtgctttcagaccgttgagtttctcgcttttgtcggcgatttccttgttgaggtcgtcgagacgttccttggcgctttcatcaagctcgttttccgctttctgcgcgtcggcatcgtctttcggattgccaagcaggtacgatttttccatcttgagacggtcgacctgacgctgcagttcgtcgatttcctcaggcgaggagtcgagttccatgcgcaggtgcgatgcggcctcgtcaaccagatcgatggctttgtccggcagctgacggccggaaatataccggttcgacagcgtcgccgcggccacgagcgcatcgtctccgatggtcaccttgtggtgggcttcgtatttcggtgcgatgccacgcaggatggcgatggtgtcttccacgctcggctctcctacgaacacctgctggaaacggcgttccaatgccggatccttttcgatgttctcacggtattcgtcgagtgtggtggcaccgatcaggcgcagttcgcctcgcgcgagcatgggtttgagcatgttgcccgcgtccatggatccttcggccgcgcccgcgccgacgatggtatggatctcatcgatgaacgtgatgatctgcccgtctgcgttcttgatttcctgcagcacgctcttcaggcgttcctcgaactcgccacggtatttcgaacctgccaccatggagcccagatcaagcgagatgagcttcttgttttgcagggtggtcggcacatcgccggcgacgatacgctgcgcaaggccttccaccacggcggttttgcccacgccaggctcgccgatcagcaccggattgttcttggtgcggcggctcaggatctggatgactcggcggatttcctgatcgcggccgatcacggggtcgagcttgccttctttcgcggctgccgtcaggtcggtcgaatacttttcgagggctttgtaggagccttcggcgtcgggactggtcactttcgcgcctcctcggatcgttggcacggctttgcgtagcgcgtcggcggtcacgccgtattgttccatgatttgcgcgctctgattcggctttgccgccgcgatggcgatgagcagatgttcggtggatacgtattcgtcgcccatctgctgcatttccttgccggcttgcgcaagtactgcggatagttgcctgctgacttgcggttgcgcggtggtcgatccgctgacgcttggcagcgcgtcctgcgcttggtgcacggcggcgctgatgttctgcgcgttgccgcccgcggcttcgatcagaccgcggatcacgccgttttcctggcgcagcagcgcgtcaagcaggtgcagggtttcgacttgcgcgttgcctgctgccgacgcgttctgtacggcgtcggaaatggcttcctgcgccattgtggtgaacttctgttccatatcatcctccatggttcgcgccgatcgtccgtttttcgcacggtcgcgtcgacgcatatgtcgttgtctgatatgctcaaccgacttcaccaccattctattcccaaaagttgagcctgcaacactcaacttttgttcactaaacgggaaatcgcgaacaacgcagcacaaaggccgtcacccacgaaaggtgacggccttcatatcttcaatatgtcaatcagcaatcggcaatcagccgcgcaccaccacgttgcgcaggctgccgatgccttcgacgtgcacgatcgcctcgtcgcccggatcaagatggccggaagcgttcggcgtgcccgtcagaatcacgtcgcccggcagcagcgtcgtgaagctggaaatcgccgcgatctgctccggaatgccgtgaatcagattcgccgtggtgccggaagccagctcgacatcctcaccgttcagcgtgaaggagatcttcgcgtccttccaatccaaatcgtcgcgggtcacgatccacgggccgagcgggcaggaggtgtcgaagcctttcgcacgcgtccacatcgggtcaagtccctgcaggtcacgcaatgtcacatcgttcacgcaagtgaagccgagcacgtaatccatggcctgttcgaccgtcacgttcttggcgatgcgccccatcaccacggccacttccggctcgaaattcatatcgttcgagtacgacgggatcacgatcggatcgtccgggccgatcaccgacgtgctcggcttggagaagatcaccatgtcttccggagcgtgcttgatgtcggaatggcctgcttcatgcatgaactgcgcgtgcgcctcgtaattcttggccagcccgtataccttcgacgggatcaccggagagagcagacgaacgccatcgccatccaccggaaaacgctcgccggtcggcttcacaccggcaccggccagaggatgcccctcaagcgccacgagatagtccttgccgtcgctttcgtcggtctgcacgaaagcgtattgcggtacatcattatgcgaaaaacgtgcgattctcatgtctgccagtctacccgcaacaatcgtcgaatcgtccatatcatcgacatgcaacgcccgacaatcaaaaacatcgaaaaaaaaaacgggccatcacatcatgcgaaggcccgtcacaggaagaaaacgtcagataaaagcacgctcgccgaaaatcgcggtgccgacgcgcacgatggtggatccttccgcaaccgcaagttccatgtcgccggtcatgcccatcgacagttcgcggcaggattgcgtgcccggctcgccggattcgagaatatggtcgcgggttttgcgcaggtgctcgaatcccttgcggatggcggtttcgtcgtcgacatgcgcgccgatggtcatcagcccctgcaattcaagtccgtccaatgtaccgattttttgcgcgatgcggatggcatgcgagggatcgcagccggatttcgacgcctcacccgattcgttgacttccagcagcacgcccacggtgatgccgcgcgccacggccctgcgtgagattttctccgccaagtcaagggaatcaaccgattcgatggtgttgacgaccggcagcactttgccgatcttattgctttgcagctggccgatcagatggaacggaatatgctcacccgcaatagtggaagcgccggcatcgtcggcaacgcccaacgcgaatccgcgctccccgcaacgtgccatcaatccttcggccttcgccatcacttcctgcggacgattctcgccgatcatacgcacgccagcgtcgatcgcagccatgatctcacctacgtcgcgcgttttcgtggcggcaagcaggcgtacggaacctgcgtcacgcccggcatgctgctccgccgatgcgatgcggtccagcacacggtgcacgccatcggcgatctgcacggcacgcacaccgtcgatcacctcattggcaagattcttatggtccatatatgcagtcatgttcagcctcttgcgttcaatcccaactacctctaccagagtaagaagaagcccgtacgacggtctgaagtgaagcgataaagcgaccgatatccgtacgggctaataaaacagacggcagtagaagggggaacttcaaagactccgtccgacagcaactatatgcaagatttactaaacacgcgccgaaaaaacttttttcttcaaaaaaaaattttctcagcgaactcaaattcagccttgcgattcgtctaatttgcgttccaaagcatcaacgcgttccttcaacgcaagcacctgacacgtcagcgatcgaatctgccccaactgcacagtcaccaatcgttccctggtgtcggaagacaaggcgcccgtcgtggaattgcttcttgcggccgccataatatccagatccactttccaacgtgcgatattacgttccacacgcttgcgcccgatgatcgcagggctcaacccagccgacgtgaaaatcgtgctcggccgctcgccatccaaatatcggcgcatgcaactgatctgaaaatcacgcgaatacgtgatccgattttccgtaaccgactcaaccgccggcaacgcacgaagatactcgacctccgtgttactaaactgccttttcgtcatatcgaccccattcatccgacaaaacggaataccattctcgtgctcgtagattaccatcacaaacgaacgcgcccgaacggcatatactaccactttaacgtaaggctatgggggctcacgccacctgaatcgccctacgctaaacctagctaaaccccaacgggtacagttgcgtactgccacagtcaacccaccaaaggagcagccatgaccggccgattcgcaccaaccccatcaggacgcatgcacatcggcaacgtttacgccatgctcggagcatggctttccgcccgcaaatcgggtgattccatacggctgcgcatcgaagacatcgacgagccacgagtggttcccggcgccgccgaaaccatgatgcgcgatctcgaatggcttggtctcggttgggatgacgaaccggtattccagtcgtcgcgacacgccctataccaggaagcgcttgagcttctcagcaagctgagctttgacgaaatcagcgatattatcagtactggttccaacgattccaagccctgcagcactacagcaggcaacgaagcagccacctctgaggcaacaccgctcatctacccctgcttctgctcgcgcgccgacatccgcgccgcctctgcgccacaggaaggcgatcgtttcaccgtgtacccaggaacatgccgacgcctcatcgccagcgaaccgcagcgtgcgaaacaacgcctcgccaacaacgaccgccactcgatgcgcatcgccaccgccgacaccaccatcaccttccacgacgaagtattcggcacccagcaatacaacctcgcccacgacatcggcgacatcatcgtgcgccgctcggacggcatctactcctaccagctggccgtcaccgtggacgacctcgacatgggcatcaccgacattgtgcgcggccgtgatctgcttcgctccaacgctttgcaaatctacattcgcaaagcccttatcaacgcgggattcaagccttccgaaccgacacagcccttccatcctgccgacggttccaataaacctgacgatgtgaccatctcatacgcgcatctgcccctcatcgacaacgcagccggccaacgccttgccaaacgcgagcgctcgctcgatctcggcatactcacggcacacggcgccaccgcgcaacagatcatcggctattgcgcatggctgctcggattgcagggagacctgaaacacaccaaaccgcagcctatgagcgccgacgaagcgcttggcgtattcagttgggatgccgttcgcaccaacacgtcagaccgcacgctcgatcaaggcgagttcaacgcatatttcggactgtaggccctattctgcagttttattctgcagctctattccgcaatcgcgttcagccaatccataattccgaatcaagcggatattcgttgatcgcacagccatccaaaaatatggactgctcctgcataagcggtgccgcttggccagccccgcgcacgtcatctcattgtcgatatgccccaaccggtgcccgacctcatgattgatcaccatcgtgcgatatcgcgccaagtcgccgcctcccgacatccacacgtccgtgccggaattccaacgatcatcgttgataatcacattgttgcccacacggcagctgtattgctccgaacataccgacgagaacgtcggcaaggtcgacgcttgggcgagcacgatattgaaatcgcaattgccgtccgtagaaggttcgaaaatcgcgcctgcgcgcccatccatgttcgctgttcagaatacgaaacacggcattcgaaaaatcttcgactgatccgacttcaccattggtgaccacacagtaatgatattgcaccatgccatatccgctgttttgcgccgtttgctgcgctttcgcaagtatttcgcttttctgatcgtccatcagcgcggccgactgctcgcgaagcgctttggtgacggcgtcttcctgcggttccgccgtttcctccgctgaggcctttgcgtctttcgtttccgacgattcctaggttttcttctctgattgttgcgatttcttttcggatttcgcggattgatccgttttttctgaatgtgttccggaattgccgatctgcgccgttttcgcatgtccgttcagtaccgcgttgaccagcacggcatgcacgctgcacgacgtacatgacacgatgacgcataatgcaagaatccaagccacgacgcttctgcggatgcggaacgcttccgtccgttcccggcggctcatggtggcggccgctttcggatcgagcgcacgcagaatggtacgaattcgcttcaatccggcctccttataaccctgccgtcacgcaggtggcagcatatctcttccgcggcaacactaccagccaacagtaggcatgcaaaaagcccgcttcccccgtaccggaaattttccgaggaaaacaggctttatgcaacagttctcatatatcaaacgcaacttatgcgacggtcaggcaaacaagtcacgaatgattgaatgcgatcaggcgaacaacttgaacacgaacgcacccacgatagcgcccagaatcggggcgacaaccggaatccaagcctcgccccagcgggaggagcccttggacgggatcggcaggatggcgtgcagcagtcgcggcatgagatcacgggccgggttcaggccaggaccggtcgggccgcccatggaagtcacgagaccccacacaatgaagccgaccacgatggaagcggcagcgtggtccgcttcgccccacggcatggacaggcagcacagggcgccgaacacgagcacgagggtgccgaagaactcgttgacgaagtagttgatgcggtcgttgtgggcgtcggtggtgcagaaggtgccgaggatggcgttggcgttttcggtgtccttatagtgcgggtagtaggtgatgtacaccacgagctgacctgcggcggcaccaagcagctgggcgatgatgtacggcagcacgaggctccagtcgaacaggccgttcacagcctgggcgatggtcatggccgggttgatgtgcgcgccggagacggcaccgaacatgagcaccgggatcatcacgccgaagccgtagcccatggcgatgttcagccagcccgcatggtggcccttggtgttcttcagttcaacgttcgcgacagcgccgttgccgaagatcatcagaatggcggtaccgaagaattcggccgcaagtttgacaaaagtcgagtattccactgctgtttcctctattgcttcttctcaataagaatcagattgatgtcgattccgctctcggcggacaacagcgtccaacattactccccgcactggaagtcagtatgccactaggtatgacgtcatagcgctggtttcatatgttggatattgcactcgtagtttgattcggcaaaccgcggtttcgccagttccaccattatcgtcagtactgccgaccgctgggcagcgtcacatcgaattcggaattatacgattgcgtttcgttgatatggtatgtggatccgccttggctgacccaagtaccgccgaattgttcggctttgtcgtcacctgcggatttcatgctgccggtccacgtaccgccagtctgcatagtcatctgcatttcggtaatggtcagacctgccgccttggcagagaatccccatgtgccaatgagattgcctttcgcagccttcttcggtgtggtcagcgtggccacaaccatggtgctggctttatctatagatgatgaatccactccgaagaactctgcaataccgatgtcttcgccatccctgtagaaatgaagattagagatgtcgtactgcgcgttggagcctgtcgacctgcccttgccaagagtgcccacgatcttgtcttctgcaatcagagtaatacgtcattattctcagacaaagaagcaaatcgatgatcggaccgcacgtgggcctttgagcatatcggaaccaaagttattgtctataccctcggaagttattaccagggtggacgcgccgggggattgaacctggaacgcgtgtcttcatggagtgatgaggcgtcggccggcatgcgggagccatagtgagtccgtcgcgggaagccagtagggccggtgcgtaagtccatccacgggaattcatcgcaaagccatttccttagcatcccatttcctccacccgctggacgttttgcccgctggaaggcttgctttccgggtaaattcccccagtcactggaggaatcaggactccgaagcgtgcgccagcgggtagatttccccaccggctggaagaatcaggacgctgagacgccagtcgatgggtggattcctccaccgactggacgttttgcccgctggaaggcttgctttccgggtagattcccccagtcactggaggaatcaagatgctgaagcgtgcgccagcgggaagcttcccccaccgactggatgtttcgcccgctgaaaggcccacttccgggaagatccctccaccgattggatgttttcggactctgggatgcttacaaacgggaagattcctccactgactggaggaatcaggacgctggagaaccttgccgatagtacggatgcggagtacgaggaggataggcccgagaaacagtttctacgcaaactgcagtggatgtgggagtagacatgcgagcatcagaaaacaaaaaaaccttggaaccggagttccaaggttttgtctgtgccccctcagggattcgaaccctggacacgctgattaagagtcagctgctctaaccaactgagctaaaggggcgttggtcttgcgaggttttgttctcgctgagcacaagaagtaaatatactcagaatcaagaagaacgcaactctcggcgtgtcgcgattgtagaaccgctatttttcaacgatttcagcatattgcataaattacagaaaaatgcgatccagccgtcatgttccctatctaaacagcacagccaaggcaggaaatcacaatttcttcacaactgtcgttccgcgtaatccaatcgccccaaacacttccgccaattcacttcgctaatttatttgcacggccatgcaatcattctccccgaatccattgtccgaacaccatgcacgcgcatcagccaccgaaccgaactcctccccggaaagaagcacgtaataatcggcctcatgcccataccgcgtgtagtagctgtagtccgcggcccacgccaacaccgccttcggccatgaagcgcgcgatgtaagatactgcgcgtaaatatcgcggtattgctgggttttgccgtcgacttccataccgtatttacgactgaacagctgcgttgtcggaatgtcgtacagtccggaaaccgccgaccggtcatgagacagctgccagctcaacgccagctgcgcatagcgttccgcatcggagtcggcaatgttcgcgccaccccttgcgtctcccacactcgcaaccgcattaccgttcggcgtcgcacccttctgcaccaccatgctggtcgacttggtttcgatctggtcggacgcacgccagtactgccctatcgcgtacgccagctcgagcgtcgctgtgccgcttgtgaactgcatcggatcggatgcgaagtcgtacaccgcggacgcgatcacctcattgctggaatccttgatggagattgtgacgtcctcgcctttccacgcggtgtcaccgcaggcgtgtgcagagaacgcgacggtcgcaatcatcgtggttccatttttctcgacactctccaagcccgcgtcgggcgttgtcgcgcaatccttggtttgcttggccgcatcgttctgcttggttttgttggattgctcatccgcgttttgcgccgtcgaagaaccgttttgcgccgaatcgtcaccgctattacgattggttgatttccatacaacaaatcccgcgattaacgctatcaccgcaataattacaataattgcgatgatgattggcttcttgcggttcttgcaatcattggcttgcggatcagattgcgttccggactgcatgtctagctgcaggcttgatggcgcgggcatgggaaccggaggatatgcggccgttgccggcggaacatcgatttgagtggtctcagccggctgagcaccttgtgtccccaacggaaaaccgcaggaaccacagaatcgcatatctgcggtgacggcgacgccgcactgcggacacacggaaggaattcccgcagccgcatggccatcctgcaattgcgcggcgccgcgtttggcgcttatatgctggcgcgtaagtccgcactgcgtttcaagtggaccggtgcgatcagttccgctatcgtcggtgtgctttccggtttggtggttgttattctcgccgccattttccctgcgaaaatcggaggatcgtacgcatattactccgcgtccgcatcgctttccggagcatcgttccgcacgttcttcatggcgttcctgctggctggactcggcgcattggccggctacgctctggcgcaatttgctcccgattccaataacatgttctccgccacttggcgttgggctcatcgcacgcgcggtttcgtacgcacgcttgttgaatctgctgcgatttacggcgtattgttcctggcgctcggtctcgttgcactgattgtggcgacggccgcttccggaagcgcactggccggcatactgctgattccgctgctattgcctgccgtaccgttcgtactgttttccgtatcttcgttcggtggtgtcacggcttcggtttccggtcaatcctcctacacgctttccctgttcaatgtcgccagcgtcacccaatacgcttgggcactgtggatttgctttgtgcttttcatcattgcaacgatttacattgcgcttcgtgagacggcccgcaacatgtatgacccgtattatgcgaagtgggagaacacatggaaggctcctgtcgccgtgatggtgttctggcttgtcgcggaattcctgtgcacgaatttccttgccggatacagctcgaatacggtttcgacgatggtgccaatgtggtatttcatcgtcgccggcgtctgggctttcctcgttgaagtgattgcgatgacgtttggtccgacgttggttgcgtcgacgccgggattgtggaagattcttgttggcggtaccgtacagcagactccgcagaacgtcgtcgattacgtcaaggcttgcgatccgcatttcggccaaccgaaggcagccaggaccgcagcttccgcgcagaccacgcagaccgcgcaatacaacgcgcaatacaacgcgcagtacgccaatccgtccgcgccagcaacgtcaccagccgcgcagaccgctcctacgcaagcgatgcccgctgttccaatgccaaccacgccaatcccagcgccagccgcttcggttccaccagtaccgcagtcaacggcttcggttcctcccatgccacaatctccggccgacattccgatgccggccgttccacagggtgaaggaaagccactcgacccaaaaactaagaagacgatcctgatcggctgcatcgtcgccggtgcactgatcgtattgggcattgtctatggtgtgctcaattcgaccgtcttcagcgcgaaatccatggcggaaagctatgtgtcggcaatcgccagcggcgattacgacaaggctaacgacattgccgatcctcaagtgggtaaaaaccaacgcaagctgctttccaacagcgtcgccaagaccgataacgcgaccatttcgaatgcgcatgtcaatggcgtgaaatccggcaatggcacaaccaccgcatcaatcagctactcgttgaacggcgaaaccgtcgatgaggaactcacgatgcgcaaatccggcaacaaattcctgattttcccgaactggcaaatcaccacgccactgatcaagtccatcaatgtttccgtgccaagcagtgtggaatcgttgacggtcaacaaggttgcggtcacagccaaaaacgcggagaagacggattccggcgaatggcagttgcgcgtatacccaggcacgtacaacatttccgttacgagcacggattatatcgtcagcgaaacggtggtattccgcacgaacgaagacagtgattcgccgaccacgctgaaggtgacgaccaccagcaagttcaaggatgcattaagcaccgccgtgaacaacgcgctcgacaagtgcgcggaatccaccgactatgcgccggaaaactgcccgttcggcttccgcgtatgggatgaggataattaccgtaatttcgcgtggtcgatcagcatctatccgaaaatcgacgaagtcgaccttgattatggcgcttttgatactaaaaccggtaaggcaaagtgcacatacgaggtgaaagacggcgattcttgggattcggatgatgatagtacgacgttcaatgcgagcggatcgttcgctatcaaggatggtaaggtcacggtcacgcttgatgacggtggctacagctattaaatgaagtatgaaaatccccctgcatagctgttttcagctggtgcagggggattttccatgcttaagctcagacgtatctcagtctgaagtcattcgccgtaaccgcaatgaatgcagccatagcgaatggggccgaatcactcagcgacaaccttcacggtgaaggaagcggagatttccgggtgcagagcgacggttgcagcgaactcgccggtggtcttgatcggatccacggtgatgttcttcgggttgacggcagccttggaagacagcgcgatggcgatcttgtcggcggagatgccaccgaacagcttgccggactcggagaccttggcggcgatttcgacgacggaaccctcgatgagttccttggcggcaacagcctcttcgcgggtggcaacggccttggccagacgagcgcgcttcatggcctcgatctgggcggcagcgttcttggaccatgcgaagcccagaccctgcggaatcaggtagttgcgagcgtagccggccttgacggacacgacgtcgcccgggtgacccaggtgattgacggacttggtgagaataaccttagtttcagccatttttcaaacctctctaagatcagcgaccggaagtggcgtacggcagcagagccatctcgcgggcgttcttgatagccttggcgagctcgcgctgttcctgcacggaaacaccggtgatacgacgggaacgaatcttgccgcgatcggagatgaacttgcgcagcagggcaacgtccttgtaatcgatctcggtgaccttagcggccttcagtggattcggcttcttcttaaacggcttgaccggcggctgcggcctcttgcgtgacatcttgatgttctccttacaatctggaaattgcttttcttttaagctgcgatccgggtcggatcagaattccggttcgtcgctgcttccaccaaattcggaggagccaaaggaaccgaacgatgaggaaccggaattatccgaattgccccacggatccgatgccggagcaggctgcacggcgggcgcggcattggctggagcggtagccccaccctgatagccagcgccaccggaatacccggcaccgccctgatatccaccggcattgccggcgaagccaccgttgttgaacccgccgttgccgccagcgaaagcattgccgccacgattgccggcaaaattaccaccgttggcactggaggttcgggtgacctgggcggtcgcatagcgcagggacggaccgatctcatcgacctgaagctcaataaccgtgcgctgggaaccatcgttcgcctgataggaacgctgctgcaaacgaccctgcgcgatcacacgcatgcccttgctcaggctctgcgcgcaatgctcggccatgtcgcgccacgcggagcagcgcatgaacaaagcctgaccatcttcaaactggcccgtattacggttccaggtgcgcggagtggaggcaatggtgaagctggccacggacgagccgttgccaaccgtacggatttcgggatcagccgtgaggttacccaccacagtgataatcgtttcgcctgccatcgttacctacttactttgcagcttattgttttgcagcttgaaaagcttggaattacttacttgcgaagaatcttcgtacggatgacggattcgttcaggttcagcagacgatcgagttcgtcgctggtggccggctcagcggagtagttgaccacaacgtaattgccttcggtcttgccagcgatctcgtaggcaagcttgcgacggccccagatgtcgatgttctcgacagcaccgccttccttggtgacagtttccagatactgctcggtcagcttcttcagaccgcgctcatccagctcaggatcggcaatgaacatcagttcgtacttatgcgcagacatcacccacctccttcggactatcggccatggaccttccatggcaggagtgtgtatgcgtactgccttcacgcatctatatatgaaaggtataaagatacagttcagacaacctgttcagcatagcccttctgctggacgagcggcaattgcgcacgttctgtggtgcaggcgcgtcatgggcacccgcattgttatattgaatacggctatttttgtacggttggtaccgtatttacgcgactctagatttgtggaaggcgaagcatgtcggcgattctcgaaggcaccccggataagaaattggctttggtgacgggtcgtgcgtaccctgagcaggcccatgaaaccgcgaaatacctgggaatcgacgtacttgagaccacggcttacgatttcgccaacggcgagatgtatgtgcgttacaccgagccggtgcgtggcgccgatgcgttcgtgatgcaggcgcacaccgagccgatcaacaagtggattatggagcagctcattatggttgacgccatgaagcgcgcttccgcccgttccattaccgtggtcgcgccgttccttggctattcgcgccaggataagaagcatcagggccgcgagcccatcaccgcccgactgattttcgacctgttccgcgcagccggcgccgaccgtattatgacggtcgatctgcatgccgcccaggagcagggtttcttcgatgggccggtcgaccatctcaccgccactccggtgctgcttgactacgtgcgcaacaacatgccgcttgagaacaccaccatcgtgtctccggatgccggccgcatcaaggtttccgaacagtgggccgcgaagctgggcaatctgccgctcgcgttcattcacaagacccgtgacaccacccgcccgaaccatgccgaagcgcatggcattatcggcgaggtcgaaggtcacgactgcgtggtggtcgacgacatgatcgacaccgcgggcaccatctgcgaggccgtgcgcacactgaacaacgctggtgcgaagtccgtgacgctggttgccacgcatggcctgctgtccggcccggccgtggaacgcctgagaaattgcggtgccaaggaaatcgtgctcaccgacaccgtgcccgttccggaagagaagcgcttgccgaacatgaccgtgctgtccgtggctccgctgttggccgccggcatccgttccgtgttcgaatccggatccgtttccacgctgctcaacggtctgcccgaagacatgcgtccccgcaatatctacgcctgattcgcgcaatcttttcaacgtaacaaaaactcgcccccatccggtcggcgagttttttaatgtcagatcttcccaaaaacggggtgccgcatcctacgtcggtaggatgcggcaccccgcgtatcaagagagaaaagagaaatctggctagcgtccgataggcatcctcgctcccgttatttggcgaatgcttcgcggatttgcgcggcattgccgtaggaggcctgcgcaccataccctgtggcggcgtatgccgaaacatacgaggcaagctcggccgcttcggaaagcgccatgcccgaggcaagaccggctagcaccgtgcccatgaaggagtcgccgcagccggtggtgtccaccgcgttcacacgcacgggggcaatgcgctggatcggcgttgccgaagtggaatccaataccacggaaccatcgccgccgagcgtcacgatcgcctgttcgaaaccgaatccacgcattgcttccagcgcatgattccaatcgaaaccgtcccaatcgtcgttttccggctcgtcaatgccgagcagctgcaccatctcatgctcgttgacgagcagaatatcggatgcttccaccagttcggccggcagcgacggggtgaacggcgaatcgttgagcagcactttcacgcccgcttcatggcacatgcgcgcggcggccgtcaccgtttcgatcgggctttccaagcacaggccaagtacggaagaccgtgccagcgcatcgcgcacggattccacataatccacggtgacctgcgcgttcgatcccggcgagtacacgatggtgttttcgccggttgcgtccacggtaatcacggttgtgccggatggtccgagcacgcggcgaacatgcgtggtgttcacgcccgcctcgcccagagcgccgagtaggaagtcggcgttggaatcggagccgaccgcgccgaacatctgcacggttgcgccgatgcgcgctgcggcggccgcctggttgccggattttccgcccggcagcagctgcagcggaccgccggtgatggtctcccccggccctggcagacgctgtgcggtgacggtgtagtccgcgttcatcgagccgattacggacactgtgccgtggatgcggtccaatgcggagagaacttcagtcgcgctcatctttaccttccttacatcaaaagaagatttatgaaaatggagatttgcgaaatagtgttgttcagtaatcgcaattatcgcaaatccccatttttactatattgaggatgtaatgtgcgattactttgccgattcctcggtttccagcgcatggttgccttcgtagatcttcttcttgaagacgaagaacacgatcaggccaagcagtgcggtaccggcggcgaccagcagcaggttggcatagttggcggcagtgccggttgcgccggtgatggagccgcctgcgagggcgttggagccgagcaggctgccgatgatggcgatgccgatggacggggaaacgttcatggccagatcgttcatgccgacgccacggccggattcgtccttttcaatggtgcccagcacggtggagaccaccggggagtacatgaggccgcagcctgcgtagaacacacatgcgcacagggtcagcaccacgaaaccggagttcacgcagaatgccgcaccggtccagccgaggaacatgaaggtgcctgcggtcacgatgccggccttgattccgatcttgcggatgatcatgccggagcaggtgcccaccacggcggcgaccacgaaggcccacacaatgtgcagggagacctgggtggtggtcatgccgtagatgttggtgccgatggcgttgaagatcgggctcagtgcgtagttcacgaagtagaacacgagaatcaggcagatggcgcgcagccagcgggtgttcttgaagaacgccggggtgatgaacgggttggaggccttgttgatgtagaaggcgaatgccacgaacagcagcagggagaccacgagcatccaccatgccatgtacgagaagaacagggtgaggaatgcggtggcgaagccgaagatcacgaagccgaatgcgtcaaccttctggccgttgccgctcttggacggcagggtcttgagcaggatcggcaggaacaggatggtgacggacgggatcaggaacaggaactgccatgcgatggagctgagcatgccggctgcgaacacgccgatggatgcggaaagctggtatgcggcggtgaacagaccgaagaagatgaccttcaaatcgttacgcaggtacttggtggccaccaccaggaaggcggaacctgccacctgttcgcctgcggtctgcagcacgcgtgcgatgatcacggtccacaggtttgcggcaaagaagtagtttgccacgaaaccgaagatggagccgacgaacagcgtcacgagaccgacggtcacaagcttacgcagggagacgaaatcgcccagggaaccgtagatgaagcacacgatgccgagcacgatgctcggaaatgcggtgatcagggacgcctggttcggtgcgccgacgtcggcgccgacctgctggaacaccaggttgaagccctgcaggcacagggtgccgagcacgaaggtgatcagcagcgggatcagggcgcggatggccatcttgttgctggtcaccggatcatcgaacggatcggcggatgcggtaccggtcacggcggttgtgttgttagacataataaaaatccttgattctctcgaattgcgcgatatgcgatacgcgattgcttggccggttacgcttattcagccttggctgcgaggccggagatgcgggtcatgaattcgttcaggaagcgcggcacgtcgacgccgacggcaaccttcatggtcttggccgggtcattcaggcgggtttcgtcgccgatggtgcgtccgcgggtcgggccttccacgtcgaccttcatattgatgtcgagggtggtgacgagggtcgggtccactgccacgccaacggcgagcggatcgtgcaggccgcagccgcccagatgcggggacgtggtttcgtaagccttgatgtagaagtcggtcatgtcggccaggaacttgccggccttggtgccgaggtcgcgccactgctgggtttccttgtaggtgagcagggtctgcagggttacgtcgagaccgatcatggtggtcggcgccccggaacggaacaggtagtcggcggcttccggatcctgcgaaatgttggcttccatgcaggcgttgcagttgccgggtacggtcagtgcgccgcccataagcacgatttggccgatttcatccttgatttccggtgctttcttcagtgcggcttcgatgttggtcatcgggccggtcggcacgtagacgagatccttgccataagtcttcactgcgtcgatgatgaagtcgaccgcagattcggtttcgacggaacggctggaatcggggatttccacatcgccgatgccgttgtcgccgtggatgaacgcggagattggcagtacttcgaagtgatcggtggtgctggagtgcggcaaaccctgatacaccttgacttccgggtggccgagcaggtcggtcacggccagtgcgttgcgcacaccctgctcgacgagcacgttgccgtaggtgccggtgatgccgatcagttcaatctccgggcttcccagagcatacgaaatggcaagcgcgtcatcaacgccggtatcaagatcaagaatcatctttttcatgtgtgtgcctttcctctttgacggcctgacgacggtccgccaccatacgggtgcatcgtcagttatacatcgagcgcattctcgattgtgttgtgttgacaagatttatgataaagcgttttatcaagaacgcaaattcttcacctatacacggcgtgttgcctgtattcccaacgattacagcatattggagatgcttacgtcaccacataccgagattgatctgcaccacccgttttgcaccagtctgcagcatctaaaaatggcggtttacgcgcaggccgcctgcaccagtttcggcgtaagcacttcaacctgcggatcggaaagccacggacgggcatcccctgattccgtaccggacttggcacgaaccgcaacatcaatccgcttacgcaacataccccaacaagcggcggccaaatcagtcacgctctgctcaacggtggtcatacgccaaccaagaccgaatcgtttgagaatattgtcgtaaccaatcacctgcatatcctcagtaacatgcaacccacgctccgccatacgctgacggaagccaagcgccatcacatcgttgcagcagaacacggccgtcgccccgccatcgatgatctgattcgcggcacgatagccgctatcgaaacggtaatcaccctcaacacacagcgaagaatcaaaatgcttccccgactgctcgatggcatccacaaaaccacgacgacgctccgcggcactcgactccgcaatatcgccggtgacaatgccaatacgagtatgaccaccttccaacagatactgggcagccaaacgaccaccaagatagttgtcaaaaccgacggcatcgcaccagccgcactgcgtcaaacggtcgatcagcaccaccgggcacgacacaagcgccacatcctcacacagctgctcaacagcactcccaacacacgactcacgcgccgggatcaacatcaccccatccaccccacgggcaggaagacgctgcaacaactcatgctccgcagcacgcgaatcatcggaattggccacaatcagcgaatacccctgcgcggcgcactcatcctccacacacttggcaagcgccgcgaaaaacaagttctcaatatcaggcacgatcagcgcaaccagctgggactgcttggtcaccaagctacgcgcgctctgattcggcacataattcagcttcttcgccgcgtcggcaatggccttacgcttctcctcagacacgcgagccggccgattattcaacaccagcgaaaccgtcgtcacagacacccccgcagcagcggccacatccttcaacgtcgcacgatacgccattcaaaccccttaaaacgttgctccttccagcataaatgccacgcactcctgacgcgcccagcacccccatccacaaacaaattcctttcatagcaaaataatccacactatttccaccggtaaatcgtttttcggaagtgttttttgtatactcgcaacgttttgcccgaaatgagaaccgcacaagaagaaaggaaccagcaatgcagccaacagcacagaaaaacaatgcgaaacagcgcaaaaccatcgccatcgtcgccgtgatagcagtggttgccattgcgctcgcagccgttgccatcatcgcagtcgccaataagcgcgaaatgacgcaagccgccagcgacacctgcacgttgaacgcgaaggcgctcgccacgcatcagcaaaacttcgaagtggctcagaaagaagccgaagatgcggcaaaactcaccgtggacgacgtggccgacggcaccacgctggaaaccctgaaggatgcgatcacgctggccgaagccgtggaaaacgcgccaacatgccccgcgaacggcaatgccagcgacttcaccaaggcgacagacgatattcgcacgtacgccgacaacctgcgcaacatcaccaacgaactcgacgcggccgccaagtcggtgatcgccagccaggaactcaaactcgagtccgccaagtaagccgtccgagccagacgagccgacagggcgccgcccctagctccgccgcccctgcgttcaacggggccaagttgcgttttcaaacaactttgacctcgttaaagatgactttcgcaacgttttcacaacccgataaccgcccataccgcaaatcgatacccccttccgcaaaaacccgaaagagcttattaacggggtcaaagttacgttttggacgacttcacccccgcacaagcgctttcgcaccgtatctggcttatatatggcagattcgacagtccgaccggaggcatttcctgacgaagtcagctacttgcaacacgttatttcccaatcgccacttgccgaacccaattaccaagctgcgtcgcatccaccatgacgcaccgtcacaaacgttcccgtccgacgcgctttactggccttgggcgcggtagcgggcttcggtggcggctttggcgggctcccaccaggcgcggttggcagcataccaagcgatggtcgcttgcaaaccggcttcgaaatcggtgcgcacaggcttccatccaagttcggtacgcagcttgctggagtcaatcgcgtaacgccgatcatgcccggggcggtcacgcacccagtcgaacgcatcttcggcacatcccataagccgcaggatcatacgcatcacggcaatgttgctcatttcaccatccgcgccgatcaggtatgtttcgccgatccgcccgcgtgtaagaatcttccacaccgcagaagagtggtcttccgtatggatccagtcgcgcacgttctcgcctgtgccatatagtttcggacgcacgccctccatgatggaagtgatctggcgtggaatgaatttttccacatgctggtacggcccgtaattgttggaacagttggaaatcgtggcgcgaagcccgtacgtgcgaacccaggcacgcaccagctggtcggacgccgcttttgacgcgctgtacgggcttgacggcttatatggcgtgctttcggtgaatttgcatggatcgtcgagcgcaaggtcgccgtacacttcgtcggtgctgatgtgatggaatcgcacgtcatgcttgcgcgccgcctcaagcaggtggaacgtaccctccacattcgttgtgatgaagggttcaggattggcgatggagttgtcgttatgcgattcggccgcgaaatgcacgatcgcgtcatgaccaggcacgatacgttccagtagtgcagcatcgcaaatgtcaccttgcacgagttcgacttgcgattgcggaagaccggcgatattctgcggatttccggcatacgtcagcttgtcgagcacggttatgcgcacgtcaggatggttgtgtgccacgtagcgcacgaaattagctccgataaacccacatccgccggtcacgatgatgttgcgcggcttgaaaatctcactactcaccatttcagggtaccggcagggttgcatagttcatggagcaatttcacacctacctcatatatggcagatttggaaggctgaccggaaatatctacgagatacccgttcgtccacagctgaacactaaaatgtatccggtttaattgtacagagcccctaattataaggggctatcttgttgaaggatgcgacgatgcctattttttcgcctgaccgtcatgcttgtgcaccttcatacgtaaaacttactaagcagccgattgcgggtggaacatatcgccctcttgcgaatgacgaagacagcaacgcttgcgccccatccgccctttcaggccaccacggttcaaaactgtatacgcagaaatcagcaattcacgccatctccgataacacaagcattttcattcccaaagtcgatgcgccccatctgccaaaaacgactgacgacaagtccattaacgaagctgcgaacaacagtacccatccagcccccctatctgctgaaattcagctcacgcaaactgacgaacatcctctgatgcaggcctttgaagtctgcaagcaagcagcccgcaccacaacaaacgcgctttccaccgcagggcacgcagtcgtaaaagccgccaaaactaccggccacgccatccatatcgccgccacagcagtaaagaccgcatggcacaccttcaccaacttcaaagccgttcaactcatcatcaaattctttagaaaagcatatggcccgtggaagaagcgcatgaggttctcctatgcgttctacgccatcgtattcaccctattgacttctgccgaggtcatcttccttcagtggggaatgtatagcgaaccaacatacgataaaagcaacgaggtggatcagacaaccaaaatcctgaacagtgtcgcagggcaagtcaccaaattcgtcagtcaaatgtatcttgagcaaaaataccaattcctgctcagtctgtttacactcgcagtgatttatcttgttttcatctttgtcaccaatcgtttttggattgcgacattattgttcggtattcttttcactgtctacggaacggccaacagcgttaagatgggactacgcaatgaatcaatcattcctgccgatctatcttttgtgacaggaggagattcaggaaaacttctgtctttcattcctaaagaaagtcagtcattcgtcaacggagccgccactgttttagtctggttcatttgctgctgtatcgttttcttcattatagatggtagacggagtttcatctattgctcatggaaaagaccttttgcaagcattaaaaactttactggcactcttacccgcattgttgccgcaatatccagtattgctttgctctgttcctactcttggaacctcagcgttcccggctcctgggcatactctttcgcgggatcgcttgggtatactccttccttattcgatactaaaattgacgcccagaccaatggtccggtcactacattcctcagcttggcaaaaacgaaagtgatagaaaaaccaaaagattataatcgcgatacaatgacgcaaattgcggaaaaatactctcagcaggccatatcaatcaacaacaacaggcagaatgaccttactgacagtactgtagtaatgattctttcggagactttttccgatccaacaagaattcctggtatttctttttcgactgatccgattccgaatattcatgctataaaagacaccacgacctcgggcttgatgttgtcttcggggtatggcggaggtaccgccaatatggaatatcaagctttgacgggtttaagtctgtctatttttgatgattccctcattatcccgttccaacagcttgtgcctaatcagaagaacccttatgccttcaaccaaatctggaacaatcgatatggcgctgacggctctgacgcagttcatccgtattaccaaagcatgtatctgagaaacgttgactacaagaaatttggcttttctcacctacgcactcttgatagcactccctcaatcaagcacaaagacacaatcgactactctccatacgtcagtgatgaagaggcatacaaaaatattattgatttaatcgaaaagcaaaagcacccacagtttttgcaattatccaccatgcaaaatcatatgccttacaccaattggtacatcgataatgaatttgtaggcgcagatacttccacaggattgtctgcggacgaatatcaaaatctcgaaacctatactaaaggactaaacctcaccgatcaggcaaccgcttcgttcttagacgaactcaaccaaattgacaagccaattactgtgattttctatggcgatcacctgcctagtatctattcgacagctgatcaggatactgaaaatcacgtcgctctacatgaaaccgactactttatatggtcaaacagtgcatcagcatcaagtggaacgaaactcgatgcctctaatacagccttcacgtcgccaaattacttcatgtcattagcagccaaccatatgaatgcgaaagtatctccttatcttgcattacttacacaattgttggaacaaattcccgcagcaagtcgcatcgcaacagaaacaggcggaatcagttcaggggacacaacgtatctggacatgtcaggcaatcagatctcgaagaaatcactgagtaaggacgcaaaacaactacttcgtgactatgaattggttcaatatgatatgaccgcaggcaaagggtatctaaacaacaccgatttcaccaaagtccaataaccttgtacgatagaaacgtacgactaacccatgcgtcaaggatgcacttcatgaccggtataagaccgttggtctcaattattgttcccgtgtataacgcagaaaaatatctgccatactgtatcgattcaattctggctcagtcataccaaaccttggaaatcatcctcgtcgatgatggcgctacggataagtcgccacaaatttgcgacagttatgcagctctggactctcgtgttcatgtcattcatcaagaaaatggtggcatcgctaaagctcagaacgctggcctcgatgccgcacacggtgaatatgtcgcttttgcggacaacgatgacattttggattgtcataacattgaattccttctgcatgctctcctaagcagcggctctgacatgtctaaggctcggtggcaacagtttggcatctcacagctcgataaggtcaaatcagttgcagcagtaggcgcaacggcacctaacaaagtaactgcattcaaaaacccacttcggtcgtatcaaactgttttctgcaagagtcttcgtctcatcggtgacatactcaaaaaaaataccgaagctcgttacttcaacgaggcgaactggtgccgcttatacaaacgagaattgtgggacggcattcgtttccccgaaggcatgtatgcccaagatgtcatggtagccggcaagttatactcccgcatgcataaagttgtggacatcgattgtactttgtactactggctccagtcccctggatccgtcactcacagcaagcgcaattacagtttttaccaggacaatctcaacgcggggctgtcaaatttcgagcatgctctcagccaaggcgtgcttccagcccgcagctactacaccatgatcggatcactaaacgaggcagcctccgcccccgatttaagctcaaatagaagcacttatgagcgtagcaagaacgaggctcaatctcttattaggaagctgtctctttcgcaaaaaacaatttgtgtaattctgcgtcatatgcggttagttgaaaaggctgtgtacgaccgcaaaattaaaaacatgcagtagcttgcttcccaaagcaatccaacgttatatgtggcatgtgcatagggtgtagattttaaacagcctaaagtttcagctatcccttttgatagagtggagagactatgagtgacttaattcggcgtttcaaggctaagtaccgatattcaatagtggtatttaaagaattagtgaagactgacttccagctaagatatcaaggatcttttctaggcgtactttggtctgtcttaaaaccgttgatgctttttgccgtcatgtacatggttttcgtccgattcctacgtttttcggacggtactcctacatttgcgatttcacttctgtgcggtacatgcttgtggtcattcttttctgaagcgaccactatgggaatgcagtcaatagttaatcgtggcgatttacttcgcaaggttcatttcccgagctatatcatcgttgccgcaacaaccatgggatctatgatttcccttggaataaacttgcttgtggttgtcatcttcggtttcttctcgcacgcccattacacatggtatatgctgctagttcctctgaacgtactgcagctttatgcgctggccctcgccatttcgttgcttctcggcacgttgtatgtatattttcgagatgtgtcccatatatgggatgtcgttttacaagcaatgttttatgcgattcctgtaatttatccactttctatggtttcgcagtacttccccgctgtgtccaaaattatgttactcaatccaatagcgcagaccatcatggatgtccgtcacaatctgttatctccagaggacattccaactgtatggacatgggtgggtgaccccattctttcccttatcccgtatgctctgacggcattattgctctggcttggtgtacatgttttccgaaagaatagcagcaaattcgcggaggtactctagtgactacagttgaaaccccgattgtcctgtcgaacgatgaagagaatcccctcgcgctatctgtttctcacgttgcaaaatcgttccgtctgccgacagaacaggcaagtggcctaaaacaagccttcctgaactggaccaaaggcatcaaaggataccgtgaacagcaagtgctgcgcgatatttctttcgaagtacgaaaaggtgatttctttggtatcgtcggacgaaacggctctggaaaatcaaccctcctcaagattatttcaggtatctatacacccgaaaaaggcaacgttgtgataaatggaactctagtcccgtttatcgaattaggtgtcggttttaatccagaattaacgggtagagaaaatgtgtacctcaatggcgcactcctcggtttctctcgcgaccaagtcgacgcaatgtatgacgatatcgttgaatttgctgagcttggtgaattcatggatcagaaacttaaaaactattctagcggcatgcaggtgcgtcttgctttctctgtggctatcaaggcgcgcggagacattctagttctagatgaagtacttgcggttggagacgaggctttccagaagaagtgtgataggttctttaagcaggtcaaaaccgatccaagcaagacagttatacttgtcacgcatagcatggatgccgtcaagaagtattgcaataaggcaattctcattaaagacggtgaaattattgcctctggtgacccacataatgtcgcagatcagtattcgctcgagaatgcacatgaactcaactattacaagacaaagaacgactcgagcaaggagcttcactatcccaatggtctgaaccagcgcgttcccgtgcttcgaataactcctgtcagccctaaaatcgtcgatggggaatctccctttgtttttgacgttgaatatgaatacgccattagtgatcgacagggatatctggggctaattctgcaagatgcacgacgcggtggccaaatttatgacgtcgatactcaaagcgaatatttcggtctcccaattgaaaaagggcaccataaagtccggttttccattccaatggagcaattcaataacggggagttccgcattttcgccaccatccgttctgagtcagaggaatcagaacggccagattacgtcgctttcaccaacgatgatttctgctgctattttgcagtgcgcaatgatagaaacagcgaaaatggtatcctcagtgaccgcgcgttgacttttaatcgcatcgactagtcaagttttacgagaaggacgactttcaaaaaattgacaggtctttagaaagcgacagcgagtcattgctgtaagtaattatgatcagataaataactgcagcaacctgtccaggtcgtgatacgtattatcaatacacacagagagagcaaactactatgaaaattcaagatgagtcatcggtaaaacgtcttgggattttcttcttctacgatgcagaaggcgtggtagatgactacatccctacattgctgaatggtttcagaccctatctttctgaaatgactatcgtctgcaatggaaaattgaacgaggcaggagaaaaaattctttcctcgtatacaaataacctgattgttcgcccaaatgagggcttcgatgtttgggcttataaaactgcaatggaatcttacggttgggaaaaactcgtatctttcgatgaagttgtgctgttcaacgccaccatcatgggtcctgtctatccgttctctgaaatgttcgagacgatggatcagcgtgatttggacttctggggtatcacaaagttccataaagttccacaggacccattcgggcgcagtccctttggatatctaccagagcatattcaatcccacttccacgcataccgtcgaagcctgattgagagcaagtcattccaagactattgggacaatatgcctcctattaaaagctactatgactctgttggcctccatgagtcattgtttactaaacgttttgctgacaagggatttaagtgggacacctacgtcaatacggatgatttagaaggctttacatacggaccgattacttttgccgcgaagacactagtcgcagaaaagcgttgccctattttcaaacgtcgctcattcttccatgactacatggataccatgaatcagtccgtaggcaatgccgcgttggacttgtttgaattcctacgtgatcatactgactttgatgttgatctcatttggcaaaatgcactgagaaccatgaatctcgcagatcttgtcagaaacctgcatcttgattttgttcttccctcaaatactatcgctcccattccgactaataagcgtattgctcttatcatgcatttgtactatatggatttgctcgataagactctggaatacgctaaatccatgccggaaggttgcgatttcattttcaccgttggctctgaggagaacgctacgattgtgcgagagcgttgcaaagatctgccctataacgttgatgtgcgtgttattcagaatcgcggacgtgacgtcagcgcattattggttggagcaggcaaagactgccttcaatacgattacgtatgcttcgcacatgacaaaaaagttacccaactttctccatacagcataggtgatggcttctcttataagtgcttcgagaatgtattaggaagtaaggctctggtcagcaatataatcaatcatttcgagaatgatccgcatgctggcgttcttgcgcctgcgccgccgaaccatgctgattattttggtaatttcgccagtctttgggggccgaattacgaaggtaccaagaagatgcttgaagaaacactacaggttaaggttccactggataaaagtaaagaacctattgctcccatgggaacgatgttttggttccgtccaaaagctttgcaacagttcttcgacatcgactggaagtatgaggacttccctcctgagccgaataaaatcgacggttccatgcttcattttgttgaacgagcttacggttatgttcctcaagccaacggctactatacaggctatatctattctgaccgttttgcgcgtatcgagatcactaacctttcttatgatatccaaaagctagccaattctgccgctccatatcttgatgcgactttacttgggacttgtacaaatgtaccccgtggcttctctttaagagctgccattcttctatggttcaagcgtatgctggtaaaaataccctttgcctatcattgcggtgcaaagttcatgaacttgtatagacatatccgtcacccgcgcacatacaaaacacgatatggcaatgccaacagccatctgaagaaagaccgtacatgacagacaatagtctcaccgccaagaaagctgaggacgtagcccagcaaagcaagaaaaaacgtccacgacttttctatttggatttggtgcgtgcgctagctgcaatccttattattatcacgcatttcaacaatccttatatgcttggtcatccagtttttatatatgaaccatttggcatttatgtaggcagtctaggtgtatcgttgttcctcatcatttcgggagcagcgcttatgtacacatatggcgaatccaacaaactagactgcaggcatttctattacaagcgcttcattggaatctatccaatgttttggattgcattcattatcgctaacgcctatctttttttgcgtaacggtggacatgtattcgcgaacgcctcaaaatggacgttaattttctctatgctcggcattgacgggttaatggccaatacttcacttccaacgttctatacgcttggtgaatggttcttgggattcatcctcattttctatgcagtatttccgttattgaggtacggggtaaaagaacatcccatcgtcactggatctgtcgctattgcattgtatgccttgacgctttatttccatccaatgccccttggattaccatctgatttattgcttacaatgaggctgcctgaattactgttcggcatgtatttcattcagtacatcagaaaaataccaacctatgcagccgcagtagctttattattccttgttgtacaagaaattcatccactgcttaacgggtcctttgccgtgaccatcgtaggaatttgtgcatttgcagttatagtttatatcgcaaaatggcttgatatacaacctattcgagtgccagtaaattctgtatcaaaatattcgtatcctattttcttagttcaccatgttttgatttcacaggtattcacaattgttgactgtactgctttgtcacacttcgacggttatctactattttttgtagatttcatgataatcatgacattgtcaattgcactgtatcgactagaaaaaaatactattcaatatatacattcaatgtttcagtaaaataagaaacgatatccttataaataatgcgcctgatttaacggcgcattatttatatgctactaaaaagctgtttcaatgtaataccgaggacgatgcttagtttccaagtagattttacctacatattcgcctacgatacccatcgaaaccattaagaaacctccaatgagccatatagagcacatcatagatccccaaccgacaacagcatgattcataaaaacagacccgattgcatatgccaacatgattaagcctatgagtatagatatcacgcccagacccgtgacaaacttcaaaggctttgtggaaaaagatgtaataccttccagcgcaaaagcaatcatcttcttcaatgggtatttagactcgccagcttcacgcacaccacgcacataataaaccttgccggttttaaagccaatcgacggaacgatgcctcgaaggaataaattgacttcgtgatactcagatagagcctccaaagccaaacggctcatcaatcgataatcagcatgattgggcacagtttcagcacccatccattcaaaaacacgataaaacatcaatgctgaattcctcttaaaccaagaatccttctcccgagaggagcgaacgccatacacgatctcacagtgctcttggctaaatttcttaaccatctcatctacagcattaacatcatcctgcaaatcggcatccatggaaatagccgcatcacatccatcacgcaatgcttgcatgagtcccgcgtataaagcactctgatgaccacgattatgggcaagcttcactccgccgaacaacgcttcatcctcataatgcaattgctgaatcaaatcccaggtaccgtctttagatccatcgtcaacaaatagaatgcgacttttccccgaaataccatcacaagcaatcagctgattaatcttcttttttagcacatcagcagtatgtcttaaaccttcagattcgttatagcaaggtaagacaaaatagacaacaggtaaagtcataatgtcattagccaaaatatattccccaattatcaagtactaccttaaaaggacaaagcaatataaatatatgctccaatacgcaaaagctaaaaattaactattatcaaatcacccttcttagcgacacttcccggagcaggccaatgaggcattgcagcaccgactttctcagcactttgcaactgaggcttgctggcctgtttgaatttgttgcccatgatattcataaaattcgtcttaacaaacgttccttgctccggcgaaacagttacctcaaacaaagaccgtccgaccagccctagttgatccgaggtaaaacaatcactattacatgcagaaggatgatagttcaaaaacaccaaagtttcttttgattgatcggtgacaccaagctcatcaatacggttcctgatatcctgcgctaattccgcatcttgctgatgattaatagcctcggtataaaaaatacgatttacgataagcgcttggctccagctaaggataaatgccaatacaacagcaacatacttaaccgcaattttcccattaaataagtcagaagtccacatcaccaagaaaacgacagcgaaagcaaacatcagcggataagacatttccgttctcactgatggtgcgcttcccaagataatactcatcatcattggagatagacacaaacacagcgagacaatcagcgtcaatacatcaactttatgccgaaatacagaaatcaatattattacaataaatagtgccaacaaacaagtgaaaacttttgaataatatattcccttgcctgaatataatgatgcagcatgcaaacttattgattgcaaaatgtgatgaacagagtccttgccccacctcgactgctcactgatgtaagggtttgtcgtcatatggcatattttcaacgcacatacattagcaaccacatataaaagataagaaatacagaaaaatccagcacctactccgataaaaacaaaccggcgagctaaagtaaatttggaattatcccaaaataataaaataaataccatagcaaaaccggcgataaaaaccgtcaccattgccaaatatagcgagaaggagaccgtagcaaacaataccgttagaaagcccatccaccactttttgcttacaacgaaatccatcaaacacatcaaggctatcgctgcaaaacctatggcaatccccacttctgctcccataagagagaaccctaacatttctgccaaaactggagatgtaacaaatggtcctacaaaataaaccggatgatatttccctataaaattagtgacgccagaaaaaagataagcccataaaagagccgccacaagtaaacagacggcagtcaggaatgatgctaacgcgttattataccagtacaatcccaacattttcttcaggagcaacaatccaaatcgttctagcccaatccaagatcggtatagtgaactttggacttgtatcattgcctctgtatcaatagaatatgaattaccgaacattttcagctcatatcccataagcaacaaaaatgtgctcagcaccatatcccaagggttcatgcgcagaaaacgcatgaacccgcgaactgtatactgcctctctaaaggaaaagtcgacgttgtggaatcaacggatttctctccagaatttttcctttttcccttagctattgagtcaatagtctgttctgttgttgatgcacatgtcatagtggatgccctaattcactggttttttaaaatctgtttgatcttagaagcatcgccccatacgcccggcgaatcgtatggacgatcagggaacacgccatagtcgagcttaatattgagatcattctccttgatatagcgctcgacgcgttcagccaatgtcatcggttcaccagtgcagcaattaatgacgccatcaaccgcatcctgcgaaacaactgcactaatttgacccgcaagctcatctacatcgatgaaatcgtacttatttttacctgtagtgaatgggaaagtcgctttgccatcattcgctgcctgcagcagctttgagaaaatagagctaccgtgagcatcgtcgccaacaatgtagtaagcacgaatccattgcgcagttgcatcatattccttagcaagcattaaagtcgcctcacgcaacgcattcttagcaattccgtacatagaagcaggatggcaaggagtattttcatcaatcgcgccttcccaataaccaacttcatgcatagttcccataacagcgatctgcttaagcccagagtcaagcatgtgcttcagaaagcgataatggttggacaaatcccccatatggttatccgaattatgtttaaaaccatcacgccaagccatgtgcagacatacatcaggggcccctagctcctcaaataaatcatcatttggctcaaaaatatttgcttgtacttttgtggcgcgttcatcgacaccatcaagccgtaaatctgaagcaatgacgtcttgtccagcatcaagcaatgcactcacgacatgacgtccaatatatccgccagcaccagttaccaaaattttcttagccatatttacaaagtctaccagcaggctccccacaggaaacaagcgattgaatgtctagcccaattttcacgtttttagaaaaactcgtacgcgcaagcggctaatattgcatatatggctgaagagacgtttactcccaagaacatcatcgtgaccggtggctgtggtttcatcgggtcgaatttcgtacattacgtggtcgacaaccatccggacgtgcacgtgaccgtgctggacgctttgacctacgcaggcaacatcgagaacatcgcgggccttcccgaggaccgtgtcgagttcgtgcacggcaacatctgcgacgcggagctgctcgacaggatcgtgccgggccacgatgcgatcgtgcattacgcggccgaatcccacaacgacaactcgattgcggatccagaaccgttcctgaagacgaacgtggagggcacgttccgtctgctcgaggccgtgcgcaggtacggcatccgctaccaccacgtgagcacggacgaggtgtatggcgacctcgctttggatgatccggccaagttcacggagcgtaccccgtaccatccgtccagcccgtattcgtccacgaaggcggcatcggacatgctggtgcgcgcgtggacgcgtacgtacggcatccgcgccacgatctcgaactgctcgaataattacggcccgtaccagcatgtggagaagttcatcccgcgccagatcacgaacattctggacgggcagcgtccgaagctgtatggcaagggcgagaacgtgcgcgactggatccacaccgaggaccacagctcgggcgtgtggacgattctcacgaagggccgcatcggcgagacgtacctgatcggcgccaacggcgagaagaacaacatcaccgtgctacgcatgatcctgaagatgatgggacagccggaagacgcgttcgactgggtcaaggaccgtccgggccacgaccgccgttacgcgatcgattccacgaagctcaggaccgaattgggctggacgcccacgcacacggatttcgagtccggtctgaagaccaccatcgactggtacacggacaaccgccagtggtgggagccggccaaggccgccactgaagccaagtacaagcagcagggccagtaaaaagcgtatggaaaacaggccgcgcccggaaaaacgcggcccctgaatgtggtccctattaaagcaaaggatttacggggtatggatttcgagaaggatctgagggtcgaggagacaaacattccaggactgctggtgttcgacctgccggtgcacggcgacaaccgtggctggttcaaggagaactggcagcgcgcgaagatgaccgcgctaggcctgccggatttcggtccggtgcagaacaacatcagcttcaatgcgaagaagggcgtgacgcgaggcatccacgcggaaccgtgggacaagtacatctcgatcgccacgggctccgtgttcggtgcatgggtggacctgcgtccgggcgagagcttcggccaggtgtacacgaccgtattggatccatcgaaggcgatctacgtgccgcgtggcgtgggcaacagcttccaggcgttggaggacggcactgcgtacacgtatctcgtgaacgcgcattggagcctcgagcagaagaagacgtacacgttcgtgaacctcgccgacccggacctggacatccagtggccgattccgttggacgaggccgaacgcagcgaggccgacctgaagcacccgatgctgagggacgcgaagccgatggcgcctaagcgcacaatggtttttggatgcaacggcaaactcggcaaggcaatcaggcaatatgccgaagatcatcatctcgaaggttttgaatatcacgacacagacaccttcgacatctccgatgcgcatgcttttgaaaatgtggattgggatttatacggcaccattattaatgccgcagctttcactgccgtcgatgctgccgaaacagcagagggacgaaaagcggcatggttgacaaatgtccaaggcgtaaagaaccttgctaaagtcgctacagatcacaaaatcaccttggttcatatttccagtgattacgtattcgatggcgaacttgaattccacaaagaagacgaaggcttcgcgccactgggggtctacggacagaccaaggccgcgggtgatgcacttgtggaaaatgtccctcagcattatctcttgcgttctagctgggttatcggtgaagggcgcaactttgtaacccgcatgctaggtcttgcgcaatcaggcgaacctgcagaagcgccacgagatcaattcgggcgtttgactttcacctttgatatggcaaatgctattttccatctcctgacgacccatgctgaatacggtacttataacatgactggatccggcaaagttgctagctggtacgatatcgcaaagattgtttacgagaccgcagaagctgatatatctgcgcttaaggcaaattccgtcgaagaatatgttcagaacactcacggtgcacttcgcccacgcaattgttctctggatctaagcaaattggaatccaccggatatgcaccggttgactgggaagaggctctccacgactacctccagaaggagattgcaaaatgaaaggcatcattcttgctggaggatccggcacgaggctttatcctctaacaaccgtcacttcaaagcagcttctaccggtttatgacaagccgatgatctattacccgctcagcgtgttgatgatggctggaattcgtgacattttgatcatcagcactccgaaagatctaccgaactttgaacgacttttgggagacggtagccagtatggagtcaatttcagttacaaggttcagccgtctccggatggtctggcgcaagctttcatcatcggagaagattttatcggaggcgaaccctgcgcacttgttcttggagataatatcttctatggaaatggtcttggcaaaaccttgagaagagccgcctccgtcaaacacggcgctactgttttcgggtattacgttgatgatcctgaacgttacggtgttgtcgagttcgacagtaaccataaagcgatatcgatagtagaaaagcccgaacatcctgctagcaattatgctgttacgggtctttatttttacgatgcacgagtcagcgagttcgccaagcaggtaaagccttctcctcgcggagaactcgaaattactgatttgaacaagatgtatctagaagataatagcttaaacgtccaaaccttgggacgaggctatgcttggcttgatacgggaacaatggattctctgtttgaagctggagaattcgtgcgaacaattcagcatgctcagggtcttccgattgcagtcgcagaagaaatcgcatttgaaaatggctggatctcagcagagcaacttatggaagctgcaataaagtatggaaaatccccatatggaaagcatcttaaagatgtcgcagaccataaaattatatcccgtccaaacgatgatccgcaaataactgaataataataaaaaatagatcgctgtttcacgaagctcatgaaacagcgatcttttttatcagcctaataactagcccaatgagtcgtcaaactccaaaggcataggtcttagtctctactaacttcccatttgacgtatacaactcaaagtgagtccaatatatccctttactaggtttttcccaaacagcccactgaccgttaaaaccggcgacccattgttgcttgtttacgtcgtatatcttaatcttgtaacgtccttgagcattatcagaggatactcccagcaaaacatcttttgactgccatcccgcgtaagtagcattgatccgcttgctgcccggaacatatgcaaatgcgatggtcttttcaccaacacttgtcttggaagccgcatcgcgcacttcaagatgcaaccaatatgttccaacatcatcagaccagccggcccaatttgcactattccaattggcgatggtcttccatttgcccgtattaacattgtacgactgccacttgtattcaagatcagtgtacggagcattcacagatgctccaactgcgatatcttcatctcttacgacccatagcagattaattaaggattcatactccttattcccaaacgcattcatgtccacgttgccgctgatgccgtccaccttgccggtgctggtgtattgccatccgcgactgttggtcgggaatgagtcgaatcccatgcgagcgccgtactgcgccacccacgtggttttggcgtaaatgtcggcatgtttcagcggtccttgcaggtagctggtgtacgagtagacgcccaggttcttgtatccggcggactgtagtgcgctgtaccaattgttgacgatattgttgtacacgttcgggtcggtgggcggctgatgcccttcccacgtccacttttccaggtcgtaatacacggggtacgccagatcgctcggattcacgccaaactgcttgagtttggcgaccacgtcggcaccttcttctttggcgagcgccggagtgtccgcgtaggaataccagtagatgccgaacgggatgccaagtctcttgcattcggaaatgttacgttgcgctttcttgtcggcattgttgccttcgccgtagccgaggcggatgatcgcgccttccacgccgtcggctttcgctttggcccaatcgatgtcgccttgccattcggaaacgtcaatcacgcctttggcttgctgcacgaacaggttgttctggtagtcgaagaaagctttcgtattgttgtaggtgccccagtgcgcgccgtattcattgctttcgaatttggagagctgtacgttcgcgtcggctacagcatttttgacatcttccgcacttaccggaatgaaggattcgccgttggttttggcgagcggatccggctgctgatctttcgtgccgaccaatgttggatcggtcacgatttcgccggtttcgatgttcttgacctcaccttcgggggtgacagccaggtcttccgaaatcacggtggcatcgtcggaaatctcgtcactgacgttatccggaagtttcgcattcggattgtcaggcatgctgtcttgcgattgctggccgcccgtctgatcatccgactgatcgtcagactgcataacaacaccattatctgcagtaacggaaccgctttgcgcaacagcatcctcaatcgcaatatcctgcaatgcgtaagccggcgcaaccgcaacggaagcagtcaacgcaaccgcagacagcgcagtcgcaatcttcacaacatgatgtggcgaaaccattcgtcagcctctcttgaatacagtcatcaaccccaaatattcggcgcaaacgccctaaccgccaactctaactgcaacccacaaccccgtccatccccaactccaaaatcatcccaatccccacatctcacgcattacacactgataagaatcgactagctcgttaggggcaccgatatggcatcatccatttccatatctcctttccagcattctcgctgaccttcccatcacgcttcgtagagggaccatttccaggaggggagtacgtggatcgtgccagtggaatcgggaagttcaatggtttctccctcgttaagcgtgagaatcaggccggaatcaacgttggtacgttgcataaccgcttgcagagagccgatttctcgcgccctggttttctcatttcccatattggcacacacttgaataagcccatacggttccgtaacaagagcatcgccgataagaaagtcaactttctcctgtttggacgtcggcatagtgtacgaagtgattgtttccgtacgcctaccggaagttcgtctctgcagttcgcagaaaatcgcagtttccagtcgttttccaatatcttgctggttggcgcgtgacaccgcgtaaaccataccctgatcgacggcatacattttcggcaccgcagtactacccggcttgagcatggtggaatactcctcaagctgatacgccagaaatgcctgcttgaacagctcgagtaacgtattcgccttatcccaatagattttccagccgaccgctcgcaacgtttccacaagaccattggtagacagctcgcaggccgtattgcgcagcaaaaacagcgctatctgcgtggcgagagtaatgttttcacgaccaagacgctcggcaacgtcacgcgcaaccacgtcccgcacgtaaccttggagcgtttcaatacgatcagcttcaaccatacgttgcactgcagggaagccgccaatagttaggtaatcgttgtaggcagcttcaaaccgggtgacctctcgcggcgaaaacacggcatcggcaagagtgctgcccgctgtaggcgtttcgattccccgaaagtcgcagaattcacggaaagacagtggcgccatggcatgcggatgcgatcttcctcggaaattcgttgcgatttcttcgctggacagtttcgaagacgatccagtaatgactagcgtcacagcttcatgttcggctatgtgctggcagaatccctgccaattggcgcattcttgcacttcgtcaaggaagaggtagcagccatggtcacgagagtcgggatattgccgccagtattccgtaacaatatcgttgagcacggtgtcttgcattggttgtagacgatcgtcagcgaagttgaaatagaaaatatcattacgcgagacgccgttttgtaacaaatcatgaattttctggaaaagatagaacgttttgccgcaacgtcggatgccagtgatgatgtgcacagcattgaacactgccggctgcggcagctcgcgtatgatttcgatgcggcgtgacggcgtaggaatgtcaaactgcatggactcacgaaccagcatggcatacgattcacatggattatccggcaccataagttcttcctttcgccgtccgttgcgaaacacccaacaatcccagcataacacttctcaaaaattttaagaagtttccaccaacacttctaaaaatttttaagaagttaccacagacgaataaaactccagagaatacctgaatgcattaacgactacaacacgagtgtgggaaatcggggaaggacgggtatcgtacgctgtatattggcatttcaggtggactctcggaacgtgattcaattgacctgaatcgggagctgtcaccggggagtgcagaatagtaggcagattctggaggggttatggcacggcacggcaagaagccaagcgaggaaggtacctcgccacacacaccgagaacacttgccggaagcgcaacgaccaacacttctgccgacagcactgacgccgctgccagcggtatcgctgtcaacagctcgaccgtcagcagcgcatttgccagcgatgccgatggcaataccgggaatacgcttgtcggcaacgcttccaacgaagtcgaagcaaccgaagtcgaaaccaacgcaaccagtaccaacgcaaccggagagcgcacaatcagcagcagcaacacggctgaaatcagcaaccggcaatcacacgaatccagcgaatcccgccagccgcaagacctattcgacgcggccatagcgcaaggcatcagcgacggcgacgcttggacggaccagcgcgtaaaacacatctaccgccagatcatcatcgtcgtagtcgtcgtagtcgttgttctgggcgcggtcttcggattcacaggcgtgcgcgcatcgcagcaaatgcgcgacctggccgcactcaacgactgcaaggaagccgtcacggccatgaacatctcctattccaaggcgttccagctgaaggcgaagatctccgaagcgttcaccagcttcgacgggtcctacgatctcgacaagcttgccgaactgcaccagacggaagttaccgcgccgaaaacgctgagctgcgccgccgacacttccgctaccatcagcaaagccaacgccgcaaaagccgagtacgacaagcagaccaagcagttcaagcaggctttgcagaagagcgacgaatccgcggccaccgatggcggtgacggaaccgacaatagcgctgacggaacggccggcgacgacggaacggacgaagccacagacacggagggcgatgctggagttgccggcgacgcgggcgccacggacggcaccgtcgaccaatccggcgcagccgacgcgaccgacgcaacgctggacgatcaattcctccagtaaatcaaccgatcgcaacgctgccaaccaaccagccgatcaagccggccaatcaaccagccgatcaagccggtcaatcaagccaaccaggcctgtcaaccaagccggtcattagcctcaccgtctttacgtttctcccaactcttccataccccttttccgcatacccaacgtttcttttgattttagaatcaaaagaaaagcaaaagagagtcacatggcaggcaaaagaagaaacgctgaaattccgccattttcaagacttcacggctataaaatgcagtaacaagtcaaaagaaaagtgcaagactagggaaagaccaaacgaacggaaaggaggctctcatgagctggacatcggcaaatggtcgagagatcaccgatgagatgatcgatcgttggcgcaaatcctacgaacaaggcgaatttcctgaagacgaacgaacagtgggtggcgtgattatgggacgtccaccgctctcgaccgataaaagtccggcccatgggacgccatcatgaagagatgacagaaatgggcagagcctgacggatgaccatatttgtgcgcatcgcagcaagattgactaggctttaatgtgattgctccgttaaacaaacgctgcaagcgttgcattgcggacgcagaaggggagccatcttgaagaagaaacgactggcacgcgtgattattgccgcggtagtgaccgcggcaattctggtggcgatcattgttggttgtgggccgaaatggggcgacggttcagcaaacgtcaacggcagtaattccaatagcagcaacagcgcatcagataatgtctccagcaacgacaacgccgcgcaatccaacaacaattatgcgacccgcatcaccgtgaaactcccctcctactatttggagaacatggttttccaacgtgggaaaacgctggtagtcaaaggaacggccaccacttcacaacgcggaaaagttgttgacccaacgcaactgattacaacgatttcccaaggaaagaaatcagcatcagcacaagctaaaatttccaaaaatggcgatttcacctgcaccttacctaaacaaaaagcaagccttaaaccatattcattaacgattttatacaacgaaaccactttgttgactctgaaaaacgtgtatgttggcgacgtatttattgctgccggacagtcgaatatggaattgaattattcgcaatattatgagggttcaggcaactcctacaatttcggcggaggtctgataacgaccgacgatctgccgaagcagctttccgacaacaacgtacacttcgttgcgagcgccaattcctcgaaaggtacggattttccgttacgcgacgtgaatgagcaggctggcacctggcttgaggcgaccgccgataattcgcagcatttcagttatctggcgcagcagtttgccatgcagcttcgtgccgcgcatccgaacgtgccgatcggcattattcaaaccgcatggggtggcacgccgattcgacgtcacgtgcaaggcggtgatatttatgcgaaccatattgcgcctttggaagggttccacgtggcgggcgtgctgtggtatcagggatgcaatgattccacgaacgaggcgaccgcgctggcgtacgagtcgcagatgacgctgctgatcaaccaatatcgtgaagtgttcgatcaggatgatctgccgttcctgtatgtgcaattggcacgctggcccggctaccagtacacgcaaaacgtgcgattcgcgcagttgaacacgttgagcaatgccggattacgcaatgcttccaacgttgcaatgacggtgtcactggatacggacaagggcacttcaacgttgatacatccgcttggcaaagatattctcggcgcgcgcatggcagcgcaatatctggcgatgtcggaaggcaagaccattcccaacgggccgcttatcgcgcatgcgaagcatgcttccgatggcacgatcgtattgtcgttccagaacggcaccgcaaccggtttgcaggcggaaaagcccaattattcgaagactgcgagcgcgaccgtgcccgattatgatgcgaatccggacgcgactcctttgaatggtatttccaacgttgcaacgccgacttccacgccattgcaaggttttgaaattgccgacgattccggaaagtgggtttcggcaacggcaacgattaagggtgatcagattgtgctgagtgccgccgatggaagctcgaattgcaacgcggtaactcaagtgcgttactggtggagtgggaatccggttatttccagtctgctgtataacgatctcggattgcctgcaagtccgtttattgctgttgttgagtaatacggcagattgataatcgggcattatccggctgcgacgactaatcgataaagcggactgtaattaggttagaatcaggcctgtttcatcgaacttaagtcgaaagcaatgtcgacggtcaaaatcgacgatcaatcgacgtagtgcggggcgctggacgctatgcggggcgttatggagccgctattgccgttgccgtcggtactaccgtctgcatcgaaatcttgcgatttacgaagcgagccggcagccagcgaacgtatggatcgaacggaacggccaatctgtgcctgtttttcctgagcatccgactgtattgcgggaatcgtgcccgtcacagggcgaatgcggccggtcgcagtgggaatgaagcttggcggcaacacctgcgtggtaacggcacccggcgatgacacatggtagtgggccatcgaagccagggaatcgcgggtatcgagttcacgctgcatatctagctcatcgtcgaactcagccatcgctgccctccctctcttcaagcaatctctgccggtaatctctccactggcaacggtcatcgttccgagcgtaacgcaaggtagcataccgttacgaacgaaatcagcgatatgcgcaactcccccactgtttcgcaacttttccgttgcacgtgccgcagcgagccacgccagcgagctattgaaaacccgccgttttggcataaaaaaaggctttcggaatcatccgaaagccctactggcggagaatacgagattcgaactcgtgaggctgttacaccaacacgctttccaagcgtgcgccatagaccactaggcgaattctccaattatgcaacgtctcacagtgtctatccgcgaaacgcaacttgattaggatacaacagtttcttccaaaccccaaatcggcgtgtcgcaacgtcccagatcgcccactcactggaggaatcagcccgctgccaagactctcacagtccgaattcctccagtggctggaacaatcagtacgcccataggccttctacagtccgaaaacctccacccactggaggaaaacacccgcgcaccggcctccaaacgtcctgaaacctccatccactggaggaattgatacgttggtatgcttcccagcatccggattctcccacccactggaggaatctgcccgcatatacacccccgaattgtccagattcttccagcgagtggagggatccggacacgagctcacgtaccgtgagcacagcagctatcgtttggacgcgaaggcacgcaggttggcgagcatggcagtgaacatcggacggaccggaccgaacttatcaagcagcgatcccgaaaccggagcactagccgctcccagcaacgcgccaggcagcaacaccacgcctgcagcaagcacagacgcgccgaatcccagttgcgaagcgttcggaatcatatagccgtaaccgatcgtcacaaactgcagcagcacatacgcaagcaaatgccaacggaatttcacgctccgcaacacggtcagacgaaccagcgagaacgcacgatgcgacacccaagcgaacactagcaaagcggccatggcaatcagcagcagaaccactgcaatcacacattgcgtagtcgcggaagtatccccattactcactgcggtaacggcggatccgccacggtcgagcgcaaacacgaaacagacgaatccgactgctaggcaaagcacatgcagcggattgatatacgcctcttcggtaggagtgacctgatgaatcgttttaaggccgcacaccagcgaaacaaacaggaacggcagcagaatcacgaaaatccaacaccacggcatgaacgtgccgacaagaccgcccacagtcggtccgagtgccggcgccacggccaccaccatgcctccaacgcccatcagcatgccgattttgcttttcggagactgttcaagaatgatattgaacatcaacggaagcgcgattcccgtgcccgctccctgtagtattcgcgcggtcatcagcataggaaagttcaacgtgcaagctgccatcaggcagccggtgatgcagagcacgattgcggtaaggaagatggtacgcaacttcagtttgcgcttgaaatagcttgagagcggcgtgacaagcgctaccgtaagcagatagccggtctcagccattgaacagtggacgtgtcgacgtggaattccgccattaatccagggaaaagcacgttggtgagggtttccgtaaggatgccaatgaaggccatgattccagttgacagaatggcaagaataagattgatggagatgttctcgtcatcttgcgttgccgtgttattgtttcgcgcaatggactgtgacatggatttgcggccgttcccggccttccctttcttggcccggctttactgagccaccattccgttatgccgggcagtttgccggaatggcgattatttgcccagaaatacaaaaagatccttgggagcggagcgctctaccaaggatcttcatattattaagttgaatgcggcggcgtgctactctcccacaccctctcgagtgcagtaccatcgccgcgaccaggccttagcttccgggttcggaaagggaccgggcgtctcacctgggccatgaccaccgcaaaaccaatacaacggccaaccccgacgggccggccggcagaaccggaaccacgccacgattccgatcgtggcggtccgggaaccggacaacggacgcgagcaaccaaacgcttcaccggtatcgtttccgtgaccacaagaaacaatgctccttgccatccaacgaaagaaaccaccacaggacgagacccgacccaacaagcgggtcggaaaaagtgtgccgcgttcgcccgttagtaccggtcggctccacccctcgcggggcttccacctccggcctatcgaacacgtgttcaacatgcgggcttcggacgctccggggagcgtcaaggaatcctaatcttggagcaggcttcccgcttagatgctttcagcggttatccctcccgaacgtagccaaccggccatgccgctggcgcgacaaccggcataccagaggtccgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgcccgaaccgtcgttctcgcagtcaagcccgcttgtgcgattacactcgaaacccgattgccaaccgggctgagcggacctttgagcgcctccgttactctttgggaggcaaccgccccagttaaactacccgccaggcactgtccctgaacaggatgactgttcgaggttagacgtcaaacgagaacagagcggtatttcaccttgcggctccacacgggctggcgcccatgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcaccccaaaaggggctgacggatcctcttaaccttccggcaccgggcaggcgtcagtgcatatacagcggcttgcgccttcgcatgcacctgtgtttttggtaaacagtcgctaccccctggtctgtgccaccccccaacgctccgagggcaagcctcttcacgcccgggggtctcccttataccgaaggcacgggagtgatttgccgagttccttgaccaggattcgctcgatcgccttggtattctctacctgaccaccagtgtcggtttggggtacgggcggcgacgcccctcgcgccgaggcttttctcgacggcctggaccaccggatatcgcgtccaaaggacgcccatcatcacacctcaccctatgcgtcccacggatttgcctatgggacgggctgcgtgcttgaccacggaaaaccacctccgcggccggctcccattccgtgtcacccctgtgcgctagcctaccaggactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccacaaggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctcccgcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaacccaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccaccaggggcatccggaaaaccgcacgcacccaaaacggatgcgggtggcggtccgggaacccaaaagcatatccgcaccactccccgccggccccaagggcccgcgaagccaacgatctcttccacaccagcacgcccacacgaacccgggaaccatccccggcgcatgggccacacgacggacgccagaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaaactttgcagaaagccaacatgtgactctcaaaaacaagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccgctcacccgcctcgaggcaccccaaccggggaaccactcgccgagcggcagcaagagataaacctacagcacaatcccattccacgcaaatcgggcatgacgaaacaagacgcggacccttgcaaacactggaaagcatcggcgtgtcgaaaacacgggaaaaacggactgcggacgccatcgcgtggcgaaagaccgtcggaaaaaccctgaaacacctcaccgcaaaccaacatccgggcgtgtcgcaaccacactatccgtttacggcccatcccccaagccaacccatccgagaaaacctcccagctgaaagctgaaataggagaaacagaagaaagcagataaacgaaaccgcaccgccgatcgttgtcctgaacacattcagatcccaactgatcgaaagtgcggttttgcatatgcgcgtgcaagcgacggcagaacaaggcagcgcagccaaaaatcgattaatcggtgcaaccgaaacggtagagggcccaaccctggccgtattgcgaataatcggcaaccttcaccaacgtgccgccatccacatacgtatcaatcaattcctcattgtggaaggaatcgtactgggcgcgatacgggaatgactgcagactctgcgcctggtcgcccatcgtaaggaagtattccggagcgtcggtcagcggacataccgtgccgagcacctgctgcgcatcgccggaagcaaacgcggtctccactttgccgaacggagcggatggcacatcggtgcgcgcattgatgatcggatacaacatgttcgcgttgaacagcgtctccgcatacatcgaaccgttcaacggatcggaaatgatggtggcctgggtgcccgtacgtttcgtgaccttgcgcagcacagcgatcttttgctcggtgagctgctcgttggggtcgctttggttcagactggaatgcgcgatgatcgtgtcgcgagccgcggaacgcgatgggcatacgatctgcgcggaaaccgcaagtatcgcaatcacaaggaatacggcgattaggacgatccaattggaagcgaaagaagcgttcttcacggaagaaacagcagacgcagaagaaagggaaggaacggaagaagcactattcttcgtggaaaaggacgatgcagaaggagcgaaagaagcggatgcggcgcacgcggaaacgcattcggcaagagcgttgattccaatgacaagcagcggcagcgtgaccagcggaagcatggtcataatacggttttcatcgcgataccacggagcgctgatgatattcggcaacgcgccgaccagcgtgaccgtgcacacatacaccagcgtgaccagcaggaatgcggccgtcaacgcaatcacgtcacgcaggcgatcgttgcgacgaagtcgagatgattcggacgacgcggacgcggcatcagtggcgttggagtgcgacgcaggtggcggacaggaaacggaaaccggggaatcagcggcggaaaccgcaatatcagaagtcgaagcatcaacatcgacatcagcagaagccacgggaaccacagtggaagcagccgacgaaaacgaatccgaagcacgcgcagccgcgcggcgggaagcgcaaacgaaagcggccgcagttcccgcaatcagcaacagtgcgaacagaatcgcaggaaaaccgtcaagcccatccgtgagacagaacgaaatcgactcccacaaattcttggacggctgatggctatggaaccaggaatcgggattcgcccaacggtccgatttgaacgacgtcagcatcaacgccacaaacgccaccgcaccgacgcacatggcaatgaacgcgccaagaatcagcttccacggcaagcgcagcacaatgaacggcaccagaatcagagcatacgtgaatgcgatacgcgggtgcgcaacgaggcaaaccacgcctgcgacagcagcgatcgcaagccattttgctatatgctcgcgcgcggcgatcgcatcgaacaagcgcaatgtggcggcgatgaggaacggcagcagcgacgtggcgaaaccgaatgcgatcagcggaccggcattcagcagtccgtacgggtggcacaccgagctgacggcaagcacgggcacgaacagtccaatcagattctgcagaacgaaagtagcgtcgaaagtgacgttatattgccgattcacagctgacgatacctgctgatttgaaacattcgacgattcagatacggacgacgattcaggcgtagacgatgcttgagaaatacgtgaaattggattggaaattggattaccgcgattccaacgttgcaggaaatacctgcataataccagcattccggcagggaaaatcacgcccgaagcaatgatccacgtgatattgaatgccgcgtagatcgaacattgcacgccgaacagcgccgcgatcttaatcacaaggtaagcacagacgtgaaacaacggcggataaaacgaatcatgcggccacaaatgcagagccgcccccaatccctcgtcaagcagacggtgaatgaaatagtaatgcgcgggggcatcgctgctgacgatcggcgtattccacaccgtggaggggaaccacgcaatcaccaggcatagtgcggacgcgacgccgataatcgacgtaagccacggcaataacgcgtgacgcgatgcaggacgcagcatcgcgtggcaccgctgcaggccatgtttctgcccggacggaccgcccttggctgaatcattcctggctggaccattcgtagccgaaccatccttggccgagccattctgccgagcctgagtctgcacataagcctgcacatgagttcgcgcacgagcctgagccgagccacaatcgcccgacacggaaccggtattcgtaatctgttcggaagtcatcgattccatcgtagcgagtgccgcaaccatgctcaacgcttattctctggaatcacttttcaggaatcattcagacttcatgcaggggtataacagtgttgcgcaagaaaacaatcacgttggaagcccaagatgattgcacgggacgcatcatgcgctacgggcctgccttgctgcggagcgcgcgtcccggccaacgctgacgtcggcatgcgccggcgcgctataacagagaactggagaagtaccgcatgttcgttctcaagaacgcatgggcggcgcttggtcgcgtcaaatggcgcaccgcgctgatcgccctactcgcactactggtgtctttctcggctgccgtggacttggcagtgattcgagccgacgacaccgccaataatgaaacataccagtcgcaaaaagccacggcggtgattcgtccgaacgcgcaaacacaagccaagcgcgacggtgccgattccagctataccgacaagtatttgacgtgggaaaagtacagcacgtatgcaacggccgcacagagcaacaacgtgaccttcaattacacgttggcaacatcggtgccggtgcgcgaaagcaagtcgttgcaggcgatcgccgcgaaaaacgacaccagcgaagacaagaccggcggcaacctgactctgcaggcgttctacacgttggacgccgcgaaaatcaacgactacggctactacaaggtagtcaaaggcaagcatctgagctataagacgcagagcgacggcgtactcatttcgcaggcgctggccgataagaacaatctcaaggtcggcgacaaagtgacggtcggcaatccgtcgaaggcttccgacacatacacgttcaccgtgcgcggcatttacgaatacgacagcgacgtgccggaaggcaacggatccgacgcgaaatacgcaaaggacaatcgtgagaacgtgatctacacgacgtatatcaacttcgccaagaacgggcttgacacgacggaggccacgggatgggccattccgaatctgaatatcatcttctcgctggcgaatccttccacctacaacacgttcgtgcgcttggtgaagaaggccaagttggacacgaagacgtacgagatcacctcgccgtcgcttaccgcttacaagaagtcgatcgagccgcttgattccgccgcttcggcagcgcgcatcatgctgattgccgtgacgattgtcggtggcatcgctttgctggcattgattgcatgtgctgcgattggcggccgccgcgatgagatcggcatggcgatgatcacaggtgtgaccaagggccgtttgggatggcagttcatgctggaaacgttcatgatgacggttccgggttggattgtcggtttggttgcgggcgcgctgttggcgaagccgatcggcaccgcatgggccggcgggcaggctgtgtcgatgacgtccgcttcggtgtggaacgtgatctggtacggcttgggcgcatgcctggtgcttggcatcgtggcattcgcgcgcgtggcctgcttcaacctgaaccaactgtttgaggaacgctcggaggtgaaggcatgagcgacaacatgaatgataagaacgagaacctcgacgagaccgtggtcgacgagaccgtggtcgacgagactgccgagaccgcatcaaacgagaccgtcgatgatgttgcgactgacgatattgcagctgacgcatcttccgctgattccattgaatccatcgattttgcggtggtatacgacgatgacaatgcagatatcgaaattgccgcaactgacggcgcggaaatttccgacgatgtaaacgatggcgatactgcagtagctgccgacggcgatgctgtggtatctgcagataatgcagataccactgaagttgcagatgacgctgcaactgctgctgatactgcggatggttcggatgtggtcgccaacaatgcgaatcaggtgagggaaacgcttgccttgcgttcttccgacgaaccgaccgtgctggaatcacatgaaatggtgaaagccgattccgcaaccagcgtctcctcacagctcgaccgcgaaatcaagcatcatcgcaagaaggatgcgtttttcttcaaagcgaatccgacgttcgcactcgatcatgtgaccgtgatcaatcgcaagaccggccgcaatattctcgacgacctatcgctgtcgttccatgcgggcgccacgcatgcggtgctcgtggacgcggaggatcgcgaacagcatcaggcgttgctggccaccatggtcggcatggtacgcacggaccgcggcaacgtgatgcacaaaagcaccaacctgagcgacgtcgaaccggtcgaaatgttgggacaccgcatcggattcattccgcaacgtttcgctttccgccccgacctcgacgcggaaagcaatgtactgtacgccatggatgcgtcgaaccgcaacttcctcaagccgaagcctgtgatcgcccgcgaactgctcaagcgcgtgggcttcgacgaagtgacgtccggcctggcagtcggcgaagtaagcgaactgaaccagcgccgcgtggccatcgctcgtgcgctgagctgcgaggctgaagtgatcatcgccgacgagccgaccgctggattggatgccgacgatgcggccgtggtgttggatctgttgaagaagttcaagcgcgatgccgaccgcaagcgcgccatcatcgtggtgaccaccaatccggagatcgccgatgcgatggagcacagcgtggaactcgactagccgcctagtgcaacgggcgcacgaacatagactctttcgtgcgcccataggtaagccctttggaattctggttttagccaaattccaaagggcttgcgtgttctgaaaacggtctgccctactcgacgatacgcatgtggtactgctcggcgagcggcgtgacgtcaagcacgccgtatcgttcgagcagccgcagccattcgcgcctgttactttcgccgaaacgggccgccttgcgcgcataggcttcggccgtcaggaacttcggcggaatcgacttgctgttgtacttgtcggccaccatcaccacttcctgctcaagattcatgggcacatagtcggccggaggcaatggcaatccttgcgattccaccgcttctttggtgagtcccacaccggtgtggttgcgcgcgaactgcgcgatagactcgtcaacaccctcattcaacaaatattcgtagcctttaagcccatgccgcacgtaattcggaccgtcgaatttcagcggtccaccgtcggaaccgtcttgcttgagcagaaaatacgtgccgatatcatgcagcagaccaccgatcaccaccagatgctcgtcgatcagcctcggcggaacggtcccgcccgtaagcccgtccgatgatggaatggaggggatgcgaagcataccgaacgattcgcttccattgccgtcttgcgtaagcctaaggccgaaatcgcccgctttttcaggggcatcgtccggtagtgtgcagcggcgggtgaacagtgcattctgcctgcgtgccatgcgacgtgcgatgtcggcgacgactacgcaatgtccgtgaatcaaatcgtatgcggcttgcgattgcgcgatttttcgatgcagttcgtcaacttgggcgagtgtaggaatatatccggttgtcataccgcctatcttaggcgctgtatgacgattgccgcatgctgaatccggtcgaaaaaaactggaaatccccgatgaaagtttcagccgaaaaattccgaaatacggatttcagattacggatttcagatggaacgcacacggaatgcgccggtacggttggaagcaacgatcatctgattgttttccaaacgagtccagccatcttcggcacactgatcgaaaccggagctggccacaaccacgcccttcggctggcctgcagcctgatccgcttcggattcaccgagcgtacgatagcgcatcacacgatagtcatgcgcctggtcgccacggccgtactggtcatagatttccacaatgcgcttggacgtgacctcacgaccggccgcgcacagagcgatgaattggtcttggctctggatcatgcagttgtagctggacttcggatagcttttgcgcagttcacgcaccgcctgcgcgaccgcctcgtcgagtgcgaaaccaaaaccgatgtactgcaggatcactgcgaagaaaatggcggaatcggaacgtccgccagtggactgcacgatgttgggatcgaccgggaacgcgcggttggtgatgatgttgcgaccctgatcgtcggaaatatcgccattgtggatgaagctcaatccgttggcgtagaacggctgctggttttcgagaatcagcggcaggttcgagctggccaaacgcaggtgccacaggcctccacgagccggagtgttcgcaagctcgtcgaaaatcggatcatgtcgggctgcgatcgtgttcttgtagacggcggtgccggtttccggggtgggagcgccaccgtcacgcaggtacggcgactcgctcggcacggtgaccagcgcggagccccagccatcgttgtggatttcgctcagattccggaaatcgcgtacggcctgcatgccgagcacgccattgagactggtgttgcttccggctgccgcgaatccaagtaatctgcacatggttgattactctacagggcttgtaatgcaacgcgcgcatatggctatcgacattgcttatagcgtgcgaaaaacagcgtgattccaacgattcttcgagataagaccatgcaaaaacctacaaaatgccctacgaaaacgggctgcgcgacgatggcagatacgatcgccatcatcacgcagcccgtttcacggcttgtttcacacacgctttagccgcggaggacgctgagtcgcgaggaacagcggctgtatctcaatcagcggattgtaaggcgcaaggccgaaccatttgaccggagatcccgcaaaatgacgaatcgcatacttgacttccaaagaaatcgcgccacgctgcgacaccttcgactcaggcataagcgccttgtgtatcagcacatatcgaatcggaccgatattcggatcagcatcaagcttcggatagcggctttcctgcctcggcagatcccccgacttcgacaaatcgttcatgatctgatgaatgtaagctggaatcgactgagaaaccttgaaaccaagccgaatgcgaacacggaacatataatccgtaccgaaattctcaaccgaatactcgcgggtgaacggctcatcggcagtctcgacggaaacagcccaccaagcgcgggcacgttttggatggtcggcgaaaatcgagaagaagatatcggtatcgatacgcttcgtttccggatccgacgtgagatagacgatattgtcggcaaaatacggaatcgtatcgtcatcatgcaaccgcttcagcaccggtaggcattcggcgggctgcatatggcgacgctgcgcacgttccagcttcgtgccttcgttccacgtgtacataaccagcagaatcgcgaaggtaagcagcatcgtgaaccaaccaccatgcaggaacttcgccatggaagcgaagaagaacatgaattggatcgcaaggaacagcacggtgaatacgaccgctccgatacgacgccccgaatgccagatgtagacggcaagcagaatggtggtagtgatcatggtgatggtcaacgccagaccatacgccgcggaaatatgctcggaatcacggaatagcgccaaaaccaacagcgtggaaacgcaaagcaccgcattgaccacaggaatgtacagctgaccgcgggtacgggccgggtaacggacctgaagatgcggcatccagttcagatgggtggcttcagacaccatcgtgaacgcgccggtgatcaacgcctgcgatgcgataacgcccgcgaccacggaaagcacgacggccacgtaacgcacgctgggcgtcatcatttcgaagaacgggttcaaaccgtgcgtgcggatgtaagccgaatcatcccaatgattgagcatccatgcgccttgcccgaaataacagagcacaagcgcgattttgatgaacggccacgtgaaatagatgttgccacggccaacatgacccatgtcggaataaagcgcttcggcaccggtggttgacaggaacaccgtacccatgatggcaagcccggcggcattatggctgctgaacaggaatctgacaccgtacacggggttgagcgccgcgaacacgctccaatactgactgaggttcgccaagccgacaaccgccaggaacgagaaccagacaagcacgaccgaaccgaacgccttgccgatacgctcggtgccacgcgactgcacagagaacagcatcagaatgatggccgcggtgatcatcagggtcagctgcttgttttcagtaaaaagtttttcaaaagctggtagcgtctccaagccttccactgccgagctgatggacacagccggagtgagtacggaatcggcgaggaacgcggcgccgccgagcatggcaggaatcgcaagccatgcaccgtactttcgaaccaacgagtacagcgcgaaaatgccgccttcgcccttgttgtcgatacgcatggcaatcagcacgtatttgacggtggtgataagcgtgattgaccagaacaccaacgaaagcacgccgagcacggcttcgcggtcggcatgcgcaagtccgccctgcccgttgaggaacgtctgcatggtgtacagcggcgaggtgccgatatcgccatataccacgcccaacgccacgatcgccatggcgggcgtgattctgtttggaccggattgcagacggctccaccaacgaccgacgggacccttgctggccacctggtcaagtttggcggcctcctgctgtttctcctcgtgctgcttgatcagcacctgtcgctcttccttagtcagcaccttgtgcgaaaccttcggcgcctgcgtgtatgtggctgcgtgaaacagcggctcatcctcgtttggctcgttagccataacgctacctccaagtggcgggccttccaacccactccccaaaataaacgcaaaaaggcacgttaggagccttacgaagtcttgtcaaatcttcacattgtttcttgcgattcttgatctcgcacgaagtaaacttcctgtgggtttttttcttattttacctcttgtctttctcttactctctcttattttcggataaatcgtttccgtcctgtcgattttcggaatttgttcagattccgtacacttcgcgcgtggtctttcgcgttgcctgcgcgacttccgtcagcggtttatcgagataattcgccaacgactgcagggtgtaggggatcatgtatggcgcgttggtgcggccccgatacggcatcggacttaggtagggggcatctgtttcgaccatgacatggctcaatccgacaatgcgcgccgactcgcgaataccatcgttgcccttatagctggatgtgcccgaaaggctgagataccaaccgttttcacgtgcgatctcacccatttcggcatcaccggaatagctgtggaacacggtccgttcgggagcgccgtccgccagcagcgtttcgatgacttccttatgtgaatcgcgatcatggatctgcatgggcaggttcagttctttcgcgagcgcgatgtgcgcgcggaaggcttctcgctgcagttctttggcggcttctccggtgcggaagaggtccatgcccgtctcgccgatggccacaacctggttggggtaggcggtggcgaggcggtgcacttcggccatggcgtcttcgaagctggtgtcgtgccatggctggtatttgagcggcaacccgtctgggcccggcaccccgcggtgaccgtggagcacggattcgttggggtgtatggcgatggccgcatgcacggtttgggggtgttcgcgtgccatgtcgatggccgtcatgaggttcggcagttcgcatccgcagtcgatgacgccttcgactccgacttgttgcgcttggttcagcagttcgtcgacgctgtatacggggacttccggctgtcctttttcttgcgcttcgtggctcatggcccgcgagaacggcacgacggacgccacatgcgtgtggttgtcgatgacgtgcgcgttctcgggaagtggttgcggtgctggcgcccagctgcggtcacgatggtgtttgctcatgcctccagcctacgctcgatggcagtcttgcttcggaagccgcgttattcatcgatggcagtgggattaaccaacgcacctccatatgttttgcggcgtagcgctgaaacgctttccgcgattagtcatggagggtgagggtggtgaaggaccaggagggggcggtgtaggcgccgctggttaggtcgattgcggtttcaaccggaacggttggcgaagccttgccgatttcaccggcgtacgggtcggttccggcgagcacggtggcggttgccgaagcgcgggattccgcggaaacaccaagctcttcaagcacttggttcagatcaatctcggcttcagcgtcgagcgcgttgacgatacgcacgtaggtgacgccttcagcatcattgcgagccacggtgacggtacggcggggctcttccggcttctcaacaccctgcgcaacaagctctccatcgatatacagcttcatgctttcgccgcgatcggccacttcgatgcgcacctgccacacggttccggggaacacttcgtccatggaccattcggtgccgtcaagattgtaggcggtaccgtcgcgcaccaccttgatttcgaaagcacgaccgaaggaggtgatgttgtggttcttgccgttgatgtcgccgtggaccagctgcaagccccaacgaccctgatagtaggtgatggtggcgttgatggtgtaggcgtcagagtcaatgttgaggctcgtgttcatcggaccattgcctgcgtaatggcagtcctcaagatcgacatggcggccatcagcggtgtcaacgctgaagttggtgatgtcggcgtgagcggcaccttccaagcgcaggccaacggttggtggcagttcgcgacgcagcgtggtcttgccttccaccgcgaccggccatgcggtatcggacgtggtggtggcatacatctgctgcacccagtagctgtacggcaggtaggtacgttcgttgtcgaagtagatcagatcaggattccagctgtgatgcccgttcttggcaaacagcggcgcatacgaagacatgaccacggcatcgccgttcaattccatgcgacccatgaacgccgcttcggaaagaccgttgatcagctgcgtgttccacgaaccatactcgcccaagtacaccttcgggccctcacgatccgtggtgtcgtagtggtcgagattgtggaaccaccagctggaggactgataggaatgctcgtcaacgatgggaacgccggcttcacgcgcatactgccaaccagcctcgtagtcgggaccgctcggagccggaccgaccgtgccaaccacaacaatatccgggtaggtggccttgaccgcgtcgaagatctgctggaagcggttcctgaacacgtcatcgatgagatcttcgttgccgatgcccaaatattcaaggttgaacggttccggatgacccatggcggcacgcttggcaccccattcggtggtcgcggcatcgccattgcagaattcgaccaaatgcagcacttcatcgatgtatgccggcatgtctttctgcgcgatcggcaccgggccctgactggtgttctggcagctcacggcggcgggcagcaccggcagcggcttcgcgccaatggtttcacacaggcacaagtattcgtagtagccgatacggaacgactggtggtagccccacaggttgaaattgtgcggccgatgctcaacatcaccgatggtgcgatcccagtggtacatgttatccatgccaagaccgtgggtgatgcagccgcccgggaagcgcatgaagcgcggctgcaggtcggcgagcgccttgaccaaatcgggacggaaatgcttgagcccgttgtaggtggtgcgtggttcgagggtaacgaaatcaagatcgacggtaccttccgtggtgaaggtgagtcgcaaagcgccttcatgtacaacgatggcattgctttcaccggaaaccgtcagcgaaacctcttgcttacgccaatcgttggaatcgacggtgatatcttgttctgcaatcgcatttccatcgtcgtcaatcagagcgacggtgacgggaagtgcggaagcttcgcaattgctggaaatacgcatccatgcggagaaatcgtaggtttcgccggcacggaagaccatgccgtcccagccgatattttcaagcgaagccggcgcctgttcgacttcgacggacgcatagtgcgggttttcttcggctaccggattgtcggtgagcacgtcgaaggctgcgaaggagccggcgggcacgattttgcgccagaagctgtagttgctccagtcggaggagtcggcgcgattgtattcgaatgcgccgttctgtacgaggtcggcgttgagtccgccgtcgccggagtagctgatgtcttcgtagaagatgccccacaggtcggtgctgatgttgcgcacgcccgccttgttgagggttgcgatgagtttgtcggtcatggtgtgtccttggatggtgttggttgtttgttgggttggatggtgttgcggtacgtgcgattggttgcgattcgacgtctgtctggcaccgtttcgccatcggtcgaccgccggccgcgctcggggaagcgccgctcatcgggaatctggcgaccgtacgcatcgatgcacagcggggtgccgtcggagtagccgtgcgcatgggcgttgggatcgaaccaacccgcatcgatgactagggtgtctcagccggcgtccttgaggtggtcggccatgaagcgcgcgttggccaggacctcccgatcggtgacggtggtgccgtaggaatcccagctgttccagcccattggcggtcgccatgcttttggcagatcctcggtagtcgccattgccttctccttgtacaacgttagaaaagcgtgccgtttacagtatctgacgtcatccttgacttacttgttcgacttcatcatcttggaaaacttcagatatgtaccgttacatattttatagcatatttcagaaatcacaatcatgataggatatcggtgattctttgaaatttcaacgattaccagaaaatcatcatatataatatcgttacagaaaaacttggctgtaaggagcggtgcatggcaaacggcaaaccgacattgcgcgacgtggcggcggaagccggcgtctcccccatgaccgcatcgaatgcgctgcacggcaaagccggcgtcaaggaatcgacgcgggccaaagtgctggcagcagcgaaaaaactcgactatcgcatcaatctgacagccagcatgctcaaatcaggtcgcagcaacattattcacatcatcgtcaacgaattcgattcgccgttctattcgaagctgacgcaaacattgagccgcgagatcacctcacgcggactcacgccgttcatcgagcaaacccagtattcgccggacgtggccgaacatgcgctgaccagcaatccgttctcagggcagctcttcgacggtgagattctgcacgccaccggattgggcacgaatctaccgctcgccaaactcaacggcgggcgccctctcgtactgctcgacgcatgcgaggaaacgccaaccgtggatgccgtgaattttcccaacgaggagggcgaacgcgctgcgatgcagtatctgatcgcccaaggatgccggaatattgcgattgtcgggcatacgttcgtgccgcgcgccgagttggcgcatgcgcagaacgcatttgcattgcgacttcgaggagcgtgcgcggcgttgctggacgcaggattgccatatgacgaaaccatggtgttcgaaggcggtcgctccgacgaaggcattaccgccgggcacgcgatcgccgaacggatcatggcggcgcgaaggacgggctgcggagccggcgcgggtgctggagaccgcgaaacaggcacggccggaaccgccgatttcaacgatgcaagcggcaagattacgggcagatcgatcgaaacgaccgacaagattcccgcaatcgcgttcgacggagtgtgctgcgccaatgatttcgccgcattcggcgtgattcgcggcctcgccgactatggcatccatgtgccgcaagacgtgaaggtgatcggattcgacggcgtgacttccggaacctacgccaccccttcgctgagcaccatccaagtggatctcgaccagcttgccaaattcgcggtcgatatgattgtcgaacggatcgaacgcggcgaagtgaatgataattccagcaatgccggaaattccaatgatgcaggcacggtgctgccgccgagccgcgcaaccatcggatatcagttggtcgaacgtgaatccacgaccgcgatcatatagctatcgtgcgttccgcgcccgattgcagcggaacgcacgatagccggaaatacggcatttcagcgattggttggctcagccccgatcagtcgcggcggcgaatggcaaagatgcgggcggagggttgcttggaggtggcggcgttcaggcgaaccgtttccggatccatgcgttcgatagtccacggtttggcattgggcgcatggtccggttcggcaggattcgggaacacctgttcgatggtttgatccgcatccaacggcatgttcacggacggtgtgccgccgcgacgccacacgatgatgtagtcgggcttatcttccggctgaggttgctgatcgttctgctcggcagcctgctcattccaagcggattcgccgtacacatacgcgtcacccatatccgtttcgacatgacgcaagccgacggcaagccaatcgccgtcgaagtcgggaagtccggacggccagaacggcaccatatgctgctggtcggcaagtacacaacgatgtaaggcgatagcgtcgcgaacgagtgaaagacgcggctccgtcatgcgatcgatgaaaccagacagatacagcctgccgagcacacccgtagcaagcgtgaacacagcagtctcatcatccatctcttgctgagcgtaaccccaattaccctgctgttccggcagaatcgtcatacctgcaccagccgcaatcgcagcataaatcagaggatcgcactggtcggaagtggactgcaaatccaagcgggacaactgcgcgtaatcggcgcgcatggcaccggaaccgcagttttcgatcatcacatccggatgacggcgacgcagatcgtcaagccaatccacatatgcgcggcaatgctcgagcaggccatcgccaacggactcggcattcaaatcagtgccgacgccgggaatggtgttgtagtcgaacttgaagaacaccgcaccgaaatcgtcaatcaaacgatcaacagtacgcgtaacatgctctcgcgcttcgggagaacggaaatcaagcagataacgacccgaatcgcacacgcgaacaccatgacgctggaagaacgcggaatccggcaacatgctcgcaagcggcgatttcacgccgatcacttcaggttcgagccacagtcccaagcccatgccatgagcacgaatcgtgtcggcaagaccgcgcagaccggcgtcgccgaaacggttggtggaggcctgccattcgccgaccatgtcccaccagccgccgtcggtgctgtcgtaccagccggcgtcaatgcagaaaacatccgcgccaacgcttgccgcaccttcaatcagcggcagttccttctcaatacgagggtcaccgaacagcgtattcatgtaatcgttgtagatcacaagaccctgcgtatgctcgaactgatcgacgcgccccaactcacgagccttggcaatgcgcagcgcacgacgctgcaacgtcatttcggcaacagcccgctgccaatcgcctgcggcaatggcaaacgacacaggaacggactcgaaatcattgccttcaccaagattggtgaaccaaccatgatccttatattccggaccgaacgcagtgacgtgcagaccgggatcgtcctcgccgacttcccactcccacggaccgttatgctcgatctgccacattacggaaaaatcgcgggcgcggcgtaccgaaccttccacctgcagaatgccggccggctcatgctctcccgagctccatgtagaagtcgagctcatggcaaaacgcgaactagactgaccaggattgattttctggttgcggttacgcacctgagtgtcacgcagcggacgaacacgccaatcgttttccacagcccaagcggcatcgccccagaaaatattcgaacgatgcaccttgccgcagttgacgcgcatcggaacggtcagattcaacgatgacaccgcttcaatcggcagttgcctggcggactgcagacgcgtgtaggtgcgcactgcggaaagattcgggaacgcctcgaatacggaagtgaccaccaagcctgcattggaatcggcggaaaccgcctcggacgcggaattcgcggcggaatcggctgcgtcacgttcgcttgccgtcggctcgaattcacgacctttcggttcaagatcggcatacggcgcgaactgcgtgatctccaaacggaacggatcggcggaacctggttcaggttcggaagcaagcgcggaaacgaatcgcaattggctgccggcaactgtggcaatcagcgtcagtcggttgtcttgcgaaccggtattggcggcacacacctcaacaatcggacgcggatccttttcaaccactggctttccatcgtcagacaagcgaccatcgatcggaaccatgttgcgccctacaacgttgcagaggcgaacgggggaatcggcggcaatgtcaaacagcatggagaccacaccattgccccattcaaggcgcccatcctgccgaggaacaaggggagtcatattgccgttctccatttccatctccttcgaattccgaatgccgcctatccgttgacgtgcatcgtttgacgtaccctcactagcttaagcggaaaacggggcaaccgcgatgtgcgtgtctacgcacattcagcaaatattcagcaactggaatgaccgttcgaagaccagcaaatacctactcgaattgcagatattccacgaattgaatcggcatatccttggattccgtgatattgctgaatccgagaataaccccttctttcggcagtcccttcatggaagtccatgttttcgaatgggacaagtcgaatccgacagcgtcgttcacatcggaaaccggattgcctttggcgtcgaccagcgcatccttgacctgctcaagatcggcggcactcatcacttccgcgggtttggtgatgtcgccgcgatcattgacttcggcgaaaatatcggtttcggcaacaatcatgttgatctgacctgccgaaacgcgagccgtcaacgatgcggaaccatcttgcgcggcattctcgctaatcgcaatggaggcatccgtccgcacgagacgctcgtcttcaataccttgcgtcttcacaaaatcagcgcccaacgcatcaatctgttcggaatattccgccatatcgacaccttcaagactcagctcggcctcgggacctttggtcacatacgagatgacgaaagcaagtaccaagccgaccactgcgataatgatcagcacatcggtcagaaagttctgcttgaagtacggccacttgtctttcggcggcagctcgcggaaggttttgaatttcgattgcttcgcatacacgttggtggatgcgagcgctgcgaccgcatcttgctgctcctgggtgagaactggcttctctactgccataccaaaccttcccgcgttgtttcatcgacgcattcacgcgtcatcttcatgcgcagcaacatgcgttgctttctgacttccctatcttccgcctcgtacctgataatttgcggctagccgccggccgaaaaacgacaagcggctagcaggaaggctgatttcaagccaatcagtccaagccctaatcagcccatttagaccttgatcatggcgtattgggagtcgtagaggcgatagtaggcgccacgcttggcgagcagctcggcgtggttgccttgctccatgatctgcccatgatcgatgtagcagatcatgtccgcgttctctatggtggacagtcggtgcgcgatgatgaagctcgtgcgtcccttcagcaggtggttcaatccggcctgaagtgcctcttcggtacgcgtatcgatattcgacgtggcctcgtcgagaatcagaatgcgcggatcggccagcagcacgcgggcgaatgcaatcagctgacgttgaccagcggaaagcgtggaaccgcgctcctccaccaccgtgtcgtatccgttcggcaaatccataatgaactcgtgcgcatgcaccgccttcgcggccgcttcgatctcagcatcggtcgcatccaacttgccgtaacggatgttctcgcgcacattgccggagaaaatgaacgtatcctgcagcatgacgcccatctgccgacgcaacgattccaatgtgacagaacgcacatcatgaccatcaattgtgaccgaaccttctgcaacgtcgtaaaaacgcgacagcagattgataatcgtggttttgccggcaccggtcggaccaaccaacgcaacggtgctgcctggctcaacatgcagatcaaccagattgagaatattgcgaccgtcaggctcgtaacggaaaactacatcgttgaaatcgacgcgtccttcgatttgcggcagttcagtcgcgtcaggcgcgttacgaatctccggctgcacgtcaagcgtttcgaaaatacgctcaagatatgcggaacaagtgatcagctgattgtagaaattgccgatgctgatcaccggattccagaaattattcgcatagccaacgaacgcgatcagcacgccggtggaaacgttcaccgcgccgaagcccgtgacgcccacatagtagatgaatgcgatcgtcatgacggaaatggtttgaatgcccggccacatgaggaactggatatgcacggccttcatccacgaggtgcgcacgtcgtcttgctgctcttggaaggttttgaactgcgccgcctcctgggcgaaggtctgcgtggttttcacgccggtgatcgactcgtgaatgaacgcgttgagattgctctgcttgttcgacaacacctgatacgcgcggcgctggaaatgctgcaataccagcacccacgcgatcaggaacgggaagagcaccaggctgaacagcgcaagccgccaatcgaccacgaacatgaccaccagcgtgatcaggaaggtgaacacgtcggaaatcacattgatcaggccggaactcaacgtgtcggaaagcgtgttcacataattgaccacgcgaatcaggattttgccgtgcggacgcgaatcgaaatagctgaacggcagcgtctgaatatgcgtgaaaatatcgcggcgcatgtctttcaacatgagctgaccgacgcgagtaatttcgacggtacgataacgcaatccaaactcatacatcacaataagtacggccatcaaccccgttaattcaccaagtaaggtgagatttttcgaaggaatcgcgctgtcaatcatgattttcgtcaaatatggcacgactaccgcaatgcagctcatcatgacgacgacggcaagaatgcgtatgattcgtgacatatacggctttacatagacgccgatgcgcagaatatcatgcaggttgatctgttcttccagctcttcatcttcgcggtatgtgttacgttttgccatgggttttccccctttcctgctttcccgcgcctacgcttcgaaaccttgcgaacgacccgcctgcaagccgagctgcctgtagtagatctcccaatatcggccgtgcgcggccaccagttcgtcatgcgtgccgcgctccacaatgcggccatgctcaagcacgaggatcagatcggaatctttcaccgatgaaatacggtgtgcgatggtgacgatggttttctgttcgtccagttcgcgcagatggcgctggatttccgcttccgtttccatgtcgacggcgctggtcgtatcgtccatgatgaggatcgacggattgtcggcgagcgcgcgtgcgaggctcaggcgctgtttttggccgccggaaaggccgacgccacgctctccgaccacggtatcgtagccttccggcatgctgcggatgaagccgtccgcgccggcgatggtggccatgcggcgaatgtactgttcgtcgtattcgcgttgttcgcctgcgccgaagctgatgttgccgccgatggtgtcggagaacaggaacgtgtcttgcgccacgacgcacacttgcgagcgcagtgtggcgagcggccagtctcgcgcgtcgacgccgtcgatgagcacatggccttcggtggggtcgtagaagcgggagatgaggttgacgagggtggatttgcccgcgccggtttcgccgagaatgccgagtttggcgcctgccggaacatggaagtcgacgtcttcgagcacgagggtgtctggttcgtcggggaaggcgaagctgacatgctggaagtcgatgctgcctgcgatgcgggttgtgttggttgttgcagcggttgcagccgctgtgctggcgtgattcgcgtcggcgctgtctcccggtttttccgtattttccggcttttccgtaatacgtgactgagcggtgagcagtttgcggattttgatgcaggatgcgttgaatcgctgccagtcgttgatcagccatccggattggcgtaccggcccgtcgatcatccacaggtaggagttgaacgccacgagattgccgagggtcatgcgcccggtgatgaccaggaatccgccgaatccaagcgtgatcagctgcagtgagaagccgagaccgtcgagccatggcatgtatttgcggctgttgtaggcctggtccatgttgcgttgcatgtaatcgtcgttgtgtttgtcgaatttttcggtttcatacggttcgcgcacgaacgctttgaccacgcggttgccttcgatgttttcttcgaccattgagttcatttcggcaagcgagttgcggatggcgaagaacagtggtcttgcgtgcgtggagagtccgcgcgtaaggatgaaaatgaacggcgtgacgcatgcgagcgcgagcgcgagccgccagtcgatggtgaacatcatggcgagcgcgccaatgaacatgaccacgcagtcaagcacctggtagctcacccagctcagcgcgtggcgtatggcatcggtgtcggaggtcatgcggctcatgatgtcgccggtacgcgtgtggttgaaataggtgaagtcgagttcgtgcagtttctcgtattcgtcgctgacgagacggaatacggagttctgcccgaagcgttccatccacatttggtagccgtagcgcgaggcgacgcgcacgatggtgaacacgatcatcatgatgcacagtcgcgtcagttcgtcgacttggccttgcacgatgacacggtccacgatgaggcctgacaatagcggaatgatgagcgccatggtgttgttgacgcagaacagcactatcgcgccggccactcgtggcaggtcgggtttgcagtatggcaggatccatttaaggttgcctgcttctgtattacgattcggatcgacgtacatacgtagcgttccttcggattgtttgctggttgtctgggttttcgtgggttggttttgcgtttttgcgttgcttttacggccattcgttgccgttacgattcacgtccgtcgtttgtcgagcgtcccgttgccgtctctctcggtcgaaacccctgttcggattcgcaaacgcgacttattctatgcgaaccgttttttgatgcaacgtgagtgatttcggcgtgtcgcaatcgcaataaaatcaacgcatgtaccgttacataaattcgctctggacgtaaaggaatatgggtgatcgcagtagcgctttctatatcgaaccggtacgatatatcgaggtgcggcattccgatgacggaacggccgcaatcgcatgaacatcatgaaaggacggcgtcgatgacgagcacacagaccattgaggaactcagcgcacaatacgcggcaaaatatggcatcacccgtgagatgatcgaccatgcggaacgttggacggaaaccgacggcgatctcgaaggcctttccgaagagcgcgtccgcggcattctcgacatgcgtttcggcgcgatcgcggttgacaccccgcgttccgaactgtggcacacgcctgacacaatcgacgtgatcgaagatattccatacctgcctgacggtggctacgatacggaagccggacagtgcagagggcatttgctcgacctgtatctaccgcacgatgcggtgctgcgctgcgggcatacgctgccggtgtacatcgatatacacggcggcggtttcacttacggatataaggaattgaaccgcaacttcaacgtgcatctggccgaaacgggcttcgccgtattctcactgaactaccgaccggccccgcaaaccgatttgaggggtcagctggcggacgttcaggcggcattgcgttggatcaaggcgcatttgactgattatccggttaatccgaacgccgtgttcctcaccggcgattcggcaggcggcgcgttgaccatgctgacgttggcgattgaaaacaatgccgaagccgcggccgcattcggcgtggatgagccttcgggcattggtttcgccggtgccgctccggtgtgcggtgcctacagttccgcatcgttggaaaccatgggaagcgaactgaccgtaggctacgatccgaatcgccgcaccggactcgaacagatgctgggcgtcgaattcttcgacggcatcgaagccgccgacccgaagttcctcaccgccgaaggcctggcgttcaacgtcaacctgccgccactgttcatcgtgacctgcggcgacgatttcctcgaggccgacaatctggcgcttgctgccgcactggcccgcaagggagccgatttcgaactgttcgacccgaagccacgccgccacgaaacgctcggccacgtgttcgtgatcggcatgccatggcttgacgaaagcgtggaatgcttcgaacgcctgcgcaggttctcgtacgagcgctgctgaatcacgaatgcctgcacgcgaccacgcataatcaccagcatcacaaacggccgaccatgcattactcacgcatggtcggccgtttgtcttgcaactcttttcggcaaaatcgcgaaacataaatcgcgaatcgcacgaatcgcacgaatcgtgttcagaaaagaagaaagccggcggaaagaagggccgccggctgagagagaagagagaagaagggttcagttatggggttcttcaggaacctcgccagccgccgtaactgctgacatgttctatataagcgcccgagtcttggaggaatgatacgtgttcctgccaattagctgagaaaaatgtatcagacatgtgagcggccatacacattcgtgaattccgtcgaatgatcgcaacattacttccgatttgcccaatcgcacgtctatatcactcacccactccgcaaaaatcatccatttcactggacgattctgaaaaaacgcaaaatcatccatttcaccggacgatatgtcgagctcaagatgctgccgttgtctttctcggaataccgaaatgcattgcaaccgacagcaaatgacaatgcgctgttcgaccggtatctcacatatggaggtctcctctacgtcacacagctcaccttggataccatcgggctcggcgactaccaagacattcgacaccgcaacatcctcgactggctgctcgagtaggacacactctcccgactgcacaatttgcgtccacggatcacaaggtacgaaaaatagcgggaccaaatagttcctgcataacgtgcgccgtgttccacctatgatggatatatgaaacatttcgaatatgaaatttccggcatcgacggcagcgcagcgaaattcgtcggatattgccttgataacagcgaagaagtcgttcccgaccgtgtgcgtccgtctgtgcttgtgattccgggcggcggttacgaaatgacgtcggatcgtgaggcggagccgattgcgatgcagtttcttgcggccggtttcaacgcttttgtgctgcgatattcggtgaagccttccgtttttccagttgcgctgttggaagctgccggtgcgatgacgatgattcgtgagcatgccgccgagtggcatgtcgatccggatgcgattgccgtgattggcttttccgcaggtggtcatcttgctgcgaatctcgccacctccaccagcgacgatgttcttgtcgctcatggttacgatccggatgcggtgcgtccgaatggtttgatgctcgcctatccggtgatcacgtctggcccgctcgcccatcgcggcagtttcgattcgctgcttggtgaacgccgcaacgattcacaagcgcttgaatccgtgtcgatcgaacgtcatatcgacgccaaaacaccgccggttttcgcatggcataccgttcccgacgaaaccgtgccatacgaaaacacactgatgctgatcgacgcttgcaagaaagccggagtcagcatcgaagcgcacctattcccgcaaggcgggcatggactgtcgttgggcactgcggaaaccgcatggcagggcgtcaacggcattgaaccgagtatccagatctggccgcagctggctgtctcttggatgcgcagaacgttcgcacgataatcagcgcagcagacgccgtgacatctaaccccatctagtcacgtttcccgcctgcgcaacccgcaccctgcatctgcacaacccataaaatcgggttaaaaacccgggttgtgcagacgcagaacgcaagtcgcgcagacagcacaacacccccgaaccgaccggatagaccgaaaatcgtaagctcgggggcaaaaatcagcggggctgacggaagcgacgatcgccaatcggatcgaacggtgtatgcggctcgagctgataccagtacgcgacggaagcgacgtcgtcctgacgctcgaaattgccgccctcctcagtaccgatctgctgccattccacacgcaaatcatgttcgaaataaatcggatcgggaatgtgccagcgatacaatccgcgggtcaccggcgtatttacatcccaatacgcgctctcgcgatgcgaggcgagacgctgcgaatagaatgggaaaccgacgtacggcgcacagaacgtctgctcatgcatacgcccatgctcgtcgaaatcggcgaaactccacgcgccaccgaaataatcctcggcaccggtgctgcaccacgtgggatactggtcgtccccatcgatgtacatcttgacttcaccctcgccccaccagcggctttccaacgcggtgagcgccagatacgtgccgatatacgcgccacgaccatgcacgccgtcgagcaccacatagtcgcgggccagttcggtgacgcgctcgcgacgccactgcgcatggaaacgcatggtgccggccggaagcgcgtcatattcggtgtagtcgatctggtagaagaacgcgggaacgtcttcattgtgatcgttgcggagcacgatgcgcgcatgttcgaacggcatggagaagtagcagttgaaaccgcgattgggcacgaccaccaccggcatcgaattgactcggcaggcctgcgcgtggccgcagcagaagaagtcgccgaccgggcattgcacggacggggtctcctcgccatcccaatagaattccaggatcaggttgcgaagcacgttcggaccggtagacgacgtgcggtcggtgaccgtcatccaaatatggcggatcacgcccggaccgtccacatccatcaaagtgacgctctcccccgctttcacggtctggatgcacggactgcccttgcgcgacggaccaagtgcactggctgcagtggccgcagcgcccttgccgcccgtgggattctcggcgttcacgcaacgtgtgcgccctggtgccgcaaccgcaagcaagtccagcggactgcgcgcggcgaacgcacccaacgaatcaacctgcatatcgtgacgtgagctgttttgcatggtgctccaatcgttatctcgagtcataagaaaccccttttcccgctactttacggcaccagcggtaatgccctgcgacaacttgcgctggaaaataatgaagaaaataatagtcggcacaatgctcagcagcgaagccgaagcaagtgtggtcgcatccatcgtgcgttggccctgcaatgtggcgagcgccagcggaatggtctgcacgtcgtcgcccatcaggaatgccatcggaatcatgtattcgttccacgtccacacgaagaagaacacgaacagcacgctgatggtcggccaggaaatcggcagcaccaccttacgcagaatctgccagcgcgaggcgccgtcaatggctgccgcttcgagaatggcctgcgggaacgtaccgtatacggacgacagcagatacgtgccatacgcactttgaatgatggtgaagatgatgatgatcgccagtttggtgttgtacagtccgacctgcttgaacatggtgtacagcgggtagagcagcgcttcctgcggcatcatattggcaagcatgatggcgagcacaatccaagtgttgcctttgaccctgccgatgccgagcgcgaaggagttcagcacggaaagcacgacggcggccacagccactaccagcgaaataaccaagctgttccagaatttcagcgggaacttggtggtggtccagaaggagatgatgccgtccatggtgaaatgcttcggcagcgaaagcgggcctgttgcattgtaatcggcgggtgttttgaacgcgttgacggtgagcacgagcaacgggaaaagcacgagcagtgcggctgcgatgagcacgatgagggtgatccagtcgccggtcgagcgcacatgttgggttttcttggatgctttccgcgctgccgatgcggtcatggtttgcgtcatggttgtttcctcgactttcgaagtcttgcgagtcttacatgttacgggtcagttgcggtttgaaccgttcagaccagttccttttcgacgtgcttctgcaccatggtgaacacgatggagaacacgatgatgaccacggtgagcgctgtggagatggccgcgccgtagccgacttgttgcacttggaagaattgattgtaggaatagtatgatggcacggtggttgccgttcccggcccgcctttggtgagcagatagaccggtgcgaaggttttcagcgcgccgatggtggcggtgaggatgaccaccagcagctcgggaatgatggacggcagcgtgaccacacggaatttctgccaccagttggctccgtcaagaccggccgcctcgtaaagttcaggatccacgcgctgcagaccggacatgaagatcacgatcggatagcccaactggatccacaccagaatgaacatcagcaccggaagcgcgctatcagggctgccgagccagttatgctgcaacgatcccaggccgagcttgacgagcagcgcgttcaccgcgccatcttccggacggaagatccagcccatgatgatggccgcgacagcaaccggcagcaactgcggcaggtagaacatggctcgcaggaaggaagccgtcttgccgccgaatttcttctgaataacgtcagtcagcagtgacgaaataaatagtccaagaatcgtaggaataactacgatagccacaataatccagaatgaattagcgaatgaaatccagaacgtggaatcagcgaacagacgtttccaattctgcaatccaacgaatttaaccgggccgactccacgccatcgagtgaaactcaagtaaatgttccacacgaatggaataacgacgataacgagcagacctaccagtccgggaacaagatatggtacgaattttgcggaacggtttccgggaagccttgacattgagactcccccgtttttggtcttctttgacattttggcttttcctttggttgcgctgcgttgcctgtgaatatttacgattgcgatattggttcgcaagttgtaatttgcgataccgcacgggattattcatgattgatactgagcaaaaccggaataatcccgtgcgatgtcggatatgagatcagatatacgatcagttggtcttgacgcccatgtcttccacaccgacgtcgtacttctcgtggatacccttgagcacgtcggccggcttcttggtgccgttcaccagttcctggaattccgccggaacagcatcggtaaggttggaagcggcgtaatccgggtagtagctgagcttgccatcattggcgtaggaggcgtattcctcgatcatggccttgctcttctcgtcgttgatcttgctggcgtcgcccgccaccggaattccgccggcgttgccgaggtagttctgcacatcgtcggaaagcacgtagtcaatgaacttcgcagcgagatccttgtggtgagagcgttccggaatcaccagcagattgcctgcgcagccaatcgcgaaattcgattccggcatcaccgcggcgtcccaatcgaaagtggtgatctgcttgacgaaacgtccctgattccaggtgccggtctgatagatcggatactcccccttgatgaatgcctgcgtggtgtcttcggccttcataccggtggcgttgtgggagatgaagcccttgtcgagccagtcgttgatggtgctcacggaattggtgagaatcttggagttccagtcgacatcgcccttgtagagctgccagttgtcgatgaatttggcgtcggcctccttggaaaccagctgccaccacagccacatcacgccgtattcctgcgcgtcggcggcgatcggcgtcactccggcatccacgaatttctggcagacgtccacgaactcgtcataggtggtcggaatctccagcccgtacttggcgaacagatccttgttgtagtagacgcgctggaattccgcgtaactggtcatgccgtaccaggtgtcaccatccatgatgccgttttcatcatacttggccacggccgcattggcgccggtcaccttcttgtcccaaccgtattgatcgacgtaatcacccaaatcggtgagcagccccatggtggagagcacgccggccgaaccgttgccgcgattggattccataagatccggcgcctcatcggaattgaggaattggctgccgttctgcgcgatctgcgtgaacgacttgcgttcgaaattgattttgacacccgtttccttttcgaaggcttccgcggcgcgacgccatgcctgggtctggccagcgtcgtcttcctcgtaataccagaacgacaggctgtctggcgtttcctcgtcttgcgcggtgtcgctgccgcatgcagcgagcgtggtcagcgacattgccgccgcggccgcaagtgcgatgcctcgtgtgatcttcatggttctcctttgttattggtggttgtgttgttgagttatgtctcaagttgtttttcagttatgaagattgatatgtgtcgcctccttttttcgaaacgtttcgacgatggccgcggattggcgcttttcaattcggcaatcaccatcttcgcttcggctacaacgccttcacttactttcgaatcgtttcgattatggatacgggaatccgtccgcctttcacggacatactcctacaaccttcttttcacacgtcaccaactttggtaacggaacctcgactatgcatgaccggagcggacagctccaccaatcccttgatgtcgcgatgctcatcgatggcgtcgaccagcagatccacagccttagaacataattcctgcggcatgaccggcatctcggtaatcggctgcggcatcagctctccctcgaaatacgtgccgcacgacaataccgaaatatcatctggcacccgcaatcccgaagcctgtaattgctgcaataccaacttcagcacattggcgttcgcctggttgacaatcgccgtggggcgctcatccaaagaacgaagctcacgcacgaattccgcggcatcaaagcgatcgtcacgatgcttggaggattcatgaatcgtcatgcccaactcttcggcacgttccagcaaagccttgcggaacagcagcacatagcccgaaccgcgatcgtaatcggtctcattgtcacgcaaaaacatagcgctccgatgccccttggaatacaggcaatccacagccatacgaccagccgtggcaaaatcgatatcgacacaggcacagccttcatgctctgcagggtaaccgatggccacacagggtttggaatatgagccagcctgggcggtacgctcgtcatgttcctcaatgtcgagcagcaccacgccatcaaccaagttgctttgcgtcacgcgccgaatgtcggccaccgcgtcctcgccggtaagcaacagcacatcgtagccacggttctttgcctgccatgcggtctgcagaaagtaagcgttgtatttggcctgattgatatcaccgcgaatcggcgcgctgagcgcaaaaatatgattacgcataccacgcattttacgggcgctggcatccggagtatatccaagtcgttcaacggcggccatcaccttatcggtggttttggcggagatggaacgcttgccggaaagtacgtacgaaacggtgctgactgacacccccgcctcccgagccacatctttgatgcccgtcatcttccgcctccttcggctctccaagtcatttgcgttacacgtcatgcgtaccgcagctctcgtccatcgttcaacaaagccatccgccgagccttccggaatttcttccgcagaatcacgctcgtattttatcgaatcgtttcgtcgaaacgtttcactaatcgtaagccagcaactcagctttgtcaaacgtttcgacacacctacccgtcattcctcgaaatgatggacaccaggatgctgcgaccccgttccttcatatcatgattttgatgtaccgaccgttgcaatcttgagtcccgtcgcacgattgcgatttggtttcgaccttacgattttattttccgctttttcccaaatcgtgaggtcagcaagccaaaaacgtgcggccatcctccccaaacactaggacgtgcagacggaaacgcaagttgcataagaatggaggcatctacaaccgccgcccgtacacgtacacacgggctagagaagtctcaaggctacagcgggcgggactcgtagatcatttggcggtcgccgaagtagagggcgtcacgccaagaggccttcttgcgggccgcctcctgctgaggctccttgatcggcacgaagaaccaacggaccagaccaaccaccatgtcttgcacggaatgccagatgccgatatacgcggtcaacgcccagaacgtcacgatcgcattgaaaccggcgaacaccgcgttgccccaattgtgcgaaagcgtatcggcgtagaacaccatgcacgagtaaatgatgatcacccacggcatcgtcacatacaatgccggagaagcggtacgattattgactttcggcgtacgcgcgaacggaatcttcgtgttcgtcatgccctgctgaatcgacttgagcgtgccggaaagattcaccgtcaacagcacgatgttgaagccgtaaatacggaaaatatcggaacgtttatacccgttgcgtttcaaatcgctcgacatggtggcaaaatacggcagcgacgcgagcaccacccacgggctcagcaaccgctggtcgaacggatatgccaagaggaacatcaggccgaaactcgaccatgcgatggacgccatatagttcacgcgcagcgcccactcacccagcttcacatcattgccctgctgatgccgcgcgtgcacaatacggaagaatttgccgatgatcagcagaccgccattcgcccaacgccgccgctgcaccaccaacgaaccgaaatcaggcggggtggcactatagctcaaccgctccggatagttgaccaaatgccagccgaaataacccaaatcgatactggattcggtgtcttcgatcaccgtgcgatcctgaatatacgttttcaccgtgcgcgtgccctcagtcgacaccacgcagatatcgtcgagcgcggccttgcggatcaccgcgttcgcacctacccagaacgtggcgtcatagtaggtcatgccctgatgcagcatgtgctgaatgtcggtggtggcggccgcgatgcgttcgattcgcgtcggcgcgccacgatacgaggaatacggggtttggatcacggccacgcgctcattgccgggctgttccatctggtacaccaagcgcaggcagtagtcgcgcaacagcatggaatcggcgtccaacgtcagcacgtattcggaattgcgcatcacgaaatcgggagattctccctcgcgcacgtcacgcagaatcaccccgtccgacgtttccacgcgcttgagcgagtgccccatcaatccgatgaacgaattcagattcatggctttgttgccttcacgggaggtcgacgcatacagcttgcgttcgaacgaccatccttttgcggtgaaaatgcgtaccaaacgttcgtacagttgcagaatgcgattcgcgtcgacatgctgctgcagggtgatcgattcgttcaacgcctgttccgtcaaacgcaggtcgcgtgcaagaccgcgcaatacctggtcgcagaagaaatcgtcggtatgatcttcgaccagccatgtgtcggccttatgctccaaccattgcgcggccgcacgatagtcttccgcacagcgtgcgaccacactacgccttgcgtccatctgatcggcgagcgccgcaacggtttcgtcgcgcgctttggtgaaacgttccgcaggtgccgccaattcggccaatactttcggcatgagttcgcggcttgctttgagaatcgctcgcgcttcgtcattgttaggatgcggaggatcgtcgattaggagtacgactgcaaggtcgggaaattcctgcaatgccgccgaccagatcgttttttcgacgactttcggctgttccacgtacgaaggaatcagcactgtgattcccttatcgtagttgtgtgcgaaatggtcgtcgagcatcgcccgaggcacgcgttcatgccggatgaaacggtatagcgccccttgccgtgtggtcaagtagacgagcgcgctgaaaatcagcgtggtcacaatcgtcatgtacagcacgccttcaaccacgaaacgtaacgtgagtgaaggattgttgacgaacaacgacagaatcatcgtgatcatgtagatcagccatgaaacaaccgtgcagatgatggcaacgtaaccacgcacaacgcgcgttggcgaaggcttggcatgcatgatcgcaagcggttgcgtggaggtttcagcaccccactggtgcctgcggtcatcgccgtcaaaatcccctatttttgccaccatatacccctttgccttatcagcgctgcctcacctgcataaaccatacatcactgttgaaattgtcgtactagccacagactacactccctaactgtaagcgagatataagaaaaacagcgcacgagaggaaagcttaatcccccgtaaaatcccccgcatatgcactgaagcccagcgggacacagcctgctagacgccccaatgtccccatcagcattggtgacctgacgatttcgaaagggaatgatgaaacccctgtttccaggaagacgattttccttcctccgactgttcatagcgatactgtgcatcgcgctcgtcgcggccggcacatggtcgtggatcacgttcacgcgaacggcggctaagaaattgccggaaccctggttcggcggctatgtggacgtgaccgcaacaccctcatacgagttcgaatccaaggtaggcaacgtctaccggaatgtgattctcggattcgtcaccgccggcgacggctgccagccaagctggggcggctactacacgctcgacgaagcggcctccacgctcgatctcgacagccgtatcgcgcaaacctacaaaaccgatcgcacggtaaccgtcagcttcggcgggcagaacggcaccgaacttgccagtgcatgttccgacgtcgattcccttgccgacgcataccagcaggtgatcgaccgctatcacatcacctcgctcgacttcgacatcgaaaactcgaatctcgacgggtacagcgaaaccgcaacccggcgagcgcaagccgtggcaaaactcatcgccaacgaaaaagccaaaaacaaagggaaagacgataccagtcacgatctgatcatcagtttgacgcttccggccgacgcgaaaggtcttacaacgcaaggaatgcaaaccgtgaacgcgtttctggatgccggcgtgacgctatccaccgtgaatctcatgaccatggatttcaacgtggcgtccacgtcgatcacgcaatccatgctgatcaaaagttcgctgaacgcggcccacgcgcaatacaaaacgttgctgtacagtcgcggcaaactcttcagcgaccatcagatctgggagctgttgggagccaccgtgctcatcggccagaacgataccaaaaacgagtatttcacgctcgacaatgcgcgcgaaatcaacacgttcgcactggaaacaagcctgggccacttaagcatgtggtcgctgaaccgcgaccagcaatgcggcgaaaactatacgaacaccaacacgctcaaaacgttctgcagcggcatgaaacagacggacggcgaattcgccaccacattggggtcaggattccgaggcacgccgggcacgctcgtcgacttcgacaatgccagctggaattcctcgcagcaggcctaccccacgtgggagccagacgtactgtacaagcaaggcgacaaggtgatctggaacggcaatatctacgaatcgttgggcaacaacgaaaacgagcagccggacagcgccgaggaaggcacgaacgcaccgtggcgcatcatcggaccggtgctataaacgcttgccgcagcgagacgcgaccacagacacaatacaaggcaggaacacaaggcagtcgctacttttcagtaaaagtggcacgcaacaggggaacgaaatcaggcaatcatgacatcgaagcaatcaaagcatcaggcagccaccggcagccagccaaaagacggcatcagaaaaccagccagactcaccattctggccatcatctatgcgttgtgcattgcggccgcaatcgcattccatgcacaggaaggcgtgcagcaacttatggaagaccctgcgcgcatctgcatatggtcgctgtgttttctgccgtgcctgatctaccacaaaaagcgttcgtcgtatcgcgttgccgccgaacacaccgtgctgccaccgttgaccgtcatactgctggtaaccggctattttcccgacgtggccatgttcctgatcatcgttaccatcatcacgtcgatcatcaccgcacgcagtctgaaaatcggcattcttcgcgccggaaccacgcttgcgccaatcccactgatcaaaatattatttgcgaacacttctcacgtactgtcaattatcatcagccagaattccgtcaatgctgcgattaatccttatcaattccagcattggttgctgccattactgattatgactgttgcagtgccgattattcgattgatttgtgatattgtaacgttcttttttgtacaaattccgattcgtaaagccatgcgcgagtattcgctgtctcacattcttgccatggctttggctgatttgatggcgattgtgtggattcctgaaattctggagttcgccaatattggctcggatactgccaccgtgctttccgtgttcatgctggcgctgatcgcctactcgctgttgctgatgacggtcgatacgatgagccggctcacgcgatcccgaagtgcgttgaaatgcatagcgaatgtaagcgacgcgctgccgttgccgaatcaagtgccggaagagaccgtcgtaagacgcatcaatcgtggcctcacccgcatgcgctgtttcatcagcaatgcaaacaatcttaataaaagagggtattcctaccgctattccgcgcctatttccaccggctcgcgacagtattatctcgcgatggaacgcagtatttggaatcgtccgttcatgtcgaccgacgagacgatattgctcacctgcggcgaagtgcttaccgaatcgttacgcgtgaacaaggaagtgacgctgctacgcaccgaatcggaaacggatacgctgaccggcgcactcacgtatcgtgcgttcatcggacatttgaagagtctgcagaccgagaatgtgcataatctggttgccgtggtgtatttcggcgtggagcatttgcgcaccgtcaacgaacattatggacgcaaaatcggcaatgccgtgctgcgatccgtgggcatgcgtttaagccagctgctgccgggaaacgccacgctttcgcgcgtgaacggcgcagaattcgccatgatcgtaaccgatgtgacgtcaaccagcgatgtggaggagttggccacacgcatgcgcaatcttgccgtcatgccggtatacaccgaagaaggcgaggtttccgtggacgtatcgagcagcatttcgttctcgaacgcgacagacggcttctccgtgctcctcgccgatgcgagcgcgcacatctacgagtcggagagctccaatctgcccgtagtcgacggcatgacgtccacgctcgccgcgcagaatggttcgggagactatttcaacgcttccgacgtgcttcgccatgcgatcgaagacaatacgatttccgtgctctaccagccgattttcgatgtgaatacgaaacgtatcacttcgctggatacgattgtgcgcgtgcatgacgcgaagggccgtacgctggcaccgtatttcgtaacggctgaagcgcatcgtctcaacatgagcgtgcagctgacgctcgacgtgctggaaacctgcgtgaaagacatgaccgcattccgcaaggtggcacccgaattggatattgtggacatttgcatgaatggttcggaattaggtgcgtccatcttccacgagcgcttggagcagttgactcatgagcagccacagctgcgtttcggcctgcagttgggatcgcatgccattcatgtggtgcatgatgaagttgatgatgaggttgccgctcttgccgctttgccgaacgtcgagttgggtttgaccaatgctggcaccacgtattcggaggttgccgcgttcgcgcatctgccattggatttcgcacgattcgacaagacggtggttcgcgatttccgtacgcctcgcgcaaagcagatcatgcagcgcacgctcgagatttcgcgcgataacgatgcgttccatgtggtgttcgatggcgtggagtccctggaccaggttgagttcatccgttccatcggaggcacgctcgccgagggcacgctgttgagcaacgccatgagcgccaacgagttcctcatgcgcctcgaaaccatgggcacttcattgcccgaagccgctccgaggcaagctgagtaaagaggagtctcgtttgtcgcacgattgcttcatctcgtgaaacgcttggaggaaatatggcgagatgggagcatgtgtgctaaattaattagtaaacgtgtttagccaacgatggctttgaggaggattcacatggccactatcagagagatagcgaaacgggtaggtttctcccaagccactgtttccagggttttgaaggacgatcccactttttcggtgaaggattccacccgcgagaagattctaaacgccagtctggaaatgggatacaagaacgtaccgcaataccagcgcatcaccattccgcaggatgttgcgattctcgacaatgtcgtacccgacaagggcttgcaggacgcgtatttcgacgagctgcgcgaagtgctcgtcaagcatgccgaagagcagcgcatgaacgtgaccatgcacgaggacgtggattcgctgatcgccgatgccgataaatacgcgggatttatttcgatcggcccgtccccactagatcacaagacgcttcaccgcttgcataagaagcttccccacggcgtattcatcgacatcaatcctgcgccgacattgttcgattcggtacagccggatttggaacaaaccatattggatgcgatcgacgcgcttatggggtcgggttgctctcggatcggcttcattggcggcttgggcaacattatgggcaagcatgaatatccggaagatattcgtacgttcgcattccgcaattgggcgttgcgcttgggattggatgcgcaaggattggtgtatgcggacggcccgttcactgtggaaaacggccgtttgcaggggcgtcagttggtgcaggatcatgcggacgatctgcccgacgcagtgatcatcgcagccgatccgttggcggctggcgtactgcaggcatttgccaccgaaaatgtgatggtgccgcgagatatcaaagtaatcagcatcaacaatcaggagatcgcaaaatacacgtctcccgcattgtcgtcgtacgacattagccaggacgagcttgcgaaagccgcggtgcttatgcttgccgaagcgctgaccgccgaccgcaaaatcagccagcatatgcggatctccaccagtctcgtcgcacgcgacagcttcaccccgcaagactaaatataaaaacttgagatacggcaagggccggcatcctgttgcggagccggccctgcaattgtgcttcagtaatctcgcttcagtaatctcgctttagcggagagggcgagcgtcacaccaaacgtgggtgacggaccaggtggcgggatcgagcagaagcacgtcggcagcgtagccgggagcaagcagaccgagaggttgcctggtgaccgggttcgcgcggtcgaaaccgaatgctttggccggagtcaacgtggcggcctccaccgcgtcggcgggcgtgaatcccaattcgagcaccgcacgctgaacagccttttccaacgtcagcgtggaaccggcaatcgcaccattcgacacgagccgagcgtgaccatcgatcacatccacatccaacgcgcccagcagataatgaccgtccgggcaatcggtggcagccatggcatcggtcacgaatgccgtgcgatgcggtgcgaaaccaaatcccaaacgcaccatcggattctgcacatgaaaaccatcattgatcaactcgatagtgacgcgtggatcctcaacagcagccggaattggaccaggctcgcgatgatgcaagccattcatcgcattgaacatgtgcgtcataatgcccgcgcccgcgtcgaaacccttgtgagcggtcgcataatcggcatcgcaatgtcctaccgcaggaaccactcctgccgccacgaaacgacgaatcgcatcaatgccgtgcggcaattcgggggcgatggtgatctgacgcagacagccgcccgccgcttgcaaaagccgatcaacatactcgggaagcggatccttcaaacattccggatcatgcgcacccttgcgagacaacgcgaggaacggtccttccagatgcgcgccgagaatgtcagggcgggcgctcatcatgccgtgcacggtttcgagattggcgcacatcacgtcaagcggattggtgatcaaactgagcacttggcgggtggtgccgtgcatcatatgacctgcgcgagccgtgcgtatgccttgcacgccatcatcgaaggagctcccccacgaaccgtgcgcatgaatgtcgacgtaaccgggagtcatcatgcagcctgcagcgtcggttacggaaccggtcgaaccggtcatggaatttccgaaaccagccgaactgaccgaaccggaatcagcatcggcaccaactgcagcatccgcatccaaaccgacgcttgcgcaagccgcagcaaaatcatcgtcccgattaccagtcgcaataatcgcactaccatcggaaactatccaataatgttccgcaacacctcgcgcatcgactttgcgcgcattgtgaatcgcaaacgggcgggccgactgcgccaacgcaatgtccacctcattcgcaaaacgctcccgagactgttccatcttcataccttccgactcacttccagccatattcctcaattagcatccaattcttccagtcagtggaagaatcaccccgccgacaagcccatcagcgtccaaaaacctccagccggtggagaaatcctcccgctaacagccacctcagagtcccaattcctccagtcactggaagaatccggacggcgaaataccctcgtactgtccaaaaacttccagtgagtggaagaatcatcccgatgacaggccgaaaagcgtccagaatgttccagcgaatggaagaatccggacgctagcggacaccgactgcagagcagcaatcagatgtgctgccaggcgggcttgtgggcgtaggcgtaacggtagtagtccttgtgacgcaggcggctcgcagcctcctcgtccacaatgatggtggcgtgcggatgcatttgcagcgcggatgccgggcagaacgcactcacaccgccctccaccgtttcggccacagcctcggccttgcccgatccgaaggcaagcagcaccaaatgacgggctttgagaattgtgccgataccctgcgtgatgcaatgcgtaggcaccttgtcgatgtcatcgtcaaagaatcgggcgttgtcaatgcgcgtctgctcaaccaacgttttgacgcgtgtgccggaagcaagcgacgatcccggctcattgaagcccacatgcccatccgtgccaatgcccagaatctgcacatctatgccaccgacctcttcgattgccttatcgtaggcagggccggcagcctcaatgcgttcgccgtcgctcagcggcgccccgtcaagcacgtcaccaggcacgtgcaccaaatcagggttcagtccaagcggttccacaacagtgcggtgaatggtggaatgatatgactgcgggtgatcaagcggcaatcccaaatattcgtccaatgcgaaaccacgcacctgcgatacgtcaatatgctcgccgtgcacaatgcgtgcgagcgactggtatgctgcaagcggactggatccggttgccagacccaataccgcattcggcttggttttgatgagatcggcaactgaacggccgtaaatatcgcccgcttcgcgctcgtttttcacgatgatgacttcggtcatgatgttcctttcattggcattggattgacgtttttcgttttgctgatttcttgaggatttgtttgatgatttatctgctgattcgtcgaagctcgtcggctgctttccacacggtttcctgaatgcgatgcagttccgacggttggcttgtcacgttccattccttcgcataggcctcgcaccagcattcgagctcgcgtgccagcgcacgataatcggaaggccgccaatcgccagcgtcatgcgcatcacgcacgtcatgcgcttcggcgagcgcgaatcccactcgattgagcagcagctgcccttccatggcgatacgtacggcagctgcaatgcccggctttcctatatgcgccataatcggcgcaatttcaaccatgcattgctgcagcttacgattggcttgcggaattcgttcgattgtcgttgccatattgcgcatcatgcgatcgcgcgcctcacgcaaagtcaatgcgtttcccggattggcaagacgatcggtcaagcatgggatagtttgcgcaacatcggtattgcagtttcccgtgccgtcatccaattcgagatattccacaagctcacgccaagtgaatacggcttgcgcggaagcgttacgaagcaatgtgacgaaacgagcgctgcaatcgccatattcgacgcgcgaaatacgctcaagcaagtcgttttcagcactatctccagcactgttttcagcggtatttccgtcagtctttccagcactatcttctgcgggattccacgcatagtgcgcaccgaatatcatgccgggaaccgccatgcgcggatcgttgatatgcccaaaatcgccccaatcggtgacgagcatgccttccgcaccgcagtcgatgccgtagcgcgcgatgcgtgaaatgttgttccacgcatcgtcgatgcgcggcagcagcgcattccacccccatacggccgggcatacgatttgtttggctccggcttgcgccatgagttggattttttcgtcggtcgcttccggttcgtactgccagttcagcagtgtgacattgttcggcagggtttcgaggatttccggcatttcgacggcgatatctccccagaacatgggttcgcggccctgcttagacaggtgttcgcagagtttgcccacgtatgttgcgtacagcgctgcgacgcccacgcgttgcgcttcctgcttcgacttgcctttgccgaggtcgaaggtttcgtcggcgcagatgttgaatcgcttcgaacggaaaagttgcagatacgagtcgaccagttgcgcagagaatgcgaaggctcgatcgtcggcgacgttgagtgtgtggtgcctcatgcgttcgatgaagctgaacggccggtctgcgtcttcggggaattcgccgagttcgcgcagttcctgcgtgcgcatggccacatattggtgtccgaatgtggagactgacggcacgagttcgatgccaaggttcgcgcagtattggtcgaattcgagtgtgtctgccggcgtgagcgggcttgatccgcgccatgtttcgctcataccgtcgaatgcgaacgtatgctcgatgtacagctgcagttggttgtatttgtagaggcagagtttgtctgcccactgtttgagccatgcgagcgttggcactcggccgcgcgtcgcgtccaaataatatcccctgatttggcatgcgggggcatctgcaatctgcagttccggcagtacgccaccgttttgccgtatgagttggcgcagtgtctgcacgccgttgcgcacgccctcgaaatcgcaaccggtaatcgtaatgccgtcagtgttgatagtcagcgtgtatgcgccggcggtaccgccatcctgcgaatcgaaatcccacgaatccgcaatacgcaatctgatgaaacccgaccacatatcgcccgtcgcaatatcccaatcagtgcctgtcgcggaacgtatgtcggcaacaagctgatgcgcaagcaggaaatcgccatcgccaatcgcaatggattcgttcacgcgccccgcatagggcaacagcaccgtgccttcgccgaccgtcatgctgttcggttcgggaatgatcgcccatttgcgggtgttctcgcttgccatcgattcgcctttcgattgtcgattatcgatttcaattctcgattgtgattctcggattgccgggattgccggatctggatttccggaattgttgcgcttgttccagtctgcctgaagtatcacgcattcacgattgcggttgcgctcgttttgccgcgagcgccgcgccgattgcgccgattggttggtccatggctgcgattctgatgttcgatgcgatgtcgagtgtggtcaggaatcggcatccttcggctctgcggctcagttcggcttggatgacttcgatgagtgcgtcaccggttttcgccatgcctccgccaatgatgatgcgttgcggatcgtaggcttgcgcgacgatttggatggtgtcgcccatggcgtgggccaccatggcgagcacgtcgttggcatgcccgtctccttgccgcgctttgcggatgagatcaggcatgggcgggtttgcggagggccaaagttttgccacggccccgccggatgccacggtttccaagcatccacgctgcccgcatgggcattcgaatccgttggggtcgatgggtaggtgcccgatttcgccgatggatccgctgtacccgtgttcggcttgcccgccgcgcacgagtcctgcggccagtcccgtgccgaagttgaggaatacgacggttgcgttgccgtcgacttgttccacgaattccgcggctccgaccgcagccgcgttcacatcgttttccacgtgcaccggagcgtgcatgattgcgctgacgcgttcgccaagttccaacgtttcaatatcaagattgacgacgttgctcacttgcccggtcgcgcagttcacctgccctggaatgccaatgccgatgggcagcgcttcgttggacagtatgcgggcgacgcgcacgatgtcggttacgacattgctttcaccggagtgcgatggcatacggcagacgtcgatgacgcggtctgttgcgtcgagcagcacgccttcgattttcgttccgccgatgtcgatgccgacgcatccttgcgaacggccgttatggtgcagtcttgcgttcattgcatgtacctgcctgaaatagtggggcccggattacggttgttctgttgatccaactccatgcgtggcgtttgcatgccacgcatggagttggatggatgcccgtcaacccttgaccgcgcctgccgcaagaccggcctgccagtagcgctgcaagccgaggaagagcacgatcaccggcagtacgccgagcagtgcgcccatcatcagcgatccacgatcgttgaaggttgcgagcgataccatgccatacaggccgagcgtgaccggcttgagggtgtcggaggaaaccatcatcaacggcagcaggaagttgttccacgttcctacgaagaggaacaggaagatggtcaccatggctggggcgagcagtcggagcacgatggtgaagaagattctcgcttcaccggcgccgtcgatgcgggccgcttccagcagttcgttcggtacggaggtttgcgcgtacacgcgtccgaggaagaagccgaatggcgaaacgcagcacgggatgatgatcgccagcatggtgttggtcaggtgcagtgcgtggaagatggagtactgcggaatggtgagcagtgcgaccggcatcagcatgcatcccatgaccacgccgatggcgatggccttgccacggaagttgaattttgcggtggcatagcctgccatcaccgaaatgatggtgccgatcagtgcggaaaccccggagtagatcagggaattcaacacccaacgccagaattggccacgggtccaccccataagcttcgaatagttggttgcgatggcgtcgggaatctggtcaagtccgacggcgaaccacaatccgttgctgctggtcagctgcgatggtgttttggtggatgcgatgatggcccaatagattgggaagaggaagtagatcagcgctacgacgagcacgatcacggtaatggttttggtgatcggcgatgggcgcatggagcgcggcagatcgtgttcggccgcttcgcgttgcttttccatcatgcgttccgcttttctgcgggcgcgttcgtcttttcttgctgcgactgcattgctcattgttcgttcgccttcctctcgaccagtgcgtagatcatggcgagaacgcctgcgatcagtgccatgacgatggcgaccgccgatgcgggtccgtcaccgcccggagtcagcgtgccttgggaagtgttcatggccatcatcattggcgtataggttttggagatgcccggatcggcggtctgcatgatctgcggttcgttgaatagctggattgtgccgacgatggacagcaacatggacagcagcgccgcggaacgcacgttcggcagtttgatgcgcatggagatctgccatccacttgcgccatcaatgcgtgcggcttcgtacagttcgtgcggaatcgcctgcagtgcggccaagaaaatcagcatgttgtagccggtgaacgtccatgtggtgatgtttgccatggaagcgagcacaacgttcttgctgaagaaatcaacgtttattccgatggccgcaagacctttgacgatcggcgaaatctgaccgttatacaggtacacccaaatgatggatgcgaccacacctggaatggcgtacggcaggaagtagccgagacggaaacccgtgatgtgcttgaccacgaacgaatcgatgaccatcgccaaagccaacgcgatgatgatcatcagcggcacctgaatgagggtgtaaatcagcaccctgcccacaccggaccagaaattgccggacgtaagcacgtactcgaaattctggaatcctacgaatttattcaccaattcgccgccgccgtacgcgccgccgccctcggtgacctgacggaagaagctggaatagatggcatagaaaatcgggatgatgaatacaatggcgaacagtatgccgaatggcgccatgaacgcccatcctgttcgattctcgcggcgttgcgcatcagtgcgctttggtttcgccgcttgcgttgttgcagtcatgatgtacctatctttcgcatcggatgccattcatcgttgatggcatctttcacagttcgaatcgccgtatccaaatcgtcatcacgggagaggagtgccggtttcagccgctccgtcgaatcagctagatcgattcatagggaatattcacaaggaatattttcataaggaacggtgtggagccgtgtgttgcgttggctccacaccgtcgttggaggggttatggaatcagagcgggtgatccctggttccatacgtcgatcacttcgctacggacaggccgtagttcttgagggtgtcgatggaggtctgctgtgccacagggaacacgtccgccaccttgccggaaccgtcggctgccttgtcggcggcttcctgcatagctgcggagaccgcggagtagcccggcatgtagttgaatgcgaccatgttgtcgttggcagtagcgaattccttcatcacgtcttggccgccgtagaattcgttccaggattcaggggtcttcgcggtttcggtgctggcggccacaatcagaccttgggaggtcagatcctcaacctgagtgttgaaccagtcgaggaattccatggcttcggccttgtgctcacaacccttgagcactgcgacgccggaaccaccgtcagggccggtgctggtgccattgccgaaccagtcaccgatctgggtgacacgccagtcacccttgccggtgtctcctgcggagtccttgaatagcggagcctcccaagcggcgccgatgttgccgatcagcgtgccatcctgcagggatgcgtcgaacgacggcacccaacgcgggttggtcagcgtggccttgttgtcgatcagttcctggaaggtttcagcaaaagcctgcgaaccgctgccgttggtgttgaccacccaagcgtcattcttgacggtgtaccacgggtcggaagcatttgccaaacctgcgaagatgttgccggcctcatcggcttcgtaatccatgatgtacttgccggacgcggccgcggtctttgccgcttcgatcagctcatccttggttttgggaaccttgatgcccagctcatcgaaagccttctggttgtagaagtacacaagcgggccggtatcttgcggcaggccgtaggtcttgccatcaacctgcatcatggaatatgggccttcggcgaagtcgcttttgtacttcgcggcctcttcggtcacgtcttcgagcaagcccttggtgaacacctcaggcacttcggcgtagccgacctgtgcaagatccggagcattgccggccttgacgtcggtttccagcttcttgatcatatcttgtgcggcaccatcgaacttggtggccttgacctgaatgttcggatgatccttgttccacttggcaacaatgtctttgaccaaggtcatgccttcggaatccggaagacggtgcatgtacgtgaggttgacgacctccccggaatccccgccggtgctggccgtattggaaccgcatcctgcaagacccatgcacagagccgcgaaagaagctgcgcaaaccatcaaacgctgagtgtgggatcgcatatctctctccttcgtgagattattccggcacctccttgcaccggatagtcacagcatacctacgtaatccttttttgtcaagtttccttacatttaaatccggcacgcgattgctattccacaaaaaagctgaaattccgccatttagtaacaatcgtaaagcaatcgcaattcgaggaaaaatgccgtatactcttgtttagtaatctttattgccaataaaaattacataacgcacttgtatcgccacaaactacaatatgtatcggctccacacaagaaagcgaggacatcgtgagcggtacccaagcaaaggcatcaccttccgacattcgaatcagcaatatcaccgccgcattcgagcagcttttccccgcaacgcaaatgtcgcgagccaatatcggcaaactcatcggactttcgcgcttcaccaccagcgaagtgaccggcgaaatggtcgacaatcgcattctgcgcgaactcggccccgacaatcgcgaagggcgcggtaaacgttcacaagtgctcgccatcgacaccgatttctggcgaatcgtctccgtcgacctgtcgaatccgatgctcgtcaaaggagcgctggcggatctttccggcagaatcgtggaccgcaccgagcttcccgtcgaccatggctgcagcgtcaatgacgtgatcgacctctgcaggcagctcatcagctcaacgccactgccgacccttggcatcggcatcgcggtgaccggcattgtggaacccaacggcgtggtgcgcaaatccgtgcacttggggtggagcgaactgccgctgaaaaccgaagtggaaaacgccaccggagtgcccgtgatcgtaggcaacgacaccaatgcggcacttgtggcggaacgattcttcggcgactgctcccccaattccatgctcatctccatcgggcggggcgtcggcgcggcattatgcctcaacgacgtcatcatcgaaggaagttccttcactgccggagaaatcgcacacgtggtggtcgacccgaacgggccaatctgcgaatgcggcaaacagggatgtctcgaatcattcgtttccggtgacaggttgcagcaacgcatctcgcaggatcccgccgcgcgtacgcatattctcaccgaagcgggcgcgttgctcgggcgcgtcatggccataccggcaggattgttggatctgcgcgacatttcggtatatggtgcgccggaaatcgtcaatactcaattcatcgacgcgatggaaaacgaaatcagccgcaccgtgaccacggattatcaggaggcgccgcaaattcaccgttgcaggcaaggcgaggatctcaccctgcgcggacaggccaccatcgtgatccgcacactggtaccgacgatccacgaacgcggctccctcatcggcgaagcatagctccggacgccttagcgcgacccaaaacctccagtcggtggaggaagctacccgctaacagacctgctaacgtccaaaaacctccagccaccggaagaatcgccccgtctgcaactctccaagcatccatattcctccagtcgctggaagaatccggaccgcaaaatacccccgtactgtccaaaaacctccagtgagcggaggaatcctcccgctgacaggccttttatcgtccagattgttccagtgagtggagaaacccggacgggatgagaggcatggagacgaaaagaatgaaaggccgcctgcagcggatggagtgcttcaggcggccctggttgtcggaaaggaaggggaatttcagttatcgggattcaggttggcccgccggagtcgcggttccagcagttccagcggtttcagccacggcaaccgcctcgacggcttccacggtctgagcgtcgtcggcttcgatctcaccgttggcgagcttcacttcgagctccttgacgatctcatcgtgcatcttctcagtgatcttcaccttgaacagaaacacgatcaggctcaggatgatgagcacgagcggaatgtagaaggcgcagatcttgaagatgtggatgttggatgcggtcatgtcggctgcggtcgcattgccggtcatgccagcggccacggcgatgatgccgacgatgccgttggacatggcgccaccgatcttgtcgagcatcgggcggacggacagggtgacggcctcgttgcgcttgccgttcttgagctggccgtattcgatggagtcggtcagcgacaggatggcggtcatctgaatgagggtacccggcacgtagaaaagcaccagagccacgaacaccatgatgatgttgtcggagaagatgccgagcatcacatagccggcgatcatggagatcatgccaccgatgtacaggtaacggcgcggaatgcgcttgttcaggatcgggtacagcggagccataaccaagcctgcgaccagtgcgatcacgccggtgagggagtatgcggcctggttgtcgaggatgaacttgaacaggaagatcagcacgccggtggtggccacgttggcgatggcgtacagcaggtagctcaaggcaacccacagcagctggtcgttctggaagatggccttgaaggcttcgatcgggttgccgttcttctgggccttggagcgcagggcgctctcgttctccttggtgccgaaggcaacggtccatgcggtcaagaggccgagcaggccgacgataataccgaagcaggtccagccggactggctttcgacgtacttgccggtgaacacccagctgaagtaggtgacgatcgggatgaccacgacggtgatgccgttgtagccgatggagccggtgaaggagccgagtgcggtgtaggtggagcgctcgtgggagtcggaactcaatgcagggatcataccccagtaggagatgtcacgcagggagtagaacacgtcgagcacgacgaaggtgatgacgaacagtacgatgaaccacgtggtgttcacgttcaccaagccgaacaggccggtgtacactagcacgatcagcacggacgaaatcgcgccggcgaggaactgccatgggcggaaacggccccacttggtggtggtgttgtcgatgatgttgcccagcagcgggtcgatgaagatctccgcgatacggatcaccacgaccaggccggtgatgatgccgatcagcttggtggcgacgcctttatcgacaccagcgaacaaggagctcgtcacatagacgacgaagtaggtgctcagtgcgttatagaacgcggactggccaaggttgccgcacgcgtacgctacgcgctggccgagctttccgcaacgagccgtgccgttcgcagtagtggtcgtattgctcattatctcttctccttagaagattttgatgagatcacccgttgacctcgaaaattgagtatacgttgtttactatcaaaagtaaaattccttagtaaacaaagcccccaaacggcgtgtcgcaatcgcagttcttacgattatcaaatactgacatctgcaatcatgattactaccgccatttgccgtcacctatcgccatataagtaaattcagttgcaaataaagcaacacgcagatttgcaatttaagtaaacaacgtttaccatgctagcaaaagagtttattactctgagtacacaaaagtacacaccaactaaacctacatcaacaacgaagttatgtttcggaaacgaggaaatcatggcagataagatcaccaccgcatccgccgcgtggctcaccgaccccacggtgttcgcagtgaatcgcacgccggcacattccaatcacgtaaccttttctcacattcccgcgatcggcgagccgagcgatttgaagcaaagcctcgacggcgaatggcgcgtggaaatggtgcaggcctccgacatcgatcttgaggaagagccgttcgcagccgaggatttcgacgattccgctttcggccgcatcgacgtgccctcccacctgcagaacgcgggatacatgaaccacaagtacgtgaatattcagtacccgtgggacggccatgagaatccgcaggagccgaacgttcccgaaaccaaccatgtggcactgtatcgccgcacgttcaccgtcgccgagcgtcttgatacggcccgtcaaaatggcggcaccgtcagcatcacgttccacggcatggccaccgcgatctacgtgtgggtcaacggcgtgttcgtcggctacggcgaagacggctacaccccgaacgaattcgacatcaccgaagcgctgcacgacggcgaaaacgtcgtggccgtcgcctgctacgaatacgcaagcgcatcctggctggaagatcaggattactggcgtttgcacggcctgttccgttccgtggaactcgccgcacagccgcatgtgcacattgaagatatgaaggtcgaagcggattggaatccggaaaccgccaccggttcgctcgacgcgctactcgcggtgcgcaatgcgaagaatgccgccaccgtgtcggcgacgctgaaggatttgagtggcaatgtggtgtgggaaaccgcattggccgcatccgacgaaaccggcatcgtttccggctcgttggacgtcaagccgtggagcgccgagagcccggcactgtacgaactgcaagttgtggtgatcggccatgatggcgcgatcgttgaaaccgcaacgcagcgcgtcggcttccgtcgcttccgcatcgaagacggcatcatgaagctcaacggcaagcgcgtggtcttcaagggcgccgaccgccacgaattcgacgcgaagcgcggccgcgccatcaccaggcaagacatgatcgacgacatcacgttctgcaagaggcacaacatcaacgccatccgcacctcgcactaccccaaccaggaatactggtacgacctgtgcgacgaatacggcatctacctgatcgacgaaaccaatcttgaaacgcacggcagctggtgcctgccgggagacgtggtcaccgaggattccgccgttccgggcagcaagcccgaatgggagggcgcgtgcgtggaccgtgtgaacagcatgatgaagcgcgactacaaccatgcttccgtagtcatctggtcgcttggcaacgaatcgtatgcgggagacgtgttccgcgcgatgagcgtccacgtgcacgaactcgacccgaaccgaccagtgcactacgagggcgtgacccacaatcgcaagtatgacgacgtgaccgacatcgaaagccgcatgtacgcgcacgccgacgaaatcgaggaatatctcaagtccgatccgaagaagccgtatatttcctgcgaatacatgcacgccatgggcaattccgtcggcaacatggacgaatacacggctttggaacgctatccgcaatatcagggcggatttatttgggatttcattgatcaggcgattcttgtgcgcttgcccgatggcgatgaacgtctctgctacggcggcgatttcggcgaccgcccgagcgactacgagttctctggtgacggcctgctgttcgccgatcgcacgccgtcgccaaaggcgcaagacgtcaagcagctgtatgccaacgtgcgcattgtgccgggtgaaaccggcgttgagatcgcgaatgacaatctgttcgtttccaccgccgactatgtgttcgttacgcgcgtgcttgcggatggcgagccggtatggcaggccgaacagcgttttgatgtgccggctggcgaaaccaagcacttcgatattgaatggccgttggaggcctaccgaggccaagccaacgagctcacgctcgaagtgagccaacgccttgccgccgcggaagagtgggcgtcgaagggctacgagctgtcgttcggccagaccgtggttgcaggctccaagccggttgctgccagcgagacgaagcctgttgacggcatcgtgaccgttggccgttggaatgctggcgtgcagggatccggtcgtgagattctgctgtcgcgtacgcagggcggcattgtttcgtacacgcttgacggccgtgaattcgtgctgcgcaagcccacgctcaccacgttccgcgcgctgaccgacaacgatcgcggtgcaggccacggttacgaccgcgcgcagtgggtcggcgcaggccgttacgccaagtgcgtcaacaacaccatcgaacaggtcaatgacgatacgctgaaagccgtatacgagtacgagctcgccactccgcagcgcacgcacgtcaccatcacgtatgtggcagacaccaccggcaagctgcacttgagcgtcgactatccgggtgaaactcaggaagccccgaccattccggctttcggtttggaatggacgctgccggtcgaatactccaacctgcgcttctacggccccggacccgacgaaacctacgccgaccgcaagcatgccaagctgggcatttggaacaccaacgcttacgacgatcatgcgccgtacctcatgccgcaggaaaccggcaaccatgaggatgtgcgttgggctgagatcacggatgatgccggtcatggcatgcgtgtgagccgtcacggcgaatcagcgttcgcgctcagcctgcagccgtacagcgcattcatgttggaagaagcccagcatcaggacgaactgcccgctccgaagcacatgttcctgcgcgtactcgccgcgcaaatgggcgtcggcggcgacgattcctggatgagcccggtgcacccgcagtaccacattccagccgataagccgctccacttggatgtggatatcgagctgatctgacacgttggggcatgccggttgccccaacaattacggggggtccgcgtattctgcggaccccctgcttgcgttattgcgttaccgcgttaccgccaatttgcattggcgctcattgcctcatatcatgctcaccgctcaccgctgcggataggaatcctcaaagaagcgacgctcgagatgcacgatggtgcggaacacgtcggcctccgagccatccaccgacgcatactcgttgacgagcgcgatcaggcggcccgtccaggcgcggaaataatcgccctcatgcaaatcaacccaacccttgtgcgccggaatctgctgaacgacgccagcgtcgatggtgcgcttggcccaggcaagataaatccattccatgcagcacagcgcagtaatgagttcttcccaagttccctgaaccagcttggtcagatattcgcaatattcacgatttgccggagtctgctcggaattattgtattcttcgtcagtaattccgtattccttaaggaatccggtaaaatatgttgcttcattgtcagcaaaccattgcgattgtttcgccagcatatctttggtttcctgacgcggcgcaagttcaatcgcatgtgccatgatgccctgattaaagaacttgaaatcctgaattaaataagacttcaaaatcgattctggaagtgtatcatccagcaattcattcacaaaacgcgaattgattgcctgattccattcgtcggccgccgacatatacagctgatcggctacggaacccggctcggctcccaaccacgcataatcgccgcttgcggactgcggcgcttccggaacatgattcatggtcacaagaccccctcggttaatgcggccaatgcaaacgcaacgcacatctcctcgctccgttccgccgtggctcgctgtgatggcgccataatagccgccgttcccaacgtaccgaacgcgccaccgaaacgcaagaagcagaacgcttccatgacagccatgaccgcactcaatctcggcgaatcattgcgcgaatttgttgaggcggcgatcgtaggtcatgaggccgttgagctcttcttcgacgtcggaaacctgcgtatacacgtagcccgccaatccgcgtgattccaacgattccgccgaatcaagcacggaacggacggcagtgcgccaatcctcaatcgaatcgtattcaccgtagccgtacgcgcgcgaaaccgcagcatgatcggcaaccaactgcgccaatcctccgaattccgaaatcacgaacgcacgaacgccatgctgcgcaaccggcaacaccgcgtaatgcgcggcacgacgacgccgcttatgccgcttttcatattcggccacatacccacgcaatggccccttatccgggtagatttccagcggacggaagtagttgtgcacgctgtgaaaatcgccgcaacgctggtcgtaccagccactcgtggcgtcgatcgggcgcgtcgggtcaagcgcatgaatgcgttccgccgcatcgcacgcgtcgaactgcccccacccttcgttgaacagcacccacgtgacgatcgacgggtggccggcaagcatgtgcaccatggcatcgcaggtgcgcgaccagtcgcggcggtacgtcgaatcgtcggcaccgagcgccgcgaaatgcttcgccgtgtcgtcgcggtacttgttccatgtggcacgcatgagcgtcggcttgcggttggtgacccacgcgttgtattcgccgccacccgacaccgcgtcctgccataccagcatgccgaggcggtcacaatggtagtaccagcgcgccgactcgattttgatatgcttgcgcagcatagtaaagccggattccttcatggcgattatgtcatgcaccagcgcttcatcactcggcgcggtcagcaggccgtccggccaatagccctggtcgagcacacccttgaggaacaccggcttgccattgagatggaagcgcgcgatacccttcaaatcaggcttaatctcaaccgtgcggaacgcgcaatacgagcgcacaatatcttgcttttcctgcgatttcgcgggtttctcttgaatttcctgcgattcttgctgcagcttttcctgctttccctgcgatttcgccgcaccaaattccagcgtcgccgtcacgtcatacaaatacggatcgttcggcgaccacaagtgttcggcccgcgttgcgatttccgtgcgcaccttgcgcatgccagccggcagcaattcgtccgcgacgatcgtgccgtccgcgggatcggctacgacgatatgcagtttggcattcggcttgtctccgccgatttccgcgcgaataaacaatctgccgtcggcggcgcccttcagcgtaagcgtctgcacgtacgcttccggcacgatctccatccacacgctctgccaaatgccgctttgcgcggtgtaccaaatcccctcgcgctcgattttctgcttgccgcgcatttgcgtacccgaatcgttcggatcgtacacgcacaacgcaatctcgaaagcatcatcgggatcgacgaatgccgaaatatcgacgtcaaacggcaaatatcccccgacatgcatccctgcaaactgcccgttgataaagcaggcgcacacgtaatcgaccgcttcgaaatgcagcatcaagcggttcgcatcgccgatctgccgaaccgcttcccctcccccaagcgtcacgggatgcaccaccgtgcgataccagatcatattgtctgggtaaatcgtctgatgcacgccggaaagcgcggattccggggagaacggcaccaaaatcttgccgtcgaacgtttcggggatggccgcttccttcactgcctgcaccgcttcgtcacgggtgagcacagccgcggatttgcgccatttcgagccgttgccgctttcgggaatggatacgatcgcgtaatcccagaatccgttgagcatggtgtgattgccgcgcaccatggttgggcgcggatgctcgttcaggattggcgtgcggccgttttccagtttgcgttcgccgtcttttgcagggcagaacgccttgtgggcgtcgttggaagacagccattcgccggcgatctgttcgccccaaggcgtccacaactgctgcagcggctcttgggaacgcattttcgtaggcgcggctttcagcactcgcttgacgtccaacataagagcctccctgcagcatcgcatttccctcaacttccccattgtaacgagaggaatggcaaagagaaatagcgattgttacggattttgaaatcgattcaatccggattgcactatagatttgtaaaatcgtatatagaaagtcgaatattgcacattagatttacaagtcggatttgcaaaatcagatataaaaagccggtgcaagaacttcgtaattccttgcaccggcaatcagaacaactcaccttagcggcaaatcaggccaaatcaagccgaatccccaggtgaatcagcgaatcagccttccagcttggccttttcggcggcaagacgggccgcctcggcctcacgacgagccttcagctccgaatcgaagcgagcgagctcctcttcgacggcctccggcggaatcttcgcgaaaatcggatgcggcttcggcactgcagtgccggccacgatcggctcggaagcccacggatgcacggtttcgcccagcttgtagtcgccggtgatgatcggatacatgaagcccggcttgtcgagatcctcgacctcttccaagcgcggcaacggcgagaacgtgcctgtgccgccgagagcctcccacaccttctgcgcggaatgcggcaggaacggggccagcaggtggttcgcgtcggacacggcctgggcggcaacgtgcagcacggtgccgaggcgagccggattgtccttgatcttccacggttcggtggcggaaatgtacttgttgatgtcgccgaccacgcgcatggcttcactcagcgcgttcttctggcgatggttctcgatcagcgaaccgaccgtgtcgaacgcggccttggtttcgctcagcagagcgcgatcctcatcggtcatttcgctctcatcgagcgccggaatctcaccgaagttcttgttcatcagattggccacacggttgacgaggttgccccaggaagcggcaagctcctcgttgttgtggcgcacgaactcagcccatgtgaagtcggaatcggagctttccggaccggccacggaaatgtagtagcgcacggcatccacagggtagcgggcgagaatgtccttcacataaatgacgatgccacgcgaagacgagaacttcttgccttccatggtcatgaattcggaagccacgacctgctccggcatgttcagcggaccgagcttgccggtttcgccgcccttggagccctgaccgttgtagccgagcatttcggacggccagatctgggagtggaacgtgatgttgtctttgcccatgaagtagtagcccggggtttccggatcattccaccatgcgcgccatgcttccggatcgcccttgcggcgagcccattcgatggatgccgacaagtagccgatcaccgcgtcgaaccacacgtacagcttcttgttcggattgtcgatccagccggcaaccggaacgggaatgccccagtcgatgtcacgcgtgatggcacgcggcttgacttccttgaacaggccgatggagaagttgatgacgttggtacgccagccttcgcgggtcttcagccatgcgagattggcttcggcgagcgccggcaggtcgaggaagaagtgttcggtttcctcaaagcgcggggtttcgccgttgattttggaaacgggattgatgagctcgtccgggtcgagttcgttgccgcaggcgtcgcactggtcgccgcgggcaccgtcggcaccgcagatcgggcaggtgccttcgatgtaacggtcaggcagggtgcggccggtggacggcgagatggcgaccttctgggtgcccttataaatgtagccgttggcgaggcactgcttgaacagttcctgcaccacctgctcgtgattgccggtggtggtgcgggtgaacaggtcgtagctcaggccgagatcgcacagatccttggcgatcacacggttgtaacggttggcgagctcctgtgcgctgacgccttccttgtcggcttccaccaggatcggggtgccgtgctcgtcggtgccagacaccatcagcacgtcattgcccttcatgcgctcgtagcgcgcgtatacgtcggagggcacgccgaatccggcgacgtgaccgatatgacgggggccgttagcatacggccaagcaacattcaccaaaatatgactcatggtgcccgattatacaaagcgccatatcccgcattttccatgtatttcggtagttggatttttattggaggatggacgtgcgatcatcgatttcaatcgtttgaaatagtttgcatcataatttgcatatctgccgatctatccacattgttgcattacgtaacaatcattttccacatatccacagattttcgggggctggtggcgcaacggaattcgaatccgctacggtaccgtcatggacactccaccaccccttctgggcaacgatgaccttccgggcccgatgtgcctgaacctgctggcctcatccggcgcgctgtgcaagctcgacagcgcgaacgcctattcatgccacgattcggacacgttgtacgggcggtcctgcatcatcgcgacattgctgccgagccggtccgtggcatgttcacgcaccgccgcatgggtttggctaggcggcaccttccccgaatccatcgacattatcgcgaaagcccactatcgagcgctacgttacggccgtaaaatcaacgttttcaaccgtctcgcaccaaacgaacacaccatcaaagtcggtccgatcatcgtgaccacgcctgttcgcaccgcatgcgatctcgcattgaactgcacccccgaaagcgaatcgttggtttccgaaatcatctgcatgctcatgcaggaatttcatttccgctccaacgattgcatgcaaatcatgcaggagacgaagcatattcgcaacgcgccacaggcgcgcaactacattcttgcgatcgacggaagaagcgacgaatatgagcgcagcgcatagcaggcataaggcgcggcgcgcgacgcacgccgacaggataggtgccgacagagcaaacggattccgcagactgctcggaatccaagaaaaacgcaggccacggacgcatcgcgagacgcatcgggatgcgcggaatctcgcacaccgtgcacagcggacgcgccgcgaaccgccgccataccagcccaaaccgcggccgaaaccgctggtggatccgccgtctcccccaattccattgacgccgctggtggcgtgcagtccggacacaccgcaggacgtgctatggcatatcgcggaatacgcgccgcaactgcgcaaatggctggtcgccaatccttccgcaacaccggcgatgttggactatcttgcgcaagtcggcgggccggacgtggcccgcgccctgcaaatactgctggaatcgttggaatcgtgcggatcgcaagcatgcagctaacacttgcgcgacgggcaatcgcacgataggcaatcgccggacggtaactaatatggactcactgcttcatcgcaagaaccgcattgtagacctgcttgcgattggcaagcgagccgtccgcaaggggatgctcggcaacgacctgcgaaatcgcgtctttgatgcgcagattgtcttcctgcgcacggtcgatcgacagcaccgccaagtcttcgacgctcaacgatgcgggggcagcagcgtcagcctcctcttcggaagcgccggcaacgaccaacaccatttcgccgcgcggcggctcgtcgatcacgctctggcgaatctgcgcgatggttccgcgacggatctgctcaaaatccttggtaagttcacggcaaagcgccatcttgcggttcggaccgaacacgtcaagcaggtcggccatggaatcgtcgatgcgatgcagggtttcgtaaaacacgatggtgcggcgttcagaacgcagggtacgcaggtattgcacgcgttcggaatgcttgcgcggcaggaatccttcatagcagaagcggtcggtgggcagtcctgaaaggcacagcgcgtccagcactgcggacgggccgggagcgcaggtgacgggcaggccacgttcgatggcgcgacgcacgatcgcgaggcccggatcgttgatggtcggcatgcccgcgtcggacacgaccagcacggtagcgccggtttccacctgatcgagcagaccgtcggacttgtctcgctcgttgtgatcgtggtaggccaccacgcggccgttcacgtgcacgccgagacggttggcgagcgcgtagagacggcgggtgtcttcggcggccacgatgtcggcgcgttccaggagcgcaatgaggcgtgcggaggcgtcggccgtgttgccgatcggcgtggcagccatcaccaccgtgccttgcggaacgtcggttccgcacacgagggcgtcaagccccgtaccagactgttctgttccagactgttccgccgctgtcggcgattctgccatctccgccgtattcaccattcccgcagttcccgttacttctgccgtattcgcactcaactcattcagtttcaagtccaacgtctcattcatgcgttccatgccttcagcctatccaacgcaaaggaaaacagccctccccgcgtcctaaacccccaatcgctggaacaatccggacacaaaacagaccctcagcggggtgattcccccacccactggaacaatcaccccgcttacagccccagtaacgtcccaaaacatccagacattggaacaattcggacgccaacaggcttaaaaacgtcctgattcttccagtgactggaagaatccgccctcctacaagactaaaagcgggcagattcctccaccgactggaagaatccgcccgcaaacgcatgtttacaccgcgcacacgtacttacctcgtgtacatacgtggcagcgaatcggccatgcgtatgaagctgttgcgcgcgaaagcgttgaaatcgcgcgcatacggcgattccggcagcggagtgccatatgcgcccgtgccggcagcgcccgaatcattgccccagaccgccggatatgcgccggtcacggcatgcacgtcggaatccgtatcgggggtaatcaccttgctggtttcgttttgatgaccgaacatggagaattttccggccgccgcatgcaacgcttcgagcagcgcccgcgattgccgattcagattcccatcaaccgattgcgcaagattttccgccacgattcacactcccttgtatttgccgtattcgcctagtcttgcattgccccaaccgctctcgcattgccttactgctgtttccacgctatcttccgcgccatcgaaacacactttcgtaccgtcaacatgcgcgattcgtgttcagcggccccactatttgatttgttgacctcacgattccgtttttcgccgccttttttcaaatcgtgaggtcaccaaatcaaaatcatgaggtcacccccccccaaaaaaaaaaccaaaatcgtaaggtcacaacgccaaatcacaatgagcgatacgcgatataccggatatatcgcatactctaaagccaaacagccaaacgccaaacaccaccaaaccaaaatcacccaccgcagttggcactttgcgtccgtttgtgcagatttgccaaccgtcgggcattactaggcgccgcattagagggccactggtaggctgacattggttccgcgaggccaacccacacaaggcagcctgaaccacttaattttggacgtttagatgtaaggtactcacagagagcatttcatgggaattatcaacttcttcattaatctgctcaaggatccgcgcacggcgatcgccagctggatctccatgggcgtcgcccccacgcttggtttcatcttcctgattgtgttcgtcgaaaccggcgtcgtgttcttcccgttcctgccgggcgactccctgctgttcgccgccggcttcttcgccgcgcccgacgcccagaccggcgtttccgcactaccgctgttcgcgctgctgcccgtggtctggtgcgctccgatcatcggcgaccagtgcaactactggatcggccacttcttcggccgtcgcatcatcgaatccggcagagtcaaggctatgacccccgaacgcctcgccaaaaccgaaggcatgatcgaaaagtggggcccgctcgccgtgttcctcggccgtttcttcccgttcatccgcacgttcatgccgttcatttccggcatttccggcatgcgttggagccgtttcaccccgttctccgtgctcggcggcctgtgctggtccaccctgttcacgctgctcggctacttcttcggcggcattccggccgtgcagaagcatttcgaactggtcatcattgcgattctcgtgctgtcgctgattcctaccttcgtcggcttgctcaaagcaaagttcgacaaaaagaaggctgataccgcgaccgcggaagcctgatcttacgttttctccttttcttgcgattgcggtgtctttcgatttttcggaaggcaccgttttcgtatgctttcgcatgcttttcctgcaagggatattccgcaacacgcgaatctcgcagattgcattcgtacagacttcgtactagaatcgcgagagttgtcttgcttagcgtgttgctagacatgacttggggccgtagctcagttggtagagcgcttcgttcgcatcgaagaggtcgcggtttcgactaccgtcggctccactaagcccgctgcattcattccaccgcagcgggctttttcttttcctagccaccagacaaatctgccatacgtaagcgagatggggcgaaaaatcagacctgggatacgcgctgacgcacgaaagcgtcgagcgaggccgcgtcaatgccctcgtagcccttgatcgaggcgaactgcgggccgttggaattgtcgatctgcatgaacccggtctggccgatcgtcgtcgcgccggaggcgacggccgaacgcaggcccgacatggaatcctcaatcgcaatgcagtacttcatatcttccggagcgatacccaagcgacgacccgcctccaaatacggggccggagacggcttcttctcaacatcatcatcgccgcacacgtagcccgcaaacgcgccagccggcgcttggacaaccagattctccgcaagatgacgcggcgacgtggtgaccagcgtcgaaggaacgccagcgtcacgcagcgcgacaagcacgtcttccacgccttcgatccacggaatgcgctcgaattccttttgggcgacgtaatcgatcatgccctggccgatctcttcaatcgacagctggcaaccatgctccaccatgcgacgggccacatccggaaccggcgtgcccgaaccctgccaggcgagctcctcatcccaatatccgccatgcgcggctgcgattttcatctcaccctcatgccaatacggttcggaatcgatcagcgtgccgtccatatcccagaacacggccttgatcatcaggttcgtctcggtcatgatgttccttccctacgaccgtcggacgcggagcaccggatttccgggcagcgccgtccatcgcgacttccactgccatttcagcagagcggcaagacggcagcattcgcgagtcgcggcaaaacggcagacaacaaacaggcatacaagcgaggcaaacgaaaagcgcccggacggtcctccatccgagcgcttcccatatcgacgcaatacttcgcgcctacgtattcgcaaaatcatccgatttttttcacgaattatcggcaacccccatcgctataatccatgaaattcgaaaatttcacttgtatcgggagatttgaaattcactctccctgattttcactgttttccacagcggtttcagcggccttttccgcattttccgccttccagcgagcgatgcaacgttccacgcgcttgtatccgatgatcttcggatcaagcccggcctcgcggaaaatcgcggcaggcgagccaccttcggcatacctgcgcatgcaatcatcgcgaaactccttggagtaacaaatacgatactgggtgaccgattccacggcatccagagacccgagatacttgcgggtcttagctgtgaacgcaactcttggcactgtacgctcctaacctttcctgttctcgccgcatatcttaccccctcctccatgattattcatgggcaaagagaactatctttcaccgaagcaccttgacgaccggaagaatgacagttagaacgcggatactcaacattatttcccacaacgacgacatcgtcgcaggaagcaatgcatttggtaaaactatataacaaaacaggcacatctgttgccagatatgcctgtttttgaattttttttcaatgttttctgaaaatcagtcaatcccccaaagcacgatagacctagaaatcggctgagcaacgggtttacccctctcaatcccctcgttttcgcctgcgacacccccaccgcgcgtgtcgtacgcatcagccgcgacacgcgcggcctccacggactcgcgcgacggcagctgacgggcgtcgacctgaatctgccgacgccacatgcgagcgcggcgggaacgttcgatttccacaatgtcaccgtccgcatcggccgcgaacacgctggaaccggccggccggcgcaatcgctcgacttgccggcgcagctcgcggttctcctcttccaaggaaaggatccgcgcgatgccagccaggttgatgccttcttcctgactcagctgctgcgctttcgcaaggcgcgagatgtctcgcagcgaataccggcgagcgccaccgtccgtgcgttgcggcaccaccagccccaaacgatcgtattggcggagcgtctgcggatgcacgttggcgagttcgccggcgcgaccgaccgtgaacatcggcagttcgatgtcgaaaccaacttcatccgccccgtccagatcggccctgccggccacgatcgccattgcgcacatgtcgtacagcattttggcctgccgcgccgcacgggcttgggaggtccgggatgcgcgtgccatggcaatcagcgctccttggcaagttcgtcagcgaaatcgccgcactccttgtcgaattcctttgccgcatgcttgactttcaggctcggcttgtcgggaatgcggatttgcacacgcccgatcagatcgccgtcgccctgcctgttggccacgcccctgccggagatgcgcacttcggtgccgctggacgagcctgccggcactttgaaggtgacttcgttgccgtcgatatcctgtgcggtcactttcgcgcccgccacagcctgaccgacggtgattggcagatccatgatgatgtcacgcttgcgcaggctgaatttcggatcttcggcaacgttgatctgcaggtacagatcgccgttttttccgccgttacgacccggcttgcccttgcctggaatacggattttctgcccgtcacgcacgcccgctggaacatgcgtcttgaacttttttccgtcggcagacagtgaaaccgttgcccccttgaccgactggcggaaagtcagattgatcttggaattgcggtcttcgccatcttccggctgcgcagcctgctcgtagctgcccccgtaggggttgccagccccggcagggccaccagcgccgccaccgaacatcgagaaaatatcgttgatattcggattgccgccaccggtctggaagcggatgcgcgagccattgccgcccgtgccatacgctccagcgccagcgccagcgccgaacatcgagccgaaaatgtcggagaatgcccccgcgtcgaatccgcccgcaccggagccgccggcgaagcgcgcgccgcccatgccgaactgacggatggcgtcgtacttctggcggttgtctttgttgctgagcacgtcgtacgcttcggaaatgtctttgaacttttcctccgcttccttggtcttgttcagatcaggatggtacttgcgcgccagcttgcggtacgctttggtaatctcatcgtccgtggcgtctttggagacaccgaggaccttgtagaaatccttgctcagccattcattctcagccatgatgtgcctcctttcacgaggttgctgatgtcaaatgcctgttgttgttgaaatcgctgtcactgcgctagctctgcggggacgccacgaccacgcgagccgcgcgaatcacgcggtcgccgatacggtagccggcttccaccacggtgtcgacggtttccttctcggcctgcggatccggcttgtgcaggatcgcgtcatgcttggtcgggtcgaaatcctcgcctttttcgccgaacttctcgacgccgaacttttcgaacgccttgtcgattttggcggaaacggctttgaaggattcgtccatttcgctgtgttcgcgaatgcgatcgatgtcatcaagtgccggcagcagtgcggtcagcacgtcgatgatgccgtgctgacggaagcgttcctgctccttctgcgaacgattgcggaagttgatgaattccgcacgttcgcgctgaagggcttccaagtattccgccgcttccttcttggcctggccaagcggagtcagcgtatcttcaccatcttgcgtcgcaccatccgcagcatcgccgttttcttgcgattcggaagatgctgcgttcgctgcagttgctgcagaatctgcagaatcggaagttgcacttgctgcagaatcgccattattctgcgattcctgcgatgcaccggctgcaggggcggcctgcccggacaggttgtccatgtcgggcaggtcgttcagatattcgtccttgttgaagtcggacatgattacttgttgtccttgtcgtcatcgtccacgacttcggcgtcaaccacgtcgtcgtcagcgggagcggaaccggcggcacctgcggcgcctgcggcatcggcggcaccctgctgtgcgtagagggcctggccgatcttctgggcggaggtcatcagctcgctctgggcggacttgatcttctcaatgtcctcacccttcagggcttccttgagctcgttgaccttatcggtgacttccttggccacatcgtcggagagcttgtctttattgtcgttgacgagcttctcggtctgataggcgaaggattcggcctggttgcgggtttcggcgtcttccttgcgcttcttgtcttcggcttcgtgagcttcggcttccttgaccatgcggtcgatttcgtccttgcccaggccggaaccgccggtgatggtcatggactgttccttgccggtgcccttgtccttggcggacacgtgcacaatgccgttggcgtcgatatcgaaggtgacctcgatctgcggaacgccacgcggagccggagcgatgccggtcagctcgaaggtgcccagcggcttgttgtcgcgagcgaactcacgctcgccctgatagacctggatgagcacggacggctggttgtcttcagcggtggagaagacctcggaacgcttggtcggaatggcggtgttgcggtcgatgagcttggtcatgatgccacccttggtctcgatgccgagggacagcggggtcacgtcgatgagcagcacgtccttgcggtcgcccttgatgacgccggactgcacggctgcgccgacggccacgacttcatccgggttcacggactggttggcttccttaccgccggtaagctccttgacgagctccttgacggccggcatacgagtggaaccgccgacgagcaccacatggtcgatgtcggaaacaccgatgccagcgtcgtgcagcacgttgttgaacggggtgcggcagcggcccagcaggtcggaggtcatgctctcgaagtgggcacgggtcagggtttcgtccaggtgcaccggagtgccgtcaggggtcatggccagatactgcatggagatggaggtgctcgaagaggagctcagctccttcttggcctgctctgcggcttccttcaggcgctgcagggcgatcttgtccttgctcaggtcgatgccgtacttgttcttgacttcgccgacgagccagtcgatgatcttctgatcccaatcgtcgccgcccaggtggttgtcgccgttggtggcctgcacctgaatggtggagaagccgtcgtcgtccttgccgatctccagcagggacacatcgaaagtgccgccaccgaggtcgaagaccaggatggtttcgtcttccttgcccttttcgaggccgtaggccagtgcggctgcggtcggctcgttgatgatacgcagcacgttcaggcctgcgatggtgccggcgtccttggtggcctgacgctgagcgtcgttgaagtatgccgggcaggtgatcacggcgtcggtgaccggttcgccgaggtaggcttcggcgtcgcgcttcagcttcatcagcacctgtgcggagatctcctgcggagtccacttcttgccgtcgatttcaacggtccagtcggtgcccatgtggcgcttgacggagctgatggtgcggtcgacgttggtcacggcctgacgcttggcgacttcgccgacgaggatctcgccggacttgctgaatgccacgacggacggcgtggtgcgagcgccttcagcgttcacgataacggtgggctggccaccttcaagagttgcgatgcaggaattagtagtacccagatcgatgccaactgcgcgtcccataacttgtctcctttgtagataggttcgctatgcgttttctgttctattcgttctttcgcccgagtttcggtttgccgcctcccggactttccaaaacttgagcctacaccactcaactttgaatcgcaagcgattattcccaaatctacaaaaaagttgagctcccttcgctcaactttttatcagacacaatctcaagacacgatttcaaggcgcgatcaccatcgaacatcaatcaaatcgcaatctcaacaaaacctgccatctcaccatcggcagggcgcgaacgcaatccgtcaacgtttcaactgcctttcgttgacgaatcgccattaactgcaatcaaccggccaaatcaggccgcaccggaacccgcgttcggattagccagattggcggcgaccggcgcgagaagcacacgacccgtaccgcgatacacgttgaccaagccctcgccgctcgcagccgaaccgatcagcgtcttcgtggaacgctcgaccgtgaactgcaggccgttcgtccacgcgatcgcgaaattgccgtccaccttcagctcgtcgttctccaaatcgacggtcacgatttcggaagcgggcaccggcgactccaacgcaaccgttccctggcccatcagcgacaggttgaacaggccctcgccgccggccaccatcgcgctcggacgcgaaaccataaccgcatgctgctgaatcgtggtttcgcaagcgtaaaacaggccgtcgttcacggtgatggcgccgcccatctggctcggatcgagcagcagcacatgacggtaggtcggttcgagcacaaccacgccattgcccacgtattccggcttgaccgcggactcgttggtgaccgcgccacgcgccagcttgccgatgaaatcgccaacgcccttcacaccggtcgtcacttcgacatggccgacggtccactgcatggcgcccgcctgcacaaccgcgccggtcttgccattgagattgcagaccagttgacggcggcgcacgttcatttcggacgcatagtaggcgtccatggcgctgccgtacgtcacggaaaaatcgcgcttccactccatgacctggaaaatgccctgctgcgcgacaattgcggcatcgtcattatccgtcagattgtaaatacgcacgaatgctcctttgctggtaatactttgttgataatactttggatgtcgagagataatctcccggtttgcgagatagacatctcgaaggatattgtctcacaacgcttgctgcgttgaacgacccatctcattttggatttgcggcccgccctgtctgcattgacctcacgatttcgatttggcgacctcacgattcggaaaaaggcttaaaaaatgaaatcgtgaggtcagaccacaaatcgtgaagtcaccaaacctgaatcgtgcgatgaagcaaaagatccggaccacactgcaatgcgtgcgatccggatcttatttgcgctcttcagatctcttcagattttcagcggctgatcttggcggtcttgacgatcatcgcgattgcggccggatcgttctcgacggtctggtagcccatttccttggcctgctcccacacggtcttgccagcgcattcgccgccctgcacggtctggcggaagtacttggaaccaccgccgatggtcacgtcagcgcgggtatcgagcagctgctcggaaatggaaccgatgccgccgttttccttgagctggttggcaaggcagcgcttgagcgcgtcgttggagctgccgtcggtcttgccttgcggaccgtagcagccacgctcggtggagtgcgattcgagcacggccggggtggtgtactggccggtgccggcattggtgtcgccgagctctgccggctggccgactgcgtcaaggccttcgaagtggccgtttgcacccccgagataatcgcgggcgacggtgatttcggaatcgcccatgccgtcaccgatgaacaggatgacgttcttggcggtgccgttgccgatggccgcaatgcgctgtgcgccgccgtgctgagccagttccgcaacggacttgccgttcagattgtaagtggaagtttcgttggcgagcgccggtgccgcaagcgcgccgagcgttgcaacggaagcgattgctgcaatcgctcctttgagagcctttcgattgctcatcttttttcttctttcttcagcctgtgctgtattgcaatctccacgccaggtttcgcaaaccaacttccgaggcgttttggacgaacaaaacgtgaactctcgtcttcacaaagtgaacacttatctcaaatcctctttccgtcaaccatcattcccaataccccctaaatactgaattatgactcatgcttttgtcgcatgaagggcaaacggtcaggcaggggcgcggcgcgtcaggaagaggcgcgggcggaacgagtggccttgacggctacgaagaggctgcgaatcaggagcacgcacaggtagcaggcgaacagaatcgatccgacgcggggcgagaccgcgcccgctatccacgtaccgaatggcgcggtaacggcagccaccaagccaataatcagcgcggccttcacatgcaccagccttcgtttcaggtttgccacgctcgtcgtgatcgagttcggaaacatggccagcagcgacgtgcctcgcgcaatcagatcggaagcgccgaacagcatcgatagcgcgggcacggcgagcgccccgccgccaatccccagcagtcccgccaatatgccaatcaccacgcccagcagcaccaggcaaactccggtcagcgcactcatcgcaatgtgctggtcgcgcgacggcacaaaacttatctggttcaccaccacaaacacgagaaacactacgaaaatccatcgcagcacaagttccggcaagcgcgaaagcagccagctgccaatctgcccgcccacaaacatgccgcaaaacagcagcagcgcggcgagccagtccacgtttccgcaagtcgcgtacgaaatgacgccggaaatcgaggtcggtacgatcgcaagcattgacgtcgccgccgcattgcgttgcgtcagtccgagccataccagcgcgggcacgatcacggtgccgccgccgatgccgaacatgcctgacagcagtcctactgccacgccgacgatcaccagcaccgcaatgcctcgcgcggattcgtcgagtcccgcaggatccgcaccaaacagtcgatccgctttcccgccgaatttcccgctcggttgcacactcgatcgcacactttcttcagcgcgttcaacactttcagcattcgaaatattggaaatatccgatttcttcatctctcccctaccatcgcactttcttcatcttgcgataattgcgatagtacattcccacacatcgcagcgtcgcaagaccggcagaatacgagaaggaagaagagaaactacgcccgtctgccggacgagtggcgcccggcagccacgcgatcggctttcacgatgcgcccgcgccgccacagccgtgccagccatacgcacgcgaatccaatgatcgacacgagcagcccaatcacaagagccgccacagccgtcatataccccggctcgtcgtacgtggtcgcgtccggcactttcgggttcggtatgcgatgcccgcgcacgagcagcctgtgcgagttcaccccgtatggcgtgcatgtgatcagcgtcgcgtagtctttgccggattcgatgttgagtttgctgatgtcgctcggcagcactacggaaatttggtcaacctggtacgtgtaggtttcgtcgagcacgtggaatgcgaacgtgtcgcctttttgcagttcgtcgagaccggtgagcagtttcgcgctgggcaatccggtatgcccggaaatcaccgcatgcgtggtttcgccgcctacgggcagtgacgttcccgccaaatgccctgccgcgatttgcagcacgccttcgctggtgccatggtagacgggcagtttcactttgatgcgcggtatggtcacgtatcccatgatgccggtaccggttatgtcgagcgtgttttcgtatgtttgcttctgctcgtcggtcaggtgccagcggtcgccgttcgccgcgagcgcctcgttgtaggcgtgcgccgcgtcgagcatgtgctgtttttcttcgccggagagatcttcggtttgttccacgtagcttgccacggcgtacgactggtgcatgcggttccaccagtcgctgaatgttgggtatgcgatgaggcagatcgcgccgatcatgaatattgcggatattgcgattaatacgtcgagcagcgcgttcgactttttcttcggtttcttcgattgttccgaagattttacagatttcaaagattccgatttcgcactttccgcgccttccgcagaaccttccgcactttccatgccttccgtgctttccgaaaattcagcgaattctgagaatccggcaaagtcggaagagccggcaatatccgcggaatccccggcaatcttacggcgcgcttcagcagtttcacggcgcgcttcagtgctcggttctcccgattcgctgtttccgctccgccgccgtttcacgctactgttcgccttcccgctttctcgcaatcctcactacgcctaagagtaccaatgctgcggcgcagatggcggctgccatccaggccacgctctgtaccgccgagccggtgtgtgcgggcggggtttcgggtggcgtgtgcgtgttggtgatggtggtggtgtcgccttccacgtcagagagggtggtgtacccgctgggtacggaagcttcgaccaccgcccactggtgtgcggaggaaagtcccgtccacgaatgtgcccacttgttggactcgttgagtttcacttcttcgaataccacgccgtcacgcaataatttcacggtgatggattcgggacgcttgccgtcggagtcgttgcgatcgttccacactttgcgcacggtgcgttccagggtcggcttgagttgggtggagcattcggtttttggctcgatggcgagttcgcgtgatccgttggagacgccgtcttgcggcatggcgacgagcatgttggcggaagcgcactgccagtaggagtcttcgtcggccgttccgccaacagcagccgcgccagcagcgccttcgactttcacgctatcggacacgaccagatacagcccgtcttccacgccggcgaacgtgagtcgcccggctttgtcggtttcgcccgagtccacggctgcggattcgcttgccccgttcgccgcgatgagtccggcgagcgtgttggccacgtcgcggtacacttgcgcgtcatatccggttactttcgaccagtcgatcgggtatgcggtggagtcggtgaatggtgcgacgggttcgaagtttgcgccggacgagacttgcccgactttgtataggcggaaggttgctcccggaatggcgaaatcgcccgttccagcggctccagaatcggaagcgcctcccgcattagagtcagccccgtcattgcttttgcgttgatacgtaatggcgatgctgccgctggcagagtctgttggcgccgcaaccgcatcgcgagtggtgagtgcacagattgcggcggcacatgcgacggcagctgcgcagcatgttgcgacgatgcggcttgcgatcgtgtgttccttcattgccagcccctcttctgtggttctttctatgaaaactagaaatatcaagtcgcccccaacttgcgacttggaaaaattagggagtcaggctgaattctcgttagtttaggcagtttacaagggatttgaggcaatccagcctgacatatgtgggttcagttattgttcaattatttttaaattatgatgattgtgatgattccgctgttgccatgcggaggtaagtgcatggcaacagcggtttcatgtgtagttattttcagttatggtttttgattttcagttatgttgactgtgatctgtgagatcaggcgttgcggcgacgcagcgccatgaccagggttgcgccagcgagcacgaacactgccacgccagccacatacagcatcaccgtgcccatgccaccagtggatggcaggttggagcccttctggttcacgatggtggtggcgacaacaccggtggtcgtatcgccagcagtcgaatcgatcttgagcgagatcagcttcggatcagcagcatcaacgtcatgctctgcagtgatttcgaagaacttatccgctgcggtgttgtagcctgccggagtgtgggtttccacgagcttgtacttgccgtcgtcgatgcgcttgtaggaggtagtgtacttgccatccgtgcccttgacgacggtcacttcaccgagatcagtggcgtagtctttctgagcctcgtcatacttgtagagcttgaacttcggcaggtcattctcagccggggtgccgttatcgctgaaggtcttggtgatgtccagctcataggtgaacacgatgaccttatccttaggggtttcgccggtttcgccttcgccgccaacattcgggttgttggagaactcaagggaggcctcgttcgggttacccgtagagccgattacagcctgatcattcagcgtagaagtgtattcgacggtgaacttgccgccagcagcaacggtgattgccttgctatcagtgcccttgacggactttgcatcagcaatggtgaggtcgaaggtgtgattatcggtagtagccgtgttgagagtgtaggagtcagcgctaagctgcttgccttcatacttgacaaccacggattcgctattgaaagtcagacctgcggactgagtatcgtggaagaccagcttgtaggtcttgtatgcggcgaaatcagccgcatcggtcggcagggtggcggtcagctggaacggcaccttgtcattcacgtcgtagtcggcggaatcctgccatccggtggtgtcaccagtggaatcgttgatgtccttgaccttcttttcaaaggtcggcttgtcagccttacggttcacagtcaccggaccattgacccgcacgatgaacagggtggaagcatcgtcaccagtcacggcggtgctgtccttcagcaggtagtaacctgcggcagcatcaagagaggcgtccttggagaccgagccgaaagcagcaccgctcagatcaacgaacttggaaatggttgccaacttcgtagtgtcatcagcagtgctctcaagcgcagcgatcttgacggcagcttcggcggcagtcaaattagcgtttccctcgccagcaccattattttcattgaagttcttgccagcggtgacgtcacccagagtaccgtccgtgctcaaagaaccggtgaaaatctgatacacagagtaggtgtgcgtatcttcggccggcacagtaatctggtacgtgttcgctgccattgcggtgcctgcgccgaacatgccggcgacggccatggctgcggatgctgccacagcgacgaggcctttgagaaccttattcattgttctccctttctttcctttttccataaacttgttgaaatcttcgttgttttccaacgttttcaattatttttcagttattgagttattgcccagaaggcagtggtcgtttgttttacggaccatcccctcctcttctagacgtgttcattgccgacgcctcctgactttcagggccagtccggccgtcgcaacggatgccatggccacaagcaatcccgtagccaaagtcttcatatttccgtcgccgcccgtccccggcaacaccacccccggctgattctcaatcttgttgtcagcgggaccggttgcgccgtcgacagtgagcgcaacgctccatgcggagccgttatacgaacttggaccgatggtgaacttgtagacaacaccgccgaggttgtacccgtcgggagccttgttctcttccaacgtgtattcaccccaaggcaaacccgtcagtttgaacttaccggcactggaatcttcgtccgcaaagccttcgctcgagcacgcatccatgcagtcagtcacgaagtactctttagaagtggcgagcttttcaaacgtgccgtttacgccatcgtttccgtacttgaactcgctggtctgggtgactttccattccgatccggcaagcagcaaggaatcattttccgagctgacctttgaccagctcacttcaccgagcacacgagggttctcgatgatattgctggccgcgacggtaagggcagggtccttgtacaaggtgacgtctccgttcgaatcagtcaaccggaagtagtacgtaggtgtgcctgcgtgggcagtcgggttgcgggcttcctgaagctggtagatctcgccgttcgtgttgaccggcagaccggaaacagtgaacgcacctggatcggcgttttcatcacccatgccattggcaacgcatgatgatgtgcaatcggtcactgtgatcggcgttccgccattcgccgtgaacgaaccatcgcttaccttgccggaagcaatcgtccaagacgatcctgcaattttcgccttgtcggtgccatcgatcttattccacgtcaccttggtgcgagtatccgtgaacacaatctcaatggcgccaacagttgtgcccgtagcatcatccgcgttctcatgcctcgtcacggttgtgacttgaccgtcgctaattacgaatgtgtaccaaacgtctgtcttggtgtatccggttggcgcttcatgctctttcagcttgtacgtgccgtccgccagatccttgacctcgaacttgcccgcgtcagcgttgatatcgcacattacgccaagctggtcgccgttcggctcagacttcgtgcaggcagtcgtacgtgcaacagtctcgtttgcgagcactacgtcagcagcgccctgctcgtaatacacagcggcagacaccttggcttcaacgttctttgcagaaacgtttgccgcgcaaccactcggagctgtggcatacacattcgcggaggtattcaggccgctcgacttctgtacggtaatcaccgcactgtagtccgcgacatagtttccaccaccactcggcccatcccaagacgcagttccgttatcagaaccgctcttgaacttgaaagtgatctgcttccggtcatcattctgaattttgacatagctccagtcgccgcaattattactgctatagtccctggtcattgccgcctcgcgccaagagccatccgtgccgtcaaggctgtaccacaggtatggggtgctccatttgccaggattattaaagtaaatgaccgtataatgcgtatccttaggcacggtaacagtgaacgaaacggaaaggcttcctgcttttgcggtaatcgtcaccgtacctgaagcaacggcggtaactttgccgtcgctgtccaccgtcgcaacgctctcagcgctcgacgtccatgaaaccgccgtattagcgggatcaacagtggcagtgaaccgctgatagtttccctttgacaagctgaacgatgcattgttcgccacatccatattaccggttttcaccgtcagagatgtcacctgaaccgcagtgacggtgaccgttatggaatcgctgattgaatcgtcgccaacaggcttgaccgtaatcacagcagtacctggggcaatgccggtcaccgttccatcgctaacggttgcgacagcggaattgcttgactcccacttcacatcctgtgccgcattcgcaggctgcacctgcgcggtcaaagtagccgaactattctgagtaatactcagcgaatcaccagcatcaacgccatccttcagaatggtgacgctggaaacctgcaccatattgtcttcaacgatgtaagttctgccatcgttagcagtgatttcccaactggaatctgccaacggtttatcatcttcaccattcttcgtccaggaaatcgacgcggactgcggatagttcacaatcttgttgtcagaaaccggagtccaattggttccgtctgcgctctcgtaaacatcttgtacgagagagccttggtcgcccgcagtgatgcggtacaccttgctggaaatctgatagccttttggcgctccaagttccttcaggtagtagttgctgttggtcttgagattgccgacctgaatggtgccgttatcaacaccgtctttgtcagacagcgcattaccgtcagtaaccgtcgtaatcgcctcgccaccgttcgcggcatctgcgtaagtcttgtacacaccccacgtggtgccagccaaggcattgtcgttgttgtctaccttgttgatctgaatgaccgcgcactgggtagagtacgagccgttccacggcaggttgtggcgttcctgatccatatcaagcgcggaagccgagtagctgcgctcgtagttgaggaacttgtagaaagtaccgttattagtattgccaaccgcatccggattgtacatggagaaatccccgccaacccatacacgaccgttggtgctcacgtgagattcgaagctgccattcggcacgaggatgctgccgagcatgccagcggcaggatcatccttagtctccatggcaaacgacttatcccatacgccatcagctttttccagattggagtttgcgtccctacgcgtcgtagtgccactaccttggccaccatggataaccacatttgtagcgtcagcaaaattccacatgatctgctgcgcacgcttagcatactccgagtccgcataagaaccaccaagctcacgcttggtaccgctttcatcagtccaccagaaacgccaaccgttatgaaaatccacgttctttccggtcacattaatgaccacggaagcgctatcgggaataccggaaaagtcgaaactgacacccgtatagctcgaagaatcattgagaaagcttgcgggaaggttgaacacctgcatagaggctttcccgtcaccctgaaacttaattaccttctcattgacgttgttaatcgtaaaagtatagctaccgttgtcgtactcattgacgtcatatttcgtacgcttcaaattgttatagctgtccgaagaatatgtcgcagtggtaacatatacgcttccgaaccccttcagggaagacaagtcgtttgacaacttcttgatatatgtgtcaaagtccgagaacttttcattagtcgagccgatcgtctcatcagtctgtttccagctgacagtaccctccatgccgcctggcacatagacggagttcctggagtcgtaccgattggtgtcggtgttctttgatccatttcccaaaatctgattcgaagaaccaccatataccgtggtgctatcgcccgcgatatttgcggagtaggacggctcagtgttcttgttcttgccaacccagccagcatttccccaagcttgagtgcccttaacccagccaatgctcgaatcgttgctgtcacctttaacgtccagcacaacagaaccatctttaggacgatactgaccgccaaagcccacgacaccgaagcggaaaccccggtaatcctttacatagccgttcttagcaccgtccgcatcggtgaaatacgtggcccacgcacctttaagcgggtgcatcaaaagctttcctttgaccgcggttaggccttcggcttccacagcatacgacccgcttggaccgttaacatctagcatgtttccgccggtcttcttgccaacgtacatgtcgccgcccacatatgtggcgacgccggtatcttccgtactgtgacccgtatcagtgcccaaggttatggattgcggggtgcagataccgccattgtctcctgccgcaccttcggcattggcgctgtaggtggggatgaaggcggtgacggctacggaggccatcatggcaactgcgactgcggcggcggtcagggagcgggcatgagagaaggcgcgggcagataccactcgcgctcccgagtaatgctgtggcgccgagctcctcgctccgcctctgagcaatctcttcatcatgtcccctaactgcacgaatcagacccccctcagacattccgactctaacacgacatcctttgcaatatgccatctacaggagtggcaactacgccactcaacctttttctttctcccgcaccttgtgggtacgtctcaaaatgataacctttgcattcatgaaaatcactgaaacaaaaataccacccccccccccgatataaaggtggtaaaacctttgttttccagtaccgaagcgtctaatccgttctgccaactggagtttgaaatcgttcgcaaaaacgccgaggttacccctgcgatcagtctttgttaatctaaccgataccctccacggcgtgtcgcgaaacaaatgattgcaaaccgtttcattcattgcagaaattttcatgaaaataccccctagtacacccgtgtaccataccccaatttccccgtccccgccgcccatccacactcgttacaatcaacaatcacaaatcaaccatggaaatctcataacctcgcaacaggcggcaaaacctccgaccacagggataaattttcagggctcgcacactctccaacagctacatatgagacaagggcgcgtaagggatcgagccgtgacaaccaaggttgcgaaatgaactatgatgacggttgcaagccccgcatcctacgaagacggcaagtacccgagcgaaaccggaaaatccactccggatcgcacctcgacgcggtcggcaaaaagcgagtcaccgtcgtctacgacgcccaagacacgcaacggaacttgtgcagacaccaccagcagcgttgcgcagacggcggcagctggcagtatatgcaaaatacccccgtattgtcggcgtgaatcaaaacggcaagtacggaggcatgaagaagagtggcagaaaaatcagcgatctccgccgtagacggagtcggtgccgcggagcacaagctgggcacgcaccacctcatacggattttcgagagtctcccccgcaatcagcttcacggccttccgcgctgcggcacgacccatggcgaacggatcctgacgcatggtcgtcaggttcacggtgtcggcatatgcggaatcgtcgaagccgatgatcgaatagtcgcgcggcgtgcgatgcccataccggtcaaggcgcagcacgagcggaatcgccatcatatcggtctggcagcaaatgccgtcggggaactcatccaacgcaagcagcgcggtcaacgccgaatcggcgaacgttttgccgcgcggcacggaaagcacgcgccacttgaaatcgtgcgtgccctccatggtcttgcatgcgcgaatgaagccctgcccgcgcgcatcgatcgacgaattgatcgaatcgactgcatcggagcacacgtacacaatgtttttgtgcccaagattgattagatgctgcgcggacgagaacatgccgtcttcatcgtcgacggagatcgttgcgtcgaagccttcctgcgatggcgtgttgatgccgatgatcggcacatgaatacgctgcaactgctggatttcctccggttcgacgccgaacgacgttacgaacacggcgtcgacgttgcgtcgcaccggaagattcgtaaagaagtcacgcctgttctcaccggtatcgacatgctggaacagagagatgtcgtatccggcatcatgcatgacggaattgattccagcgaatacttccatattgaaccagctggtgatttcctcattcatcagcatggcgacacggtacgtttgccctgacttcagtgccgtcgcggaacgggagatattaaaatccaaccggtccgcggtgtcgagcaccttgcgcctggtacgctcggaaacgagctccggacgcgtgaacgcgcgcgaaaccgtcgaaatcgacactcctgcggccttggccacctcacgaatgccagccttgtccatgtcagcccctttgcagctcacagcatcatcgcacccctgccaacagtggaacgggtggtatttggagcgacgacgctctctcaatctgttttcattatagtgcgaacgttgtcaaaactctcgcaatatgatcaaatttcatgcgacagccgcgcaaatcagcaaaattaccggatagaaggcatagaacatccacttagtccatgaatgtttgtatccgagtttgccattgtagtagtgcacgaatgcaacaccgacgccaggcgcaatcatcatcaccgcaccgaacagaccggccgtgaacatcatggtgttttcacgcgagcgcatcagccagaaaatcagcacgaaaccaagcgtcaccgcacccaggctcatcagatgctggcgcagtccgacacgcaacagcagatcccacaatacggcaaccactaccagcacaatgtcggagatcacgagcatggcaccttggtagcgctgcgccacccatttcattgctgcgagcatggcgaaggcgatgaacaggccgaacaccggattctgcgagccgaaatcgaacggcttgcccgaagtggcgagatcgtacggcacttcggcgattagtgccagcaacagcagctgcacgccgtatgccacgcgattgcgcgtctgctggaagccttgcaccagcagccacgcgtagatcggcgcggcgaaccacgacaccacttcgcatagcaccatggccgtaagcgacgtcatgttgctcgtgtcggatccgaaaatcagtggcaccagcgtggtactgccggcggaaagcaccagcgccaccgcgccgattaccttgagctggaatacgctcaatccgcggcgctgctttttcttgcggcgcatgcccgcaaagccgatctggtcggtgacgtcggttccggcgccgttttcggtgtagccttccataagtcctcctcgagttttcctcgattccatcgcgcaagcaatcatgcgcgcacgtaatcgtctgcgcacactgtgccacgtcacgacattacgccgcggtatcgcgttgcggcatcgctgccatatgcggagcttcgcgtctcacgcgcttgcacagcattccgcgcaatatgtttttcacgtaacccctgtgcgacatgtttcacgcgattgtttcacactatgtctttcgtgctttcacgtagctttactcgcatcatcttgccattgttgcaaaaatcctgcgaacgtatgctgcaaatgtatgcaacataccttacacgctttacgaaaggtgacccccgtaaacgtggcgcacgccgcgcaatacgcgcaacgcaacgcacgccccgcaatacacgagcagtacgcacgcaatgcgaaagatcaggcgttcagcacgtaatccagcaatccttcataatcggcacccttaaacgaacgcaccgcataactcgacgcatccggatcgtcggccggcgaaatctccgtgcggaaatacacgccgtcaatgcccgccgaacgcgcaccgacaatatcgttcttctcgtcattgcccaccatcagcgcatgcttggcggtaacgaattcacggtcgagcgccagcatatacaaatcgcgcgcgggcttgcgaatcttttcctcgctggagatgatcacgtcgtcaagcacgctggcaagtcccgtcatttccaactcggcacgggtatagcaggattgcgcgttgctgagcagcgccacgacaatgccggcttcctgcagtttttcgatcatttccagcgcacccggatacaggcggatcatgctggtgctaccctgacggaacgcccacgcggccttttgagcggcctgcggcaacgccagcaaccgttccgcctcgtcgttgcgattcatgagcagcgagcggtacaccggcagcacgtcgaactcgtcccacccattgcgaacgatggcatgattcgactgatgcagcatttcgcgcgcctcaagtttttcgaaacgttcacgcagtgcctcaaccgaatcgtattgcgctccaagctcgcaagcggtgtcatacaaggcctgccaggccgcgtcgcactgttcgtcggtacgtatgtcaataagcgttccatacagatcgaagaacacaacctcgtatttaggggtatgcgtcacgttttccatagcaggtcctttcatcggcatcgtcgccgctttaccggcggcggcgattgccactttgcagccgctgcccttgcaaaccaatgcgttacatgcgttatgcacgaggttaccgcaaccgccagattgcaaacgtatgcggtggcacgatcaaataatcgccatctcccgcactgatgcacgccgcggatgcgtttgtggacgaacccatgccgcaccatacgcgagacgactccgaaaccggcgcaaccgcagtcgaggcaacgtcaatcgcgccaatatgacgtcccggattcaccgccaccaagtagtcgccgacccggaacaccagttcgtcgccttccacgctgacgatcacacgatcgccgtcaaaccattccgccgagctcttacgcaaggcgatcagtttcgtgtaatactccaccagatcgcgcatgcgccaggcacgagtccaatcaagccaattcagctcgcgcgtcgaatcgtacgaatcggaattgccgtatttcgtacgcgcgaactcctcgccagacagcatgaacggaatgcccgcggaagtgagcacaatgcccgccgccatacgattcgcatccatcaccgtggccatggccccggcaatcgcggaaccggccgaggcgagcccagcttccgaaagatcggcgtcatacaacgccttcggcacgtccacggaattctcgttgtcgccttcactaacggcgctgcccagcgatttcgcggcaagacttgcgcaaagcttgtcccacaaggtcagatcgtcatgcgcggaaacatactggatcacttgacccgcaacaccttccggctgtttgctggcacgccaggcgttcaccgcgtcgcgcacggaggccgcattctcatgcatacccccgttaacgtatccgggacggtccgagaagaacacatgccccttgatggcgtctcgcgtggtgtcgcaaaaatgcccgatgcgattatcaagctgcggcaatccggccttgtcggcaagcacggtgcccggcaaagctgcggtagcgctggccgaccacggttcgccatacataagaatgctcggcccacggtcggggatttcgtccaaagcggcgcgcacggcgttcatggtgtcgacgtcgatcaggcccatcaggtcgaatcggaagccgtcaagatggtattccctcgcccaatacgccacggattccaccacaaaacggcggaacatcgcacgttccgtggccatatcgcatccgcatccggagccgttcgacaacgccccgttcggcttgcggcgcaggaagtattcgggcacaatgcgctcgaaccagttgtcgggcgagaacatgtgattgtagaccacgtccataatcactttgatgccggcattatgcaacgcctgcaccatctgcttgacctcgcggatgcgcacggacccgtcatacggattcgtggagtacgatccttcaggaacgttgtaattgacgggatcgtaaccccagttgtatcggctgcagatcgtttcgtcgacggaaccgaaatcgtagatcggcatcagctgcaccgcggtaatgccaagctttttgagatacgacaatcccgtcggaaaatcaggatgaccgtccaacgtcgttcccaggtcggtgaacgcaagatattttccacgatgggattcggggaatcctcccgcgggatcgttgctgaaatcgccgacatgcgtttcccaaacaaccgtttgcgcaatcggcacttccggcatgcgatcggcatcccaaccttcgggatcggtgcgaggcaagtcgacgaccatgcttcgacggccgttcacgccagccgcgtgcgcccatggatcggcaacgcgatcgacggaaccgcaatcgcgttcaatcaaaaaatcgtaatataagccgtgtttattatcggcaaaatcgtaagtccaagagccatcggcctcgggacgcatcaaaaactgcccaattaaagcgtcgccgtcttcccccttggaaccgcgcgagaacaacctcaacgttattttctcggccgttggggcccaaatggcaaactgggtgccggattgcgaaaccacggcacccagcggccgttccagacaaagcgggaacggttcggcgactctcgtattcggctgttcgaaattgttttcgaggctgtttacgagcgtcattgcttcccctttttctaactgttatcagcccttgacagaacctgacatggactcctgatagaaacgctgcatcacgatgaacaggatggcgatcgggatggagatcacgaccgcggccgcggcgaagcgggcgtaccagttctggatgtattccttctgcagcatgagccacaggcccaatgccacggtgtagttggactgcgtgcggcagatcaccttggccatgacgaagtcgagccacggggtcaggaagccgatgatggcctgatagacgatcatgggcttgcagatcgggatgatgatcttgtagaacacctggaaacgggtgcagccgtcaagcagggcggcctcatccaacgaggttgggatggtgtccatgtagcccttcatcacgtagaatccagcaccggaacctgcggagtacacaagaatcagcgccacggtggtcatagcgccgcttgacaggcccaaggccttcagaatgaagtagatggcggtgacggccatgatgcccgggaacatgccgagaatcagcacgacgttcatgaaagtcttacgcacgcggaagcgcatacggctcatgcagtacgccaccgacagcacgaagatcacggagatcacgcaggtgaagcaggcgatgatgaacgtggtcatgaacatcttcgggaagtccagcacgttgcggtcggtgaacagcaccttgtagttatccagcgtccattccttcgggaagaaggagctggtgtacggggcggtgttcttgttaaaggactccgcgaacacccacacgatcggcacgagccagatcacggccaggatggcgaggaacaggtgggcgaagatgtcgccggtgacgcggcggatcttctggtcatgcaggaagccatggctttccactttggttgaggaatgcttgttgctcatcggaatgcctcctcattcttataggagccggaattgcggtaggtgatcagcgagaccacggccaacacaatgaaggtcatgatgcctatcacagcgccaaggttgtagtcctgcttatccacggtgagcttgtacagccaggtgatgagcagatcggtggagcctgcggaatcgcccagtggggtaggatctccgctggacagcaggtagatgacgttgaagttgttcacattgccggtgaaggtggtgatcaggtacggtgtgagcacgaagatgatgtacggcatggtgatcttggtgaagatctgccaccagtttgcgccatcgatcttcgccgcttcgtactgatcggcaggaatgttctgcagaataccggtgatctgcatgatggtgtacggaataccaacccacaggttgatgatgatgacggtgacgcgggcccaggtggcgttggtgaagaacggcagcgggccgtcaatccaaccccacgtctgcagcatgcggttcaccgcaccctgcggctggagcatagtgtgcatgaccagcagggatacgaactgcggaactgcgatggacatggagaagcaggcacgccaaaaacccttgaagtgggtggtcttacggttgatgatcatggccacgaacatgccgaagaagaagttcaggaaggtggcgaagaaggcccagaccaatgtccacaccagcacgcgtccgaacagtgctgcgttaacagtgccgccgctgttggagaagaccttggcgaagttttcaaagccgacccagtggaacagcacgaggtgcttgtggtcgtagctggtgaacgccatggaaatcatgaaaatcaacggaagcacagtgaacactgcgatgcccagcgtaggcaggaacatcagcaggacatgagccttggcgtcgagcagttcgtgcacatcatccatgaagctcggagccttgccgttctcttcaagcagcacctgggacttgtatgcggaacgcaccgacatgacccacaggccgacgaaggccacgcagatcacgagggacgccacgccgtagagcaggatgaccacggaacgatccggctcgacatactgccagaagccgtcaaccagtttcttgccgcccttgttttcgcccaagcttggcagcttggacagataatcaacgccattggtagccataaatacgaagaacgcgacttcaagggccagcatggcaatgcccttgacgtactgcttgcgcacgatgtttccaagaccgaatacgaccgcggaaagcttggtgaacacatcaccgtgggtcagcgcagccttgaccgtgtacggcgacgggggaacatagtcagcgccctgcttccggcggcgcttcatttcccgaggggaaagagtcgttgctgtcatttcgaccgcctctctagattttgaacataaaaaagctttgcttccggacaaggggaaggagaatgtgaaaaaccttgcccgggaatgcaaagctcggaggaggagtgagccattgcgccgaaagggagaaacaccatgactcgaagcgttgctcatatgcgccgggtggctggcgggattcggcaaaccagccacccgacgcttttcagttattggtattgggtttcaggatttcactcagcgatggtgcccttggtctggtcaatccagtcctgatacttggcagcagcgttgtccttggtgatttccttgttgaccagggccttgccgaaggtctcggccggggtccaccagtcgttcatgccagccaggccggactgcaggatcgcggtgttggccatggtgtcagcctgagccttggcagcgatgtcgtcggtggtcaggtcggacagggaggtgtcgctcggcgggatctgacgcatctcgtagtgcagcttctgggagtcggtgttgccgaggtaggctgcgaactgagcggcggccttggtgttcttggcgttcgggttgtaagcgacagccttggtagctgcgaaggacttcatctgctttttctcgccgttcacggtgaaggtcggcagctgagtagcggcgtagttgtcgcccagggcttccttcacgtcagctgcggaccaggtgccggagaacagcacgtcggcggagccatccttaatggcggcaaggccggaagcgccgtcgtcgttggagaagttcggattggcgaccacatcgaccagataagaagtaatatcggcgccgtccttcgggaagaccatgcctgcatcggcgtcattgcccttctcgccaaacaggctcagaccatcatagaagccgttgatgtaccaggaattttgcagggggaaggtgaccttggccttggaaaggatggtatcgaagtccttggcctcatcctcggtgatcttggacttgttgtagtacatgaaccacgtgttgtcggtgtacggcacaccgtagagcttgccatcggtaccggtgacggaatcgacttcgaggtcgccgttctgttccttcacctgcttctcggcgtcggtacccagctggccaatggccttggcgtccatcagaacgcccaactgatcggaagcgaacatatagacatcggccgcggcggacggatcggtgctgacctgcttggaagcgtcaccttcggagacgacgtcgttcttccaagtgatgttgtactctgggtgatccttagcgaagttctcttcgacctgacccagccaattggtatccttggcctggtcttcctgcggagcccacacgctcagggtgatgtcctcggtgccggaggcaccgctcttgccatcgccgtcggaggagccgccgcatgcagcgagcgggaccagcattgcaacagctgcggtaagtccgattgccttcttccaatcgatcttcattgacctttcctttcctcacataaccttgtgtatcttcagcgcaaccggtaccgaacgtctgatcaaactccgcatacgttcgcaccatcgtctttcaagcgggtgttgtccgtctttggagctaccggatgtgcatcagtgattgcaagtgtagcacagttttgccaacgtttgcaatctgacgttaagattgtttcagcagttgccggaaaacacgtttattccaaggagacacaccgacatgatttccccttcgacacacccctgtccacaatggctctccaacgcgatcttctacgagatctatccgcaatccttcgccgactccaatggcgacggcatcggagacattcccggcatcaccgcaaaactcggctacatcaccgaccttggctgcaacgcgatctggctgaacccgtgcttcgattcgcccttcaaagacgcgggctacgacgtgcgcgactacaagaaggtcgccccccgctacggcaccaacgacgatctggcggccctgttcgcagccgcccacgagcgcggcatgcatgtaatcctcgacctcgtgcccggccacaccagcgaggaacacgaatggttccgccacagcgccgaggtggatcgcaacgagtattccgaccgttacatttggacggattcctggatttccggcggtgacggcctgccgttcatcggcggggaaacgccacgcaacggcacctacattctgaacttcttcaaatgccagccggcactcaactacggtttcgcacatccccagcgcgcatggcagaagcccgcgttcggcccggaggcgatcgccacctgcgatgcgatggtagacgtgatgagattctggctttcgcttggcgcggacggcttccgcgttgacatggcagacagtctcgtcaagcaggacgacgccggcaaaccgttcacgattcgcacttggcagtacatgttttccaagattcgtccggaatttccagaagccgcgttcgtgtcggaatggggacgcccgaacgaatcgctggaagccggtttcgatatggatttctatttggattggcgctgggacggcattccgaacggctacaacatgctgttgcgcaacgtcgataatccgttgagcagggatggcgacaaaagctatttcaacgtggattcgggcacgccgatcagtgattttctcgagcagtacgaaccgcagctgcgcgaggcggaacacctcggaggcaccttcaatttcatcacctgcaaccacgacaccgcgcgcgtggcaccacgcctttccgagcgtgagatcgccctggcatactgcacgctgttcgctatgccgggcgtgcctttcatatattacggagacgagatcggcatgaggtaccgcgacctgcccaccaaggagggcggctacgtgcgcaccggctcgcgcacgccgatgcaatggcagagcctcgcctcgctcaacgcgagttatgcgacgccggccatcaccggcgggaactatcttccggtcgacccctcccctgacgcgcccaacgtcgccgactcccaatccaacaaagcctcactgtggtatacggtgcgccgcatgctgcatctgagggggaattgcgacccccttcaatcgagggcatccttccatccgatctcacgcagaaggctgttcgcattcgagcgttcgaccgatctggaacgagtgatcgtggcggtcaatccgagcacaaacagcgaacgtttgcaattaccgaatggtcactatcgaaagattttcgaaatcggcgagaccaaggtcgatttcaacactttgaccctcggtacgcaaagctttgcaattctgaaggcgaccgcatgacccattccgagcagtgccgtcgtcagcttcaacgaaacatgccgtcattaccatggcggcaacgccatcgcacttcggaaacagcggtggcaacgacggtaggacagcagtcatatccactgtcaaacaccttgcaaacgataggcaaacagaaaaagcattttcactatctaacgtctataaagtagttaagaaatcgcaatacttcaacgtttacacccaataacacgcctattgaaaacgatgtcatcatatgctacagtacatagcagaacggttggcatacgcaccgaagcgcgccaatcgcgtggcaatgcagcatcatcggccagcaacggccccggaaagaaggaacctatgacggcaacccagcaaaccgaaagcgcggaacgcatcgcacgaccgcttattcagctcgccaaactcaacggcatctcaacgtcgtatatcgaccagctcggcacctacgtggaaatccgcgacgaagtgctcgtctccgtacttgcggcgctcggcgtggacgcatccagcgatgaagcgatcgcggcatcgtacgaactcaccaagcagcgcatcgcagacacccttgtggaaccgaccatcgtgaagttcatcggcaaggaagcgaccacgccgatccgcgcgaagggccacgacgtgacgctacgcctgttgcttgaggacggcacgcggtatgagggcaacctgtgcatgtatttggccccgcagaccgacggctcgctcacgctcaccctgccggacgacattcccgccggctaccacacgctgcgcgtcaacgcgggcccgctgcacggcgaggcgcgactgatctgcgccccggcacgcgtaccgctgccgcctgcggttgccgaaaagcagcgttggggttggatggcgcaaatgtattccatccgctccgccgaatcgtggggcgtgggcgactacggcgatctgaagctgctgctcaccgacgccgccgaaaagtcgcatgccgatttcatgctcatcaacccgatccacgcaaccgcgccggtcgagccgctcgaaccgtcgccgtacctgccggaatcgcgccgattcatgaacgtcacctacattcgcccgcaggatatcgaggaatatgcggggcttgacgaggccgcgttggccgaagtcgagcgcttgcacgccgaagtcgctcccgccaacgacaatgccgacgaactcgacatcaactccgcgtggtggcacaagcgccaggcgctgcagctcgtgttcaaggtgccgcgttccgccgagcgtcaggccgcattcgaagcgttcaaggaggcggccggcccggatctgcgcgcattcgccgcatggtcggtggcattccagatgtggggcgccccatgggagggcacatggttcgcggagacgaaccgtgattcgccggaagtggccgaactcatgcgcgatcatgccgacatggtcgaattcgaatgctggctgcagtggatcgccgacgaacaggtgaccgccgcgcagaccgccgcacgcgaaagcggcatggcattgggcctcatgcaagacatggctgtgggcgtgcactcgctgggcgccgacgtgtggtggaatccggaacgcttcgccgtcggcagcgtcaccgttggctgcccgccggacttctacaaccagcagggccaggactggggccagccgccgttcaatccgaactatctcgccaaaaccggttatggcgtgtaccgcgaaatggtgcacaacatgttctcgcacgcgggcgcggtgcgcatcgaccatgtgctcggcctgttccgcctgtggtggattccgcagggcgaaggcgcacgcggcggcgcatacgtcacttacgactatgaggcgatgatcgcgatcctcacgatcgaggcttcccgcgtgaacggcctagtggtcggcgaagacctcggcaccgtgccggattacgtgcgcaccgtgcttgccgagcacggtctgctcggctgcacggtggaatggttcgcccgtgtggacgactcccccaacgccggcgacccgtatgccgatccggccgattaccgcgagtatgcgttggcatccgtcaccacgcacgatctgccgccgaccgcaggctacctgcagttcgagcatgtcaagctgcgcgaagaactgaacctgctcaccggtccggtcgaggaattccaggcgtccgcaaccgcggaacgtcaggccatgcttgaccgactggtcgaaagcgaactgatcacgccggaaatcgccgcggacgtcgacgaccatattcaagagatcgtcgaggcgatgcacaagatgctgctccgctcgccatccgtgcttctgcaggcggcgctggtggacggcgtcggcgaaacccgttcgcagaaccagccgggcacgtccagcgaatactgcaactggcgcgtgccactggcaggccccgaccacaaggtggtgcacaccgacgaagtgttcgacctgccgcgcgtgaagtcgctttccgccatcatgaacggcgaaaagtaagcgtcctcatataactccataaagtcccgtcacgcaccatagacgggtgtccgtaaaacagttaatcctccgtatggcttagaccatacggaggatttgtttatgtctaatcttcaaacttgctggcggcaaacggtttgtcaaaaccgtttgcggacggcaagtccacaggggatagccgctttagcggcgcaagggggtgtagccaccttgacggaacgaagtgacgaaacattctcggtcgtgcagttttcttctgctgaccgggaatgaagctccgcaggacgcactactctcgatagagagtatagaagtgcgccctttagttcctaaagggtttttatcagttcgacaaacttgaattcaattttaatgttttattagtctttacaaatcacctttgaaccttcatcattgactataattgcctggtggttgttaatagcacagatattcaaatccgaaaactcagccatgattctctcggtaattttcttaaagggtgccgtgagataatggggaagaacatagaaatcaatcaaatccagcccctcattatcttcttgagagtaatcctctggcttttcatccatttgttcaatatattgaatggtcggagcgcatataattgcgcctgccaactcaccgatcatcagttttccgtttgccaattctttcttcaacagctcatccgtttccgttttacgtagctggtccataaggaagaaagaatttccgccggtaaaatatatcacatccgcatcttcaaaaacagcctgtatcgttgaataagcctccgttgagatatcaatttcagttacagatgctcccagttttttgaatagttttcgagccgaaccaacataaccggtgtaaccttcatgcagcgaagctgttggaataaatgcgactttcttgttatcaatttcttcttttatcaaacttcctacgcttgaaaagtgcgaacataaaaacagtttcatctaaattttcctttatgacttctgatttattgctcaatttcgtgttcaaattataccataaaacttgtgaacaattctaccgcaactttggaatatatgagaaaagtccgaacagttttctgcccggactttctcgctcaatcataaatcaattccgctttcacaacttcctctgcctgtgccttgcaagcgttcatctgccgtacccattccatttggttttcagctttcagctgttcggccacgtcgtactgctttgccagctctggcatgatcagctccatgcggtttcgtgccgcttcgtcaatcttagcgcaatactgtcttatgtacacccgtctatatgtgacgggacttttttatgcacattcaatgacaacgatactaagaaagctacgcaaggaacagcagaccactactcgatgtacgcatgcaaacgattgccgcaccgccgagtagactggtacgcatgaagttcctatcacccgactccggctttatgcgcggcctcagcgacgccgtcgacgcgatttggatcaacatcctcatgttggtcaccagcattccgatcgtcaccatcggcgcggccttgaccgccggccacgacgcggcacgacgctcgctcgcaggcgaaggcaccgtcacccgcaattatttcaccgcattccggtcaaacttcgtaaaggcaaccggctattggctgattttcggcattgcaggggcgatcagcgtgtactcatggatcgtgctgcagatcacgccgctgctgattccgaaattcgcgttgagcatcgtatgggtcatcggattcgaatggatatgggcattgcagtcacgcttcgaaaactcgttctggcgcacgctcggcaacgccttcgtattcggcgtgagcaatatcgggcacacgctcggcatggccgccatcgacgcggtctatatcgcactgctggtcggcagctggttttacatgccgcaaggcctgttcctgctactcgttttgggctacggcaccatgattatgattcacgtgccgattttcgagcacgtgttccgtaaatatgtgaagtagttttctgattcggatatgaaagagcccggccttgcggccgggctcaatgctacctgagcgaggcctgtcggcctcgctcaggctggtgcatgggacagcgcactgcactgtcccacaagggatgatcgaagatcatcccttgactgcaccagccattacacccttgacgatgtgcttctggcagatgaggtagaagacaataatcgggatgatggccatcaccaggcaagccatcatagcgcccatatcgacggaaccatagccgcccttaaggtactgaatagccacggaaatcgtcttgtacttgcccaaatcgagcgtcaggtacggcagcaggtagtcgttccaaatccacattgcctgcaaaatcgcaacagacacgatcgacggcttcatgatcggcaccacgatctggaagaaaatgcggggcacggaagcgccgtcaatcattgcggactcttccaacgactgcggaatgcccttgaccacaccggtgaagatgaacacggccaggcctgcgccgaatcccaagtacacaatgcacaagccccacggagtgttgagcttcagcatatcggcgagcttcgaaagcgtgaacatcaccatctggaacggcacgatcatgttgaacaggaacagcgtgtacagcagcttcgcagcccagttgttcacacgcacgatccaccatgcgcacatcgaagtgcacaccaagatcagaatcaccgagccgaccgtgatcagcagggtccagccgaagctggcgaagaaattcgtggtttcaatgccacgggtatagttttccaatccaacgaacgccttgccggtcgggatggagaacgcatcacgcgaaatatacgccttctgcttgaaggagttgatgatcaccagcacgatcgggaagacccatgccagcgacaccaaggaaaacagtacggtccacaatccgccatgcttgaccttttctccggaaatcatgcttccacctccttggaagtcgtcagcttattctgaatcagcgcaacaatcgcgacaagcacgaagaacagcactgccttggcctgtccaacgccttcccagccgacacggccatagaaggtacgggtgatgttcagcgccaagccttcagacatgttcgacggagcgccgttcgtcaatgcgaggttctggtcatacagcttgaatccgttggtcacgcacaggaacgagcacacggtaatcgacggcatcatcaacggaatgatgatcttgaacatggtctgcgtgccgttcgcgccatccacggaagccgcttcaagcacatcggtcggcagcgactgcatgccggcgatgtagatgatcatcatgtagccgatctgctgccagcacaccagtacgaccagaccccagaagccgtacgtcgcgctataggtcagcgagcgcgcccagtgcgcgagaatgccgttgagcagcagcatccagatgtagcccagaatgatgccgccgatcaggttcggcatgaagaacaccgaacggaaaatgttcgatcccttgatcgccttggtgagcatgtaggcgatgaagaacgcgaccacgttgatcacgatcgtggtgacgatcgtcagcaatgtggagaagcccaacgcgtgcaggaattccttgtcctgcagtgcgcgggtgtagttcttaagccctacgaactcggcgtcggtaaccgttgtgaacttgcaaaagctcaggtagacgcccatgatgaatggaacgacgaatccaataatgaatgcggcgaacgttggcagcgcaaacagcgcccaccatttccgtatcgccttgccagccatgctgatcatagcctgcctgctttctttccttctccattccgatcaccgcggcaccgcggtgcggaattcctgcaattgttggccgaatcagcggatcactgctctgttctccacctttccggtatttacactcgtcatgataaacggcatgacacgaaatgtcaaacgttgtcatttttgcatgtcttgagacgcaaatttaccaacgttgtaatgtttttgattatcaaaactcgttgcaatatcaagcattttaagcctcttctgctataatgaaaacgtttgtaatgcatgtattgcaaagatgtcgcaatacagtatgttggaacgtaagcagtcacaaggaaaaacatgaaaagcagtattcaagatgtagcgcagcttgcgcacgtatccatttcaacggtttcgcgttccttcacacgcccggatctcgtgtcgaaagccacccgagacaaggtgatgaaagccgcggacgagctgaacttctccatttcacgttccgcagccgcgctgaaaaccggtcgcgcgctacgcatcgcggtcccggtttccggacggctcaacctgtggttcagctcatccatcatcgaaggcctcaaccagatcttccacgacgagggatacgacatttccatctaccagatgtcgagcatcgaggaacgtcgtgaattcttcgacatgctgccggtgcgccgcaacgtcgacgcggtaatcgtcatttccttcgatatcgacgccaacgagatcgatcagctcaagtccgtcaatgtgccaatcatcggcatcaactcgagtctgccggaagagcgcggtttcagcgcggccgtgcgcatcgacgacaagcagggatccgagcttgccgcacgccatcttatgacgctcggccaccgtgacatcgcctacattcgcaccaaccgcgaagtgacgctccacttcagcgtgcagggacgtttcgaatcgttcatggcgtgctgccaagccaacggcgtcgaaccgcgcgtgctcgtcaccgacgaaagcaagaacaacatcagcaaagtcgtgacgcagctgctcagcctcgaccatatgccgaccgcgatcgcctgccaggaagacggcatcgcggtgccgctgctgttccagctggaacgcaacggattcaccgtgccgaacgatatttccatcatcggctacgacgacagcatttacgcgcgcgacctcggcctgaccaccgtgcgccagacgcctgtcgaaatggcgcaggaggcggcccgcatgacgctcgatctcattgaggagcgcccgcttgacgaaccgttcaaaacgttcccggcgcagctgatcgtgcgttccactacggctcgtctgcatcgctaaacggtccgaacgagcaccgttcgcatagcgtctgttttttgccgccatgttgaacttcaccacttcgtgacagcgattacaggctaccgttgccttacgctatcttgtaatcgaatctttatattcgtctttcgactactgtaaatgatagcgctttcatttctgttgtacaaattcaccaatctacagcgtgttttcgtctaaaatcaaggcttttagtatcatggaagcgttaatcattttcatcaaaggagacacatggccaaaccgaccatcgccaacgtagccgaattggcaggagtgtcgcaagccaccgtttcccgagcacttcgtggcgcgaccaacgtcacagaagagacccgcatcaaagttcagcgggcagcggatcaactcaacttcacactctcaaaaagcgcttccgccctagcatccggaaaaaccatgcgcgtcatcctcctggtctcgggcaaactcaacgagtggttcaattccggagtgctccaaggggtctacgaggagctcgcgccggtcggctatgacgtcacaccggccttcatcaccgaccgcagcgaactggaccggttcttctcccagctgccgaaaagccgcaacgcggacgccatcatcatttcctcattccagctcatgcccgccatgcgcgaccagctccaagccatagacctgccgaccgtgggcgtcaacgttcctgcggaatcgggttatttcgacgcttccatcagcatcgacaactccagtgcgatgaccatggccgtacgattgctgcgctctctggggcataccaacatcgcgttctgcagcgactacattccggccgacatggtctacaacaccagccaacgcacccaggcgttcgcggatgccgcacaggccaacgccaccgatggaatcacattcagcctgcttacggccgacgcgcacgatgcgccgctgagcaaatccgacctcgcctcgcaactgaccgcgaaactgctgtcacttccggaacgccccaccgccgtctgcgtggaaaccgaccaagtcgccatcgcactggtcaaggaactacgcaagcagcagctgaatgtgccggaagacatttcagtgctcggctttgacgacgccgaaatcgcacaggcagcggatctttccaccattcgccaggagccaatcgagctagggcgcatagccggtagaaaagtgctgcagctcctacgtaacgaacctcttgaacatccgcatgaactgcaggatcctttgctggtgttgcgcaacaccacaagccgcattgacagcggggcggcgccggcggaataaatcggcgtcataaatcgacggcagctgaataaatcgagaggcagcggaaaaacgtaaagccgccaaaacgcgaaagcggcctgtatgcatgaaccagatcatgcacacaggccgctcttttcatcgcaagccttgcagggcttcaatcagcggtgcgatctcacccctgctgatcgaatttctgcgcttgaggaacggatcccaacgattcctcgttgttgttccattcggtggcccagccgtcgacgtaggcgctcttcaccttgctccaatcgccggtgccctgcgcgtattcgataagcgccgcggcgacgtcgtcctgccactgctgatccggaacggtgaagctgcgcacctcggtcttgccgtcgacagcgtaggagcgagcgatcttggtcagcggattatccggctggaactcatcgccatcgaatgtggtgaacggtacggagaagcccatatcctgggagaggatcttcttggcctcgtcatcggtgaccatccacttgatgaagtcgagcgtggcctgcttgtctttgtcggaagcgttcttgttcaccgcccagctggcgtcatacacgcctgcgggaccgctctcctcctcgcccttgatgcccatgtaatacggcagcatgccaagatcgtcgtccgctacttcgttacccttgatctgcgtgtaggcccagacaccgttcggatagaacgccacctggccaagcgcgaattcggaagtgacatcgtcgtacgtcttcgagctgaccaggctcggatcagtcgggctggtctccagctcgagatcgaacagatccttgtagttatccaagtaggtgcccttgatggtcttggagaacgtggtgttcatgtccttgtactcgtagtacagcgggatgcgccccatatgcgcggagaaacggtatgtgtcggaggcatccagacctggcgtcgcgaacgcgccgtcgacgccgagatcgtccttgtgctcgttgatggactcggccacggccttgagcgtcttgtaatccttgatgtcgtcggcgctcttgatcaccgcgtaatccttgctggcgtaatcgttgatgatcttcttgttgtagatgatgccgtaccattcagccgcgtatggcagcgtgaacgaatcgccatcaatggtgtaggagtaggccttgccgtcatcggtgagcagtttgtacgcttcggtgtcctgcaatggctcgcaatacttctgatattttgcgaactggtcgaaaccggagatgttgaacatggtcggcgcgttggacttggccagctccgagctcatggtcgcatcgtatgtgccggacgcaccggtctgcacgtccacctgcacaccggttttttcggtatacatttcggcgagctgcttgtattggtccacgacttccgacttgttgttcatgaaatacacatggcccttgtcggaatcagcgctgctgctgccgccgccgcaagccgccaacgatacgcccatggccaacgccgcggcgaccgcgcacgttttggtgatgattccctgcttcattgcttatctccttcgttggatttgttgttattcgttggacttgctgattttcgtggtagctatttgtacgtgcgccggcattgcttccggccgccgcgttatagctggagccagacggtggtgtcctgcggcaatcggccatcctcggtgagttcacccgacgcgaggatgacatcgccttgcggtagttcggccggacgttcgccgaaattggtgacgctcgcccaaccgttggaacgactgtaggcgatgactccgccgcgttgtccatccgcgccgtcccgcacgtcagatggacgatcctcgtccagccactgcagttcggtgtcctgcggcatcaggttatgcctcaacgacagcgccttgcggtacaggttcagcatggaattcgggtcggcatcctccacgtcgacggcgaaatccttgtaccatttcggctgtggtaggtgtggatcgtgctcggcgcccgcaggagagaaaccgaaagaaccatcgtggccgaattcgtcatcgggatcatcgagcttcggtgcgtctgcggcgacccagggcagcggcacacggcagccgtcacggcctttttcgatttgctcgcgcacgctgttgaacgcggtgggatcctccagcttgttccaaggaatatccgcgacttccggcagtcccagttcctcaccctggtagatgtaggtggaaccaggcaaggcaagttccataagaatcgcggcgcgggcacgcttggcgcccaattcgcggttctcctcataggtggtaccgtcgcgcagcagccaatccttggccagctgatgatgcgacgaggctggaacctgcggcaatccataacggctggcgtgacgaggcacgtcgtggttgctcatcacccaagtcgcggaggagccggaacgttccgcgctttccaagccttcctcgatggccaggtgcatgtcgtcgcgaatccagtccttcttggcgaactcgaagttgaacacctgtccgagctcttcggtcgaagcgtacagatgctggcgatccggattgacccaggcttcggccacggcgaatgccggcggattgtactcgttgaacaccttgcgccactcgcggtagatgtcatgcacctcatcacggtcatacaacgggtgcgacccgtccgagggaagcacatgctcgcagaccttgtagctttcgaggtcgtcgcggtcaagatccttggcgaggccgtgcgccacgtccacgcggaagccgtccgcaccatggtcgagccagaagcgcagcgtcttgatgaagtcggcgcgcacctcggggttcttccagttccagtccggctgctccttggtgaacatgtgcagataccactggccgtcaggaacgcgcgtccacgccggaccgccgaagcttgcgatccaatcagtcggcggctggtcgccgttcgggcccttgccgtcgcggaagatgtaacggtcgcgttccggggagcctggggcggccgcgagggcggccttgaaccattcgtgcaggttggagctgtggttcggcacgatgtcgaccacgaccttgatgccgtgctcgtgggcggccttggcgagctcgtcgaaatcgtccatggtgccgagcttcgggtcgacgttgcggtagtcgtccacgtcgtagccgccgtcggcaagctgggacgggtagaacgggctcagccagatggcatccacgccgagttcggcgaggtagtcgatcttctcggtgacgcctgcgatgctgcccaggcccgaaccgcgggagtccttgaaggaacgcgggtacacctggtacaccacggcctgcttccaccacaacgccggatcggtagtatcaatttcttgttgcaccatatgttttcactttcgttcgcatcgtcgcaaaatgatagcggttacatttcttcaaactacagataagaacatttttaaatcaacatcttttctgcttattattaataatgatagcgctttcattactgcaacgcaatccctccgacgcacggcgtgtcctacagccgtacgtcgccgcataaaaaaacgaactgcaatcaggagaggaaaggaagacttccgattgcagctcgttgcttgttcaattattcagttatgcagttattcgatcaatcacgcgccgatggtatttccgcgctacgcgacgcgcggaccgattcgtcatgcgcgattacgattggtttttcgagacgatcagtgagacgcgtcgtattcggtcttccaaccgtccacgaatgcggtcttgacggcatcccagtcgccggtgccctgcgcgtactcgaggagggcggaaccgagctggttcttccactcttcggacggcatcatggtgaagttccaagagactgcggtcttgtcagaattctgatcttcaacagcggcctgcaccagcggattgtcggacttgacatcgctgaaggacttgaacggagtggtgaagcccatggcgctggacagggactcgatgccggtcttgctggtgacgacccacttcaggaaatccttggtggcctgcttatcggcgtcggaagccttggagttaatgcaccagtagttctcggagccagtggccagaccctggttctcctcgcccttgacgcccgtgtagatcgggagcatgccgatggactcggccttcatgccgttcttctgcagatcggtccatgcccaagtgccgttctgatagaacacggcctcgccgagggagaactcggaggtggcgtcatcaccggtcttggagctcagctgggtcggttcggtggtggaatccttcaggtacaggtcgaagatgttcttatactccggcagataggtacccttgacggtcgccggctgcttggtgatgttgtcatccttgaactcgtagtacagcggcaggttggccagatgggtcttgaagcgccaatcggagctggaatcgaaaccggcggaagtgaatgcgcccttaacgccgagctggtccttcttggcctggatgtcatcagccacggccttcagggtatcgaaattgtcgatatccttgacgtccttgatcttggcgccatcggtggcgatgtacttggccagcagatccttgttgtaaatcagaccataggtttccatagcgtacggaacgccaacgaccttgctcccatccttgagggcgacgtccttgttgatgagctgcttgtacggctcggtgtccgtcatgtcatcagtgtaggacttccagttctgatagccgaccggaccattgacctggaacagggtcggggcttcggacttggcgatctcggacttcagggtctgctcgtaggtgccggaagcagcagtctggaccttgacctcgacaccggtttccttggtgtaatccttggccagcttctgccattcgtcgttggattccggcttgaagttcaggtaatagaccttgcccttgccgtcgtcggagctggagctcgatccgcaagcgcccaacgtgcctacggacatcgccgcgatggcgaccattccaactgctgccttgatagtacgattcatcatcgaacctttctcttccattcctgtttcccagcaccccgctggtcaacatcctgtgaaatcgcttcctcacgattcctgacatgcactattgtgccgcatttctcccgtttttgcaaacgtaagcaagaaaaaccatttttagagtgattttacgatcgcaggtttttctcaaaatactttattttcaacggttttcatcacactgtctttatgaaaccgtttgcgacacaccctccatatcacacggcaacaatcgcagtgaatcgcgaacctgacgccgtacggcaacaaaaaacgtcggcggtttgtaaacgatgtcaaactaccgacgctcagcccagcgcaacgcacctagcaattccaatgctcgataacgttgtctcccttatattggctcagcacgcaataatgcgcggtgtcgaggcgcagcaaacgcgcgaaatgcggatcgacgtccagccactgcgaggtgaggatgcgcaacacatgcgcgtgcgccaccaacagcacgtcatgaccggcattgagcagcggcatcaccgcgtcgatcgcatcgcgggtgcgcgcggcggcctcctcaaccgtctcgccagggccattgtgcaccggaacctgctcgccgcttggcaacgtctcaacccagtcgccctccaacgattcgggaagggaacgcggaccgtcgcgccatacatcccactggaagccgccagcctcgctcacctcctggcgtgtacgcccttcggcacggccgtaatcccattccgcaatctcgtcaagcactttgaaatcgccataaccagccagttgcgcggtctgctgggcgcgacgcagggggcttgcgaacatgcagccttggtcgaaaccattggggaacgcctcacgaagacgctcgcccgccgcacgagcctgctcgcaaccggtatcggtcaacggaatattggttcggccggtatgctggcccgattcgctccacacagtctggccatggcgcagcagtaccaggcggccgggcgcgattgaagaagcatccttgcttccgacttgagtatctgtcatactcctactctagccgacgaaaagcgtttcaccagcaatcttccaccacgtgtcttaagcgcttcgcaacgcacgcatgcgccggcgaaatccaaccgaaatccgacggcacggtctacactggaaatcatgagtgaaatgcctgacccggaatccagcgcagaccgcatcgtagcgtcgctgcataacgtcgacgagaaagtgaatgccctgcgcgaacagcgaatcaacgatcccgacgatctttgcgacaagatgttcaaggtggccgcccccacgctggccggactcgtgttcggcaaactgttcgaactggcatggcgcaagtcggtcggccgcaaagccgtgttgccggacggcaccaccgacaaacgcaaggaactggcgctgaatctcgtgttcggcgtggcttccgcaggactcggcgcgctggtatcgcaactatccgaccgcggatcgcaggcgctggtcgatcgccgccactcccgtcaatcgcgccgaatccgctgaaaccgtggaatccgctagatttgccgataagcgcaaatttcgccagatccgcaaacaatcccactccaacttccatatttcgaagcgtgcgattcagatctgcaattgaagctgcggctggaaccgcacgaaactgcacgaaactgcgattggaaggaatgcgcttgcgggcgaaaatacttgcgcaattacgcggatgggatataaatagtcaacatgagtaatattctgcataatgcaactgtcgacactctgctggagcgtcgttccatccgcaaattcaaaccgaagccgctgagcgacgatatcgtcgaaactctcgaaaccgtggcccagcatgccgcaagcagccaattcctgaacgactggtcggcaatccgcatcaccgatccggccgcaaagaagcgtcttgccgaaatcggcgggcagccatatatcgcgaccgcgccactgctgtacgtgtttgtgcttgacgagcatcgcaatgcggccatcgcagcttccaagggcgttgagaccgcttccgacgagtttacgttgaatggcagctatcgttacactcaggcacagaatgacgcagttttggcgcttcatgcgatggagacggccgcttattcgctcggccttggctgtgtgattctcggctcgctgcttaacgatgttccggctttgattgatctgctgaatcttccggaatacacgtaccctgtgctcggacttgcgattggcaagcccgatcaggatcccgcactcaagccgcgtatgccgcgctccatgcagttctttgagaatgagtatccgtcgaacaatgagacgttgcttgccggtttgcaggattttgacgaggaagtgcatcggtattacgatttgcgcaataccgagcgcccagttgatccgttcagcgatcagatcgcgtcgaatgcggtcgattccggtgtgaccagcaaggccgtggctccaaacgccaagcgccaaggcttccgcctcgagcgctaacggaactacttacgacgtggtttgtagccttttttgcgggaatgcggtttaatctgctgattgaagggcacgtacgtgtagctggattgtggatcgcgatgtgtgagatgccaggttccgcagaattcgcaccgatacacccatagttcagtgccgcgttcacgccagctctggtcggcggcctgccgggccgtcgctttgtcgcgatacatgattttgttcgattcgacgcagcgtttgggtacgaaataatgcatagttccccagtctattccaccatcggataagggcaggaagctcccctggaattcctgggatcccccagcgtcccgggactcccagtgggtggaggaatccgcccgcccacgggccttccggcggaacaaaacacccagtgggtggaggaatcatcccgccggcagtccttccggcgtccaaaaacctccaccgaatggaggaagacacccgtgcgcgggaataaaaaaggaccttccgggaaccccgatggggctcgaccggaaggtccataagttgaatgcggcggcgtgctactctcccacaccctctcgagtgcagtaccatcgccgcgaccaggccttagcttccgggttcggaaagggaccgggcgtctcacctgggccatgaccaccgcaaaaccaatataacggccaaccacaaggatcggccggcagaaccggaaccacgccacgattccgatcgtggcggtccgggaaccggacaacggacgcgagcaaaacgcttcaccggtatcgtttccgtgaccacaagaaacaatgctccttgccatccaacgaaagaaaccaccacaggacgagacccgacccaacaagcgggtcggaaagtgtgccgcgttcgcccgttagtaccggtcggctccacccctcgcggggcttccacctccggcctatcgaacacgtgttcaacatgcgggctacaggcaccgaagtgccaaggaatcctaatcttggagcaggcttcccgcttagatgctttcagcggttatccctcccgaacgtagccaaccggccatgccgctggcgcgacaaccggcataccagaggtccgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgcccgaaccgtcgttctcgcagtcaagcccgcttgtgcgattacactcgaaacccgattgccaaccgggctgagcggacctttgagcgcctccgttactctttgggaggcaaccgccccagttaaactacccgccaggcactgtccctgaacaggatgactgttcgaggttagacgtcaaacgagaacagagcggtatttcaccttgcggctccacacgggctggcgcccatgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcaccccaaaaggggctgacggatcctcttaaccttccggcaccgggcaggcgtcagtgcatatacagcggcttgcgccttcgcatgcacctgtgtttttggtaaacagtcgctaccccctggtctgtgccaccccccaacgctccgagggcaagcctcttcacgcccgggggtctcccttataccgaaggcacgggagtgatttgccgagttccttgaccaggattcgctcgatcgccttggtattctctacctgaccaccagtgtcggtttggggtacgggcggcgacgcccctcgcgccgaggcttttctcgacggcctggaccaccggatatcgcgtccaaaggacgcccatcatcacacctcaccctatgcgtcccacggatttgcctatgggacgggctgcgtgcttgaccacggaaaaccacctccgcggccggctcccattccgtgtcacccctgtgcgctagcctaccaggactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccacaaggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctcccgcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaacccaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccaccaggggcatccggaaaaccgcacgcacccaaaacggatgcgggtggcggtccgggaacccaaaagcatatccgcaccactccccgccggccccaaggacccgcgaagccaacgatctcttccacaccagcacgcccacacgaacccgggaaccatccccggcgcatgggccacacgacggacgccagaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaaactttgcagaaagccaacatgtgactctcaaaaacaagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccgctcacccgcctcgaggcaccccaaccggggaaccactcgccgagcggcagcgaagagtcaatttacacgaaccccggcgatcacgcaaatcgacccttccaaagataccctaaaaccgttgcaaataaacacatccctcggcgtgtcccgattccgtccatctgaatcgtctttctccttttccacagaaaccagctcatccttccggaaaacatgttcgtcgtatgagtcgccttatcaggaattgacggaacgatacgttgaggggattctgttatcctgtggggcgcagcggagcaaaatggcctgccaagacgggatggtccctttcctgaacaggcttttgactcaaatagaagacggatcgaatattccgcagtgataccgtgaagggagggaacggcatggaggcgcagcctatgaggctacaggacctgagactcaaagaaggaatgtctctagaacagctggccgagctctccggcgtggatcatgatcgtctcgtcatgttcgaaaacaatccggaaaccatacgcaatatgcatttggacaccgctcgccaaattgccaaagcattgcactgcaacgtgttggagctccatcccgacgaaggttggagaggcggaatccactgcgctgaatccgggctaagagacattcgtcggactcgcggctatacgcaaaacgagttgtcagagatgacagggattccccagccgaacatctcttggtttgagacaggctatcgctcgacctcaggcatgcggctggatacagccaggcgtctgtcggaagcgcttcgatgcgatccgacagatttcctaaaagaagcgtatagccgatatgaaaataaatgttgtatctgatttagataaaacacttaaatttcatcggacgccatacttcaacaaacgaatgcatcccgcgcacctcccatctcaccaaaaagattaggcaagaaagaagcccatcaatcattgacttcacaaacctttcccttccagaaagctggataacgtccgagattttgcgcactttcggacgttatctggcgcggaggacgcatttgcgcagttcggaagcgatgagcacgatcatggcaaggccgaggcattcgacccatgcgccgacgctgagcggtaccgtaccgaaagcggtgttgaggaacggaatgtaaatcaccgccagctgcaataccatgctcagcgcgatcgcgccccatagccacttgttggagaacagtccgacgaacgctgactgcaagtgcgagcgcgaggcaagcgcgttcagcatttgcgcgaacacgagaatcgtgaagcccatggtgcgtgcttccgtcatttgtgcgtcgtgaccgatcgcatcgacggaacggtcggtgaacagaccgccgtccaagtgcatgtccatgccgatcagggtgacggccgccataatcacaccgatgaaaatgatgtcgccccacatttcggcgtcaatcacgcgatcggtgagtttgcgcggcttgcgcgccatcacatcgtcggtggacgggtcgacgcccatggcgagcgcgggtgccgcgtcggtgagcaggttgatccacagcagctgcgtggcaagcagcggcacggtcacgccttggctgccgggctgggtgatgccgaggaatccggcgagcatcaccccgccgaacacggtgaacacttcgcccacattggagctcagcaggtagcgcaggaacttgcggatgttgtcgaaaatgccgcgtccttcacgcacggctgcgacgatggtgctgaagttgtcgtcggcgaggatcattttcgcgctctgcttggtcacttcagtgccggtaatgcccatggcgacgccaatatcggcggttttgactgcgggagcgtcgttcacgccgtcaccggtcatggccacgatattgccttgccgttgcaaggattcaacgatcttcaacttgtgttccggcgcgactcgcgcatagacggacacttcactggtcaccttgtcgaatgccgcttcgtcggatagttcgtcaagctggctgccggtcatggccgtgccgcccttgtcgataatacccagatcggtggcgatgcgcgccgcggtcagcgggtgatcgccggtaatcattaccgtacgaatgccggcgcgatgcgcttcggcaaccgaatcacgcacttccgtacgcggcggatcgatgatgccaaccatgccgacccaaatcaaatcgttctcaagcacatcgctttgttccgcaatatcggcaacatgacctgcggaattcagcatgattcccggcacttgcgcaagagaagcggtaccgagcggacgataagcctgacccaacgtgcggtatgcgtcggaggaaagctgttcgacagtcgcaagaatctgctgacgatcaccttccgtaagtggacgtaccgcaccgccgaccgcaatcctgctgcaatatccaagaagcacatcgggggcacccttggagaagacggtcagacggccggcgtcagcgttgtcttgcgccacgatggacatgcgcttacgttcggaagtaaacgggatttcgccaacgcgctcgtagttggcgtacttgcgatccgccttcacttttcgtgctgcgacgatgagtgagacttcggtcgggtcgccgaccgcctcccacgttacgttttccgcatttccggcagaagcagcagattcgcgcagttcgccgtcattcgccaacgcgcccacggcaagggtcgcaacggcttccgattcgatgatcccgcgtatttgcgcatgttccatggtctgtggatcgaccaccatgcggccttccggcgcatagccggtgccagtaagctgcacttcgccgctcggagtgaccacacgctccacggtcatctcattgcgggtgagcgtgccggtcttatcggagcagatcaccgacgcagatccaagcgtttccaccgaatgcagcttcttgacgatcgcattgtgcatggccatgcgctgcacgccgagcgcgagcaccaccgtaagaatcgcagccaaaccttccggcacggccgcaaccgccagagaaacggccaacagcagcgaatcgatcacatcgtgaacgtcttggaagccttcggtaagcgcgagcgcgaccaacaccacgaccgcgatgatgcataccgcgctgccgaggattttggaaacgtagttcatttccttttgcagcggggtttcgtcgtcttccgtggcttgcagcagatcggcgattttaccgacctgcgtgcccatgccggtgctggttacgatggcgcggccggtgccttgcgttacggacgtgccgttgaacaccatgttggcgcggtcgccgagggccttcgcctgtgcgagggtgtcggtctttttgccgacgggcacgctttcgccggtgaggctggcttccgcgattcgtaggctggcggcggcgaagaggcgtccgtccgcggaaacggagtcgccttcgccgagcacgatgatgtcgccgagcaccacgtcaaccgtgttgatgcgttcgattttgccgtcacgcagcacgttggtttgcggcgcggtcatgctggagagcgcttcgacggcggcttccgccttcgattcctggatgtagccgagcaccgcgttgacgatgaggatcagcacgatgacgatggcgtcgaacggcaatgcttcgccgccttccacacccggtacggcgttggcgcgttcaatgaaccatgcgacgagcgaaatgccggttgcggccagcaacaggtagacaagggggtctttgaattgttcgaggaatttcttccatttcggcaccggcggtgcggacgagagttcgttcggcccgtacttgtcgagacgccgcttggcttccgcttgactcaggccggtattcaaatcgacaccaagcgattgcgctacggtttgcgcatcggcgagcgacggatcgacttgcgtttgcgtcgcgatatttttcgcttgttcgaaatttcccgaactggtatcgcggaattgggtggattgatcttccttgcgatcaaccatgatgatctccttgggagcgccgcggagtagtcagcactcccctgccgttgcgatagtgcgaaaactgcggaaaattgcgattttcacagattccgtctgacagggcaatgctgcgcggttgtggacaccggacgtgcgccatcggtgcattcctgccattattacacaccgtgcccattttgcaagactgcaacgcaccgtcttttgtcaagatttcacaaaatcgtgaaacataatctgcaatcttatttcgaccgcgcattcgattacacggcaacaccgacggcaatgtcgctaccatctttggcggaagtgtgatatgttatcggatgttagtaaacaaaattacttacgctatgattcgtagcgtacattggcaacgtcgcaatggataggggtagttactatggcagctcaagaagaagccacgcaattgcaagaatcacaggaaacgcaaggggttccggaatcgcgcatcctgcaggcgcggcaggcgaacgcaagctggctcaccgatccgaccgcattcgcggtgaatcgcaagcccgcgcactccaatcatcggtatttcctgggcgaagccaccgaaccaaagcagaatctcgacggcgaatggaaagtaaacgtcactcaggcagccaacgtcgacgtggaaaacgcgccgttcgccgcagctgacttcaacgatgccggtttcggcgcgatcaacgtgcccgaacacctgcagatggccggctatttgaagaacaaatatgtgaatgtgcagtatccatgggatggccatgaggatccgcaggagccgaacgttcccgaaaacaatcatgtggcgatctaccgccgttccttcacgcttgaccgtccgatcgccgcgacgctggaaaatgacggcaccgtcagcatcacgttccacggcatggccaccgcgatctacgtgtgggtcaacggcacgttcgtcggctatggcgaggatggtttcaccccgaacgaattcgacatcaccgaagcgttgaacgttgacggcgacaacgtgctcaccgtcgcctgctacgaatacgcgagcgcctcttggctggaagatcaggatttctggcgtttgcacggcctgttccgttccgtggagctcgccgcacagcctcgcgtgcatgtcgaaaccgtgcagatcgaagccgactacaatccctccatggccgccggaacgctgaatgcaaccctgcagttgcgcaatgcaaacgacgcggccaccgtcaaggcgaaactgcgtgacgcaaacggcactgtggtgtgggaatccacgcaatgcgccaacgaaaccatcaccctcaattccggcgcgctgaagaacattgcgccgtggagcgccgaagagccaaccctgtatgagctgacggtgcttgtcgtcggccacgacggcccgctggtcgaaaaaaacgtgcagcgtatcggcttccgcacattccgtatcgaagacggcatcatgaagctcaacggcaagcgcgtggtcttcaagggcgccgaccgccacgaattcgacgcgaagcgcggccgcgccatcaccaggcaagacatgatcgacgacatcacgttctgcaagaggcacaacatcaacgccatccgcacctcgcactaccccaaccaggaatactggtacgacctgtgcgacgaatacggcatctacctgatcgacgagaccaatatggaaacgcacggcagctgggttgcgaacaacatcgaaacccccgaaactgcggtgccgggcagcaaaccgcagtgggagggcgcgtgcgtggaccgtatcaacagcatgatgcgccgcgattacaaccatccgagcgtgctcatctggtcgctcggcaacgagtcgttcgccggcgaagtgttccgcgcgatgcacgcccacgcgcacgcgatcgacccgaaccgccccgtgcattacgaaggttccgtgcatgatcgcgcgttcgacgacgtgaccgatatcgaaagccgcatgtacgcgcacgccgacgaaatcgaggaatatctcaagtccgatccgaagaagccgtatatttcctgcgaatacatgcacgccatgggcaattccgtcggcaacatggacgaatacacggctttggaacgctatccgcaatatcagggcggatttatttgggatttcatcgaccaggcgattctcgacagcaacggtcgcatgtgctacggcggtgatttcggcgaccgtccgagcgactacgaattctccggcgacggcctgctattcgccgaccgcacgccgtcgccaaaggcgcaagacgtcaagcagctgtacgcgaacgtgcatatgaccgtcgatgcttccggcattacgatcaccaacgacaatctgtttgtttcgacggctgattccacgtttgtgttgcgtattttggctgatggcaagcccgtttggtcttcttcgcgccgcttcgacgttgccgcaggtacaagcgagcatgttgagatcgattggccgatcgacgattaccgcgcaggtgcgcaggaactggttttggaggcgtcccagcagttgacttccgcttgcgattgggctccggctgggtatgagctttcgttcggccagtgcgtggttgcgggtggcaagattgccgatactgttacggccgcttccgccgcttccgatggagcgatcaccttgggccgctggaatatcggcgcacgccgtgcgggccgtgaagccctgttctcccttgcacagggcggcatggtgtcgtacaagcttggcgagcgcgaattcgtgttgcgcaagccgctgatcaccacgttccgtgcgctgaccgacaatgatcgcggcgcgggccatgcgttcgagcgtgcgcagtgggcggttgccggaaagtatgcgcgttgcgttgatacgaaggttgagccgctcggcgaaaccgcagtttccgtcacttacacgtatgagcttgcgattgcgcagcgcacgaaggtcaccattcgttacgttgccgatgtgcttggccacgtcgatctgcatgttgcatatccgggtgaaaaggacggcgatctgccgacgattccggcgttcggcattgaatggatgctgccggtcgagtattcgaatctgcgattctatggcgtaggcccggaggaaacgtatgccgaccgcaagcatgcgaagctgggcatttgggatacgaacgccttccgcgatcgcgcgccgtatctgctgccgcaggaaaccggcaaccatgaggacgtgcgttgggctgagattacggacgattccggtcatggcttgcgcgtgagccagactgcgaatactgaaaccggcgttacgaagccgtttgcgatgagcctgctgccgtattcgagcacgatgcttgaggaggcgctgcatcaggacgagctgccggagccgaagcacatgttcctgcgcgtgctcgccgctcagatgggtgtcggcggcgacgattcctggatgagcccggtgcacgagcagtatcagctgcccgccgaccagccgctcaacctcgacgtagccctcgacctgttctagtttcaaggattcagtcgattcctacgtgcgaaatgtctcccgattcttgatttcaaggatcgggaggcattcgttgtgccgcaagttgactttcggcctcacgattcgcagttctgtctcacgatttcgcaagatcgtgcgacaattcggaaaaaacatgcgatcagaccatcaaaatggacgatgagggggattttgttgatggcttaaattagacggattgcctagaatgggggcagaacttccgaaacgttcgagcgcaggcgggcaaattcgcgcgcgtccgagcgtcacgaagcacgctcttccaggaaaggggccatcatgagcgacgcaatgaacaacccgtatgcgaacaatccgaatcaaaatggcagcaacgaacagcagccgcaaggccagccggaatacggggcatacgcaccaaaccagcaatcgcaatcccagcagcagggcggcaatcccaacaattcgggcaatccgtatcaaagcgagcctcagaccccatgctacttcgacggtcccaacgccaacccgaatcccaaccagaacggcttcttctacgcgagctacaccaccggtcagccgtacggccaaccatacggacagcagaacagccaatccgacgctgacaacggcaccaacaattggcagccgatcagcccattcaagctcgtggaggaatggctcccgaagaaggcaaagaacgcgatccgcggcacgtatgcggtactcggcatcgccgccgtcattctcggcctggcactgctgatctggccgggtgccacactgaaggtcgccgcaatcgcgcttggtgcatacttcgtggtttccggtgtggtccgcattgtgaccgcaattgtggaactcgggcttccgggaggatggcgcgtgcttgacattctgatcggcctgatgctgtctgtcggcggtgtggtcatgctgaaaaacgcggcgctttccggagccacactcgccgtgctcatcaccatggtggtcggtctcggctggatgctggaaggcgtgatggcgctcgtggaatcgtggcgcatgccaagctccgcatgggccgtaatctacgcactgctgtcgatcgtcgccggcttcatcgtgctgttctcccccgtcagctccacgacctggctgatcctgttcggcggatgcgcgcttgtggcgatcggcatcgtcgcgatcgtacgtgcgttcaccttcggcaagtccaagcgcaagtaattttttgcggcgcgggccgtaaagtctgattatctctgttttcccaggggcaccaagcaacagctcggtgccctttccatagcgaaatcgctttttataccaagattcaaagtcgcacaaccatgaatcttggtattaatactggtatataattgggtatgaaattcggttttaagaaaggtttatcatggcaagcgcacttgacatactcgatgaccttgctccaatcagcgagctcagcaatggtcgtacttccgcattgttgcagcgggccgaccacgatccagtcattctgatcaaacgaaacaagccgtcctacgttctcatgaatatcgaaaactatcgcgctctcatggaacgaatcgaagacaacgaagacttgcttcttgccgaaaaaagactcgacaacagtactggcacaactatcagcaacgaagaggtcatgctcgatctcggcatttccccaagcgacctcgccgaggcacctgagccggaactcgcatgaactggcaagttgaatggcttgacgaagccaagaaagacatgcgcaaactcggcaaagccgagcaaatccaagtactcaagggaatcgagaaagttcgcacaaacccactgcccacctcgcaaggcgggtatggcaaaccgttacgcaatgccgaacgaacgaaactttccaggctttgcaaaatcaaattcagggatatcggcattcgcgttgtttacaaaccgttactgcgaaatggaatcatgaccatcatcgtcgttggcattcgttccgatagtgacgcttacatcaaagccaacaagagacgcaaagaatatggactataagatgcgtccgccaattttcagcgaacgttactttttcttcaagattagccgatgattttacaaaagaagtgacgatcgtcgcatgacattgtcgacttgcccgacgtaagatgaaggcacaacagaagaacgaagaaaagaaaatagacaacaaacacagacttacggcagcggccagaggaatggacaagaaaacagatacgcgccgccaagccgaacgaaaggaaacatcatgaagaacaacactttcaaccaggtcatcaacgccaacctcgcttccatcgatccgggcttcggccagttcgcactcgccaaggcttcctccgacctcttcaagaaggtcctcaacaagtaagaccgcttcctagacgggaggcaaggcgcaggcgccacagcacctcgcccctcttctttccaatccttaaatcacatagcgggaggccgcggttccaaacggaatcgcggcctcccgcttttcacgtacgccggctacccctcctcaacagcgagattgcgggcggcggcgcgttcgcgtgggccgcgcgtcacgtagaagccgattgccacgatgacgaacatcaccgtgcagcagatccacagcacacggctgccgaacgcgttgagaatccagcctccgaccaacggcgagaacgcgttcgacagcgaccacaccaggttgtataacccttggtaggtgccgcgcacatcctttggcgcgatgttcgccaccgttgtggcggcaatcgggaacgtgcccagctcgccaagcgtccacagcacggtcgcgattgcgaacgccacccacgaattcgcgccgatctggaacgcgtatccgaccgccgtgatggacatgccgagcaccagcactcgggtgttgctcatccgctggaacagaccgatcgcgggaatctgcagcagacacagcaggccgccgttgatggtcagcagactggaatattcatccgtgccaaggccgatctgcgtcatggaaatcggcaggccgctgacgatctggtaatacgccagcgtgtacaggaacatcagcaccaccatcgacatcagcgcgccgtcggcgcatgcgcgacgatagctgcgccatacggagaaccgctgcggccgctgcgattcgccggtttgtttcacagcatgttccacggcatttcccgcagctgattccgcggcttgcgacgcccgcgccggcgcgacctcgccccgcgggcgcttgcccagcccgacttccttgaagaacacgatcatcaagatcgtggcgaacaccagcaccgcggcttccgcgtagaacatcagcgcataggagatcttcaccaactggttggcgatgatcgggccgatcgcgaagccgaaattcgcggcccacgtctgcagcgaatacgcgcgcttctgtttgcggaacggcaccacgtcggacacgtacgccgcgaccgcgggcgtcggcatggatgagatggcgccgtaggccagcagcgcgatcgccatgatccacggattgccgatgaacgccagcaggaccagcatcgcggcggagccgagattgccgatgacgatcatcgccgggcggccgaagcggtcggacagcgcgccgccatacaggcagccgaagatgccgccgaaaccgtacatggagacgatggtgccggccacgcccgcgctgacatgcatgtcagacaccagatacatggaaaggaatgacgtgacgaagcggcccatccacaggataagcagcgtgacccacaagccccagaacatgaggggcaatccgaaaatctctttgttcttctccattcttgccatcatatcgagcaatatcgagcggacgcgacgccagtagccttttcccggggtgctgggagaatggacaactatggcaatgaaaaaaggaccgaccaaggggtcgggtggaaagcatcgtaacgcgctgaggggcaagggaccgacccccaaggccgaagatcgcgtatatcacaaggcttacaaggaaaagcaggctaccaatcgtcgtaagatggctgatccgcgactggcggcacgccgtcgcgcggcaaagttcagctcagaatccgacgatctcgtcatcggtcgcaacgccgttctcgaagcgttgcgctgcggcgtgcccgcgagcacgctgtatgtggccgcacgcatcgagcacgacgatcgcacgcgtgaaatcattcgtctcgccggcattcacggactgaacctcatggaagccgaccgactggaaatggaccgtatcgcacgctcctccaaccatcagggcgtggtgatgaaggcgcagccgttccagtattcctcgctcgccgagctggtggaacgcgcggacaagaagtctcgtgccatggaagcggccaactccgcaagcgcacgcattgcggcacgtccgctgttcatcgcgcttgacggcgtcaccgatccgcagaatctgggcgcggtcatccgttccgcagccgcattcggcgccaacggcgtgatcctgccggaacgtcgttccgcttcggtcaccgcagccgcatggaaggtgtccgcaggcgcagccgcgcacatgccagtcgcccgcgtggtgaacctcaccaaagccattgaaagcctgaaggaacgcggatactacagcgtcggtctcgacggtggcggcgacgccctcgttggcgaaaccggtttcgaaaccgatccgctggttgtggtgctcggttccgaaggcaacggcctgagccgtctcgtacgcgagacatgcgattccatcgccggcatcccaatgtcgaacatggtcgaatcgctgaacgcttccgtcgcagcgggcatcacgctgtattccgtcgcacgcgcccgccgcgaggccggtgccgccgctgacgcgaagtaatcaacacgaagcgacaggaagtaagcacagcgaaactgcagaagtaaacacaacaaggcagcaagtccgaaatacatatgagcggatagtccatacggattatccgctcattttgttgcgcaaatctgtacttggattgattttgcgcttaccgcagacccactcccccgccaacgatctctcgcaacacgttctctcactttcaaaagtcaaaatttttttgagttttgaaagtgaggggtgtgaagggataacaaaagcggaggattattagtggtcctccgcttaacggctcggccctgaaatttttgactgcggctacgccgcagactcaatactgccttcggcgcggctatcgcctcgtctcagggcatattgatagaaaaagctccactggagctttttctatcaatgtgcccatacagctgcgtcgggatcgtcgtcggggttgtagccgtcgtcgggatcgtcgtaggtgtattcgtcgtcgatcacaccggaatcggcttcggcgttcaacgcgtccacatccttcgtggtgagcttgtactgcggaagcaccttctccacatagctttgcaccgcctcggccatcggcacatcatgacccgccttctcggccaggaaccaacggtggtcaagcacttcatggaagaactgagccggttcgatctgcgaacggtattcacgcggaatcatgcgcacggtcggctcgaacacttcgcgcatccaatcagtggcgacaatctcaagatcctcaccctcacgccatgtggaagcgcggtaggcatccaaatcgttcaacagtcgacgagcctgattctcctgcacatcaagaccagtcaatcgcagcagcttacgattcgcatagccggcatcgaccacacgcggacgcaccagcacacgcttgccatcttcggcggtcttcatctccagctcatccacatcaaaaccaagctcattgagcttgttgacgcgcttctcgatcttccacatctcatccggaccgaacttgtcggtatcagtcagcgcgctccacagcgaatggtaacgatccaccaaacggttgccgatcgcaatttcgtcaacaccgctcggcagcagcgaaccggacgaaagatccatcaattcgccaataatgttcgtacgggccaaatcaacgtcgtactcgcgctggccctccgtcagattaatctgcagatcaccggtttccgcatcaaccaaaaatgcggagaacgcgtaggcgtcgcgcaggaacaacacgttcgacagtgacacatcgccccaatagaagccagccaaatgcaaacgcaccatcagcacggccaacgcgtcgatcagtcgttccgcggtatcagggcgcagattacgcgcgaacagcgcacgatacggcagtgagaacttcaaatgcttggtgacaaggatcgcttccagcggctcgccttcacggctatgacggcctgtgaccacggcgatcggctgcacggtcggcagttccagcttctgcaggcgacgcagcagctcgtattctcgttccgccacattgcgcgtgatttccttcatggcgtacacttcgtcgcctacgtgcacgaaacgcaccacatgcctggaaataccacgcggaagattagccagcaggtcttccggccaagtagccagcggcttttcccacggcagggtgaacatctttggattcgagcttgcggcggtgattttcagcgcatgcggctccggagatgaggcagccggatcttcggccttcacggaagttgctttcagcacacggggatccatctgtggcaattcaagagattccatgaatcaacaatttacctgttgacctacccgaagaagcaagtatggacgaatccgtttcacctgccgatatgcgatgatctcaatactggaatctcactatccatctcatattacgatcgaatattgcgatcgatgctacaaacagacattacaagccgatatcgtgcttgcggaaaacaaaagaagccccgcaccgacgcggggcttctccaacgagacgataagagaggaagagcacgtctcgtttaatggttgacggaagttcgcgcttccgccaagtttttattcagccacccgccagccgatttccgtaaaggatattcccctgaagaaacagccaacggttggttactcgatatcagctcagttcagacgcagctcggtcgacggagcgaacaggtgcatcttggacgggtcgatcttgatcttgacggtatcgccgaccttcgggagagcacgcgggttcacgcggatcgtggtgagcttgttctgatcggacatcatggtggatgcctcagcagcggagccatcggtgatgatgttgccgtagatgtagccatcggagcccagatcctcaacgttcatgaccttgagggagaaggcgttggcgtcatccggggcggccagggaagcgtcttccggacggaagccgacgacgatctggttgttgtcttcagcggtgagcttgttgacggcctcggccggcagatccacggtgtcttcgccgatctttgccttgccgttgaccaccgggtgggtgttgatgttcatcgacggggagccgatgaagccagcgacgaagacgttggccgggcgatcgtacagctcggtcggagcgccgacctgctgcaggacaccgagcttgatgacggcgatgcggtcacccatggtcagagcttcggtctgatcgtgggtcacgtacagggtggtgacacccagctggcgctgcagagcagcgatctgggtacgggtctgcacgcggagcttggcatcaaggttggacagaggctcatccatgaggaagaccttcggctcacggacgattgcacggcccatggccacgcgctgacgctggccaccggacagagccttcggcttacgatcgaggtactcggtcaggtcgaggatctcagcggccttctcgacgcgcttgcggatctcttccttcggggtgccggcgatcttcagagcgaagcccatgttgtcggccacggtcatgtgcgggtacagagcgtagttctggaacaccattgcgatgtcgcggtccttcggctgcatcgtggtgacgtccttgccaccgatgaggatgcggcccttgttgacctcttcaaggccagcgagcatacgcagagtagtggacttgccgcagccagacgggccaaccagcaccaggaactcgccgtccttgatgtccatattcaaatcatccaccgacggcttatcgttgcccgggtagatacgagtaacatggtcgaatacgacttctgccatgatttgtcatcctttcagaggcaggtacgtgcctcacgatccgttgtaaagggatttcttttcggtgcctcgccttgcggcttacgacttcgacaaagccacaattcaaagcgttaatttatttctttggtttggcgaaggttctcttcgttgagccacgttccatgatacatacaacgctaaaactgtcaatgcgtgtcgcgagtcgcgctgtttacctacgctggcaaaagggggttaacggcgtagtaaatacacgcctttatcgccatcatgcaagacaatggtgcggagcgaaagacagaacagggaggttgcagtgcgcaatattagaatcggcgtggtcgaggatgatcccgcaagctgccagctggtacttgactatctcaaccgatatcagcaggaaaatgacgaacaattcaccgtttccgtattcgacgacggcgcgagaatcgtagagaaatatacccctgtttacgatattttactgctcgacatcgaaatgagcgaaatggacggcatggccgccgcgagacgcattcgcgagcgcgacgacaaggtcgtgatcgtgttcatcaccgccgcaccgcagtatgcgatcagcgggtacgaggtgcgcgcattgtcgtatctgctcaagcccctgccgtggttcgcgttttcacaggaactcaagaagtcgatcgacatggtgaggcgcaatggcgacgattccatgcttatcgaaaccagcaacgggcagatgcggctgaatcttgccgatattctgtatctcgaatcgatccggcataccatcgtcatccacacgttggaaggcaaactgtcgatcaatggcacgctcaaagacatggaagcgaaactcgccgaccaccatttcttccgctcgaattcctgctatctggtgaatctcaagcatgtgacgggcgtcgccgaccaggattgcgtgatgtcgaacggcgaacagttgcgcgtaagccgaccacgcaagaaggcgttcctcgccgcgttgaccgactatataggaggtggcaggtgaccagcgtgatattgccgaatgcgctggccggattggcaggaggactggcaggaggctccccttccataccttccgttttggtgaccgtgctttcggtgccgccgatgacgccaatcaccaacgctctgcccgacatcccccgttcttatacggcgatctgcgaatgggccgcgtgcatggtgtatatcgcggtgtcgtatcgtcgcgtgccgctccgacggtcgatcatcgtcagtgcggccggcttggcatcgctggtcgcggtgcagtatttcgacggcagtatgccgatctggttctggatcatcggtatgctgctcgcattcgcctgcatgtatgcgacgattctgctcggcgcgggcaccggcaaacgcgagggcctgtatattacggcgcgcgcgttcgtgttggccgaattggtggcgtcgctgcattggcagatcgttacgttcattggcgtgcgcgacggattcaccgattacgattggcgcgcgatcgcgctgcttgtcgttacgtatgcgctgtgcttcggtctagcttggatggttgaacgcggcaatttcagccaggccacacctaccttgccgaccgcttccgccgcgattgcgacgatggccatcatgatcgtcacgttcgccatgagcaatttgagtttcgtgtcgacgaatacgccgttttccggttcggtcggccaggaaatcttctacattcgcacgctggtcgatttctgcggtttcgcgatcctatatgcgcagcaggagcaggcgcgccgtattgaggcgaatacggaactcgcgtcgatcaacgcgcagctggaaagccagcatcaggaatacctgcaatcgaaggaaaatatcgaatcgctaggccgtcttgcgcacgatctgaagcatcagcttgcggcgttgcgtgccgaagtcgatccgaagcatgccgcggccggcttcgagcagctggagcaatcggtgcagcgctatagcgcgcagcagcataccggcaatcccgtgcttgacgttattttgaccacgaaagagcgcacgtgcgccgatcgaggcattacgttcacggcggtcgcggacggctcgctgctaagcggcatgtcgtcgatggatatcgcatcattgttcggcaacgcgcttgacaatgcgatcgaagcgacgtcgaaattgccgaaacgtgagcagcgtctgatcaaacttgcgttatacgagcagaatcgctttattgttatccgggttgagaattattacgattcccgattgaagaaggatgcggaaggcaatctgcgcaccaccaagcgcgacgatcagcatcggcatggtttcggcgtgaagtcgattcgtcatatcgcgcagcagtatggcggcgaagtgacgattcgcaccgaagaccactggtttgtgctgaccgcgcttattccgcggaaaaccggccttatggccatgtaggactggccataaggcttaaggcggctccgctagttttcaagattctgcgcagcggcatcgccgtcagacgcatcaccggcatcaccgcctgccgatgcgtcgccgccagcatcgccggcattcgccgcacctccagccgcgccgcccgccgcagcacctccagccgtattgtccggactattcgcagcaccaccgttagagcccccgttagtgccgatattggtgttgttcgtcacggtgttgggagtcgacgacgcctcctggtattggtccatcgcctgctgaacggcgtctttggcggcattcagcgcgtcaacggcggccgtcacgtcgttttccttgagattggtgccattggcaaggtttctggccgagtcaatcgcctgctgcaatgccatgcgcacgctgtcgtcggccaccatgccgtcggaattgtcgagcacggactgcgcctgctcgatcgcgtcattgagctggcccttcagacgattctgcgtggccagcactttggaagcgtcgacggcttcggccgcatttgtaatcttttcggccttgtcgttcatgctccgtgcctcggatgccatggctttcgcggatttcttcagcttgctgatgccctgcgacgtgtcgcacgacaggattttcgcttccttcgcgttagatatggccgcattgagcttagtgacggtgctgacgtcggcgacttgatcggcagtgaccttcgcgccggtttttccgatttccaaagcgtcggaaagcgtgttattggcactttgcagctggcttgtggaatcctggcattgcgcggctgcgctggtaatggctgatttcttggaattattcgaaagcatccaacatgcaataccgccaatcaaagcaatcacgacgatagccgcaatcacgatagcgacgattttgccggtattcttcggtggtaccggaatttcattgctgtaatcgccgtaaccctcgaaaacactgaaatcgcttacaccgttcacatcgctttcttgcgaagcgaccgtcggaggcttcggcggttcggacatgtcagcccccatcacctcggtatccgtcggaaattccagcctgaaattgttgtctttcgtcatacgtccttcttcatcatcgggcgctcagcatcgaccatctatacgccgaccccctagtttaccgcctaacacacccttcaacgcgcattcgccttaattaccttcttttccgcacttttcgataggcgcaaagcggcaagcggctcccctaaacacgatgcggtgaacgcactcaccgcaaccgcgaatccaatgggcacaaacagattgatcggagcatccgcaagttccatcaccaagcaaatcgccataagcggagcctgttgggaagctgcgagcaatgcgcacgcacccagcagagcatacatgccaatcgaattcgtgtgaaacacctgcatccacagaacacccagcacagcaccccccgaagcgccgagcgcaatacccggctgcagcacaccgccggaagcgccggaacggatcgtcagcaatgtgacaatcgccttcgccaggaacgaaaccagcaaaatcggcaccaccgccaaatcggccttggacgagaaactcaactgcgcggtggcacggccattgcccataacctgcggcacccaaatcgccaccacgccagtcagcaggccggcgagcggcaacatccacagaatgcccgcgcccgacggtttggacttctcggcccactgcgagccgcgacggaacagtgcgccggcagcgccgagaatcatgccggcaaccagtgcgaacgccatgtaatcgggggtgaacaggccgtccgctttgccgatcaggtagaacgcgtgcgtgcccttgaccagcgacgccacccacgaagccagcgcggaacaggcgaaagcgagcgtcaccgtttcgagggttatgtcggcgagcagaatctcgaccgcgaaaaacgtgcccgcaagcggcgcgttatacacgcccgcaaggccggcggcggccgtaatggccaccaacatacgggtgtctttcgcatcgagacgcacccaacgtgcgaaccgctgaccgaacatcgcacccaactcgcgcggcgccacttctcgaccgatcgacatgcccgtaccgacaatgaaaatctgcagcaacacatgcacgacggtctgccaaatcggcataatatcgccattcaccgcctttttgacggacggcaccttcgtactgcgcgtacgcaacagccaccaaatcacggcggcgacggtcgcgccaacggtcacggaaatcaagcaccgaatcgcaggaacgttgaacgggccggattcctgcgaattctcaacataaccgagcgcaagatgctcgacgccgtacagcataagcgtcagcaggccagcggccgcaccaatggccacacccacaatcgccaccgccgcaatcagcgccggaattctgccaatctttggctgcgttccttgaggattctgcgactcctgcgattctcgtgttttttgcgattcctgcgattcccgcatctgccgcactccttgcacaccgtctccttcgttcaattcgttcccccaattgtcccacctgccgcaacgttcatttgttacgccccgagcgtggcgatcggcagcaccagaatgccgtcatcacgccggtatgcaatatcaccacgcccgacaataaatgccatgaattcaggctcacgaacttgagatagaggatttccgcacactttttctttgaaagcatgtagtttgtccacatttttctccatgactttcaagtcgctcagcttaatccccaccgcagcccagcgaccatccaccaattcaagaatcacatcaacttcaaggcctttttcatcccgataatatgcgattcgattcgtgccacccatcgattcgagatacacgcgcaaatcacgaatcaccaatgtttcaaacaaatctcatactgaatcagagacaatagtgatgacgctctcagcttatccagcacaactcattgcacatcatttgatagggattgctgcgagagctgcatctttaggtcatcgacttttaattccaaacgtctgatataaagcgcctgtcgacggataatcaaatcacgcatatcatttccaccggttccagggttaccttcattcgtgcgactggaagtaacctcagcatcggggagattcactctgtctaccgtgcctggatcttctattcgtattgtcttcctccaacgatgcatgcaccgttcaatacgcttttcgcctatcaactcaggaccgagccccgcttcgcggaacagcacagtgggagattcaccattttcagcactcgaaacgcattcacgcttgaaccactctgcatatcggatacgtgaaccagtaatacttatgaccgcaggcagcgaagccagatactgtgcttgttccggagagaatcgttcgtcgctcatgcttacttttttcacttcatcgtgcaatcatctgtatgggatttgccggccgaattgacatcccgtatgcggcgtctcatgcgcaatctgatcaaaatgaacgtaacaagtaacatgagccccgctgccgcggcaatgctgcctacggcggcacccgtacgaccgataaggccaggattgcccggctcctcgctcgggttattttcgggcgggacaacaggagttccagtgctaaatttcggctctactgtgatgttgagatcagcggatgtgtctccactgccaggaatcgagatgaggaacggatcacagtcgtatgctttgttggctttcgccgagctcgtgcgggagaccagatataggccgagcggcagattctggaaagtgagctgaccagctacgttagtggtgccggaatgctggtacagcttgtttttcgccgcgtgcgtagcgagcttcttggcagcatcgtgatattcacttgatgtcaggcgttcccaatcggcagtgaggccggaaaaatcgccgacggttttatatgaggagacgctaccatcattgttcgttgtgacggtggcgacgcgcacgatggaataggtatcgccggcaagcaatttgggcgaagccgtgtctcggccccatacggcattgatggtgagagcgccgaaagaatcagcttgcgcatacggcaccatagagccgaaggctgcaagaacagtgaggacgatagtaacggcggcggcaatcatggcagcaatgcgcgccgcaccatattcgcttccgctatgcaggtctaacatgtctgcccggtccttttcgccgtgatgaatgtgattggttatttgtactgtctggctgaggaggcaagtcaccgtccggctcgatatccgcagagtcagaatcaccagatgcgaccttggcgctcccactctgccggcgtcgccgctcatgacgctgccataaatgccatgcgataagcaaggcaatcagtgcaagagacggcaacaagtactgcagcggaatgtccacgtggaacgtggatttggcgtcatcctgctgctgcggcgcgtatgggatgcgatggccgcgcaccagcagccgatgcgtattgaccgcatacggcgtacaagtgatgagcgtgaccaaatccttgccgggctcaattgccagttgtttggtattggtcggcagaacggtagtgatcttatcgacctgatacgcatacgtgtctttaagtattgtgatgtagaacttgtcgccttttttcataaggttcaagtccgtgaacagttttgccgtgggcaagccccggtggccagacagcgccgcatgagtggacgcgccaccaactggtagtgaggtctgttcgagatgtccgatgccggattgcagtactttctcggaagtgccgtgataaatcggcaaggtctccttgagcttaggcacagtgatgtatcccatcatgccgtcgccgtcaatattgagcagactgttgtattcctcgtccgtggatgcggaattgacggcactggcaagagcgtcggtctctcctgcatcgttctgggcgagcttttcgttataggcgtgcgcagcatccagcaccttctggtactgttcctggctcaatgcttcaacgctggcgtcgtagttatttacggcgcggctggcgttgcgcataatgaggaagttgctgatcgtcggatagaacagaatgagcattccaccgagaatgaccagtaagggcaggatgttgcgcagtcgtttcatcgagcgttcttttcgcgaggaaaccgtgttgtgggcgtagcgggtgtgtgcccttcacgcccaaaacacggccatgctcgtcaggcgttcttgcgcttgagagtccaggcaacgccgagcgcgatgaccagcacaccaatcaccgtgaaggcgatggtacccatgccaccagtgccaggcaggatagcaccggacttgttctggaccgggatgacaccgttcgatgcggtctggttgtagctgttgccattgtcgttgttgtaggtgatggcgacggtggcatccgtggtgtcagtgccgtcgttcttgccatcaaccttcacgccgatggcgctggcgagcttgttgtagccggccggcgctttggtctcggtcagcgtgtactcgccgttctccagtccccggaagacaaccttaccgcttgcaggagtggtgatagtcgtcgtagtatctgtctcaccagccttagctacacggtatacagcgttcgcggtcgcactaccggcatcgacttgcacgaagctcatagcggtgccgttcttaggtgcaagtgtgaactcagcaccagcaagtcgagtagcgtcatcatcatatttgtcaccagtgtacttatcgacggtgaagccataagtgaagacgcgaaccttgctgggttcggactcaccggtgccaccgctgctcgggttgttggagtactgaattgttgcggagttggtgttaccaacaccgcccacaacagccttctcgttcagcgtggccgtgtaggtgacggtaatcttcttgccggcattggcctgctgcttggccttgaagtccttcatggcgacagtaagcgtattgtcggagaccgtaggagtggtgacggtgtagtcagtgttcacggtcagtggatcagtcacaccttcgaccgtaacggaagtgacttgtccaaaggtgaggccctgagacaacgtatccttgaagttgaaggtgtaggtgtcataggcggacatgtctggaatggtggaggtcagggtgaaggtcagggtatcaccgatcttcgcgtcagtggcgtccttaccagtgccgcctacctgtaccttcttgtcgacggtaggcaggtcgcccttaatgttggcagtcacattggtgctatcaacggaaactagcgtggcgtattgaccactggcgttggccaaggtcgcacccggcacagcgaccacgtagtagccgtagtcgagaccagtgaacgtcgccaagtacttaccgtccgtagcagcggcagataccttagcggtcgtgccagccgtgatgttgttggccttagtctgcgcccagttcgatgccttggtagcgaaagcaaccaagtcttcacccttcagcttggatacgtagtcgtttgctttatcgttgacgttctcgtcggtagcaccagtcagtccggaagcagtggagttcttgaagaacggcttccactcgtcagtcaacgtgtaggagacagccttgctgccaccgtcaccgctcacggtggcggagaacatcttgtaggcgttcacggtcttaccggcgaacttcgcgtcagtagtgctgaccgtcagcgtggcattatccgctgcgttggccgtggcgactgtcgtcgcagccaatccaaatacggtggcaatcgccgcagcggcagcgaaaacccttttcatcagtgatttcattactgttccttcctctaaatggaaatcttttctgtttggcagatacggtttgtctatgtagtcgtcacgcggcatgggcacctcgctttcgtatacggctggagcccgagcggactgtgccggattgaacgcgttgatcacgcacgtaccagaccacgccagctcccataagcagcaagccgaacatcagaaaccacatcgtgcccgcgcctcccgtatccggaagcaacgccgcattggtaacaatggccacgcgttccttggtgttgtaggagaccgatacttggtatccggcctccgcgggcttgatggtcttggtggtatcgccgtccttataggtcacggcggtttcttccacggtgtacgtgtagtaacgcacgatgtccttgccgttggcatcctgtccatccacgaatgcgaccggcagtccttgaatcaccttgcgccaggtgttgctccaggaagaggcatcggaggagtccaacgtcaccgtccatggattcttctgcgtcacggttgtgcaatccgcgccgaagcattgaatcgtctgcggcgtcaccgtattgccacggccatcggtatagtgcgcggcgatcttcagttcgaccgactgcggccgttcgaggttgccgtccttccacaccttctgcacggtcaagtcaacgctccggcagccgtccttgccgcacgggtcctggccgtcgtccggttcgggggtgagtccgccgttgttgtcggtcacggtcgcgtcgagcatgagcacggccttggccggggactggtaggcatcgagcttcgtcttggtgctgccgtccgtggagtcgaccacggcatccttgatgccaacccatgtggtaccagcgtcgccggatgcggagccgtgcacagcgctgctgtcgtatgtgttgaccacgtcgaacagcttcacttcccaacgatcgagtccggtgttcagcgcatcgtctgccgtgttcttctgcgagaagatcttgttgccgtcctgtgcggaggtgcgggcctcactagcgttcgcggccgccttgcggtaaatgcgataggtgttgtatgccttgtcgccgttgccgtcatcgaccggtccgaggatgtcgctcatggtgttgaagtcccatacggacttgagtttggtgttcgagaacgggtcgaccagtccgctggcaccgcggatcgtgtcggcgtagaccatgtggtcgtctgccagcacgccctcgtcgttcagtccggcgaagccgcccgtgtagcctgtggaaagatccttcacaccgtcggtatcctgagttgcccctccgccgaacacgtcatagccattggcgatgcccgttacggtggactgttcgacgcgcgtacggttgcccttgatgagctggacggtcaggttgctgcctgacccatccatatcaatgccgtctttgctgcaaggcagtttgatgacactatcgccgatggtgacaatcgccacgtcggtctgctgctggttttcatcatcagccttggacagagcaacactcaccttcagtccgaacaggttcacgtacagcacgtcgccttccgaaagcaccttgagatcgaataccttgccgaagatggccgggaaccacttgcctaaatcgatgacgccgacctgttccgccttgtcgaggtacaggagcttgaccagcgcgttcaccacttgcagcagcagttccacaagtacagagttgaccttcgcgtcaaccaaataggcacggctggtttcaccgacgaatccgccggcaatctcaccgctagtgaccttcttgagattgtcagacgtgcagcccttcaccctggccaaatccacgtatccaacaaaaccgcctgcgacctcacgtccggtagccttgtcggtggctttgccgtaattgtcgccatggtgtgtggcggtgacggtataaccgtccgggatgccggtgacgcgcgaatcgccaacgtgcgagccccagatgtcaagtacgccggccgtggcaccaagcagattgagcgcatccgtgccgagttgtgcattgtcggcggcgaccgtgccggatttgccaagatgcccgatgaagccgcccacgtagttcacgccggtcacactgttgaggttggtgaccgcagactgcttcacagagccattgatcagtccaccgccgaagccaccgaccgcaccggtgtaacgcttcgagtcaagcatgccctttgtggtggaatcatgggcgacaatctggatgccgtcgctcacaccgttgacctgaccgtcatagatgaaggtgcggaatgcttcgagcacgcccacgttgccaaccttgagcagtttgagcagcaggttggtatcctgcttatcgccggcctcgccgccgccgacggaagcgacgctggatacatcagcaaggccaaagaagccaccggcgtattgcccgccttcgacagcgcgcagcccgttaacagtaagagaagccgggtcattgttcggatccgcttcactgccggtgcctttggcggaatccttgtcaccgaggatcgcggcttgcaacgaaccagcgaaaccgccggcgttcagggcatacttggctgtggtattacccttatcgtccttgctctcatatgcgccattgaccgtgtatccccatgccgggtcatccgagctcacatgtgcaccgcgaatcgtcgtaaccgtggcctgcaatacgctgaccagacttgccgggttcgataccagcgagtcgaggattccttgcaggaatccctcggacgcattggtgtccacatccgcaaccgcaccggcagtggccacgccgataaatccgccgacattgttgcgcccttccaccttgcgcaggttggaaacgttggcgccggcagcggtgacaccctcggcaagcttctggccgttctggtcgagatcgccccagatctggccaccgaccgcgagaccggcatagcctccggcattaccggtaccgtgcgtgatgtcttcaccggtggccacgaccttcatacccttgcggtagccggccacgctcgaagatttgacgacgggcacaaatacctgtgccacgtcgagcatctgtcccaaatcaagtttgatgcctttgtcgccgaatagttggatagagccgaacgaggatgccgagccggattccatcgtgcccgcataaccgcctgccgcacgcatggcagagacggtcttgacatccatcgactggccatcggtgatcgtgccggtgcacatcagaccgacgtgtccgccggcgacgccggaatcatgcaagttcgcgccagtctgatactccgcacgaccggcgacgacgttgaatccgaagatgtaggattcgaggaacttgtccagggaatcctgatcagtaacagagcccgcaccatcgcccgtagctacctcggtaaattccttgccatacgcaccgtacttgccgatgttgtcggcccacgtcttccattggtcgtagctcatattgcgcaaaggaccagtgaccttcgagtgctcctcggtcgggtagaccacagacagcacgccagcgagattgccggccttgatgagaccgccaagcaaggagagcgaaccgccttgagcggtatcggccgcctccatgaagccggtgtaaccgccggcgatttcggcaccgtatacgctgcggatgcgcgcggcgtaggctacgcgctgcggcccgttgtatttgccgtcggtattctcctgcttccacgctgctgtgttgttgccccagatatgaccgccacgattacgacctgcatagccgccggccatgccgcggcgtgtggtcgtatccgatgccgcctgggcacgcaccgcgccgccgcacactgcggcatcggtcgagctgttgcgaatcgtcggcacgaagtcctgcacgagcgagagcaggttgtcgaggttgacaagcttcttgagcacgctgccgtcaccaagcacgttcgccacggctcccggctgcatggcgcccacgtaaccgccggccgaaacctggccgatgatgtatacgaactcatgagagctcgagtcctgaatatagccgccttcaatgtctccggcgaaaccaccagccatacccagtggatcgggctcattgttggcattcctatgatttgcggtgctggccagaacggaatatccgccgatgccgccagtcacatcggagtgttcaatcgacgagacgacgacatccagcacactgagtacatcgttgagattgacgttctggccgagcaggctcaggccaccgcccacagctgccgccgagccgatgtccattttgccgatgtaaccgccggcgtatcgcgcagcggtgactgcatatgtgctgtctttgctcagataggtgccatcgattgatccggcggtttccagattcttcggtgccttgacatcagtacggcgcagttgggtcacactggaatgggacacctgcacaccggaaccgtatccgatgtagccgccggcggaaccggattgcgtatcggactgatcaaatcgggtggcggaaacggtgaagccgggatcatccgggtcggaaatcttgttaccgctagttgcctccacggtggtggcatcggaatgcacacccgcgtaggagatgaatggcacatagccctgcaccacctgcaacaggttggcgagatccaccgtaccgaatttgccgagcaaactcaggccgccgttgccagccgaagcgagcgcaccggagacaaccttgccgccgaaaccacctgcgtatgcgccgccagtcacatggtcaaggttgacaacggccacggggttggtttgcacgcgggactgtacaccggccagcgttgagtcgttcttgagatcggtttcggagaactggttgaccttgccgctttggaagtttcccgcatagccgcccgcgatatcgccttcgacataaccgccgttgacgtacgtcacggtggtatacgtatagcttggaatcagatacggtacggcaccgagcaggtcgttcacggacagcaggccgcctttgatcaggtcatccaatatgctggaatcttctgcgttgctgagcgcgtcggcgaggccaccggtggtggagaagcccacgaaaccgcctgccacaccatcggacgtgctggtatcggctgtgaccgatttgaggtttgtcacatggctttcccgggtcttggtgctgttggcctgaccatagaaaccgcctgcagcgtaatcggtcgtttcgttgttctcgttcttgccggttgccgcaaccgtgaatccgccagagatgccgttcacgttcgatgcagtgactgcaaccgaagaatattgggcaaccgatagcagaccggaaagcttgataagcccaagcacattgagaccgccagcgccgatggcgtcgcctggtccagagaagccaataaaaccgccggcttctcccctggccgagaccgtggccagattggtaaggttcgtgttggccacgtcgccgccggtggcgcatccgatggcaccgcctgcataatatgaaccagccgtcactgtcaagccggatgccggagcggtgacagacatgttctccacggtgaacgcggcaaactggtcgaacttcttgagcgtggcaatatcgccaattttcaccacactgttgagcaacccagctaccgttgtcggttgcagatcgccggcgatgccacccgcgtaggagcccgtggccgtgaccgattcaagaccttctatggtggtggaacgctgctgtgggaagtcacgaagattgttgtacttccagaatgtgagattttgaaggcggttccgcgaggaatcaccgatcaccgtacccgaaccttcgcccacaaggccgcccgcgtaatcaccgccggcagcaactgtgagggaacccttcatttgtgtaccgagaatcacagaaggattcacaccgacgatggatagcagttctcctgcaccgttatcgctgccgctcagcaatttagtcacagccttggtgagctgtttcaacagcgatgcattcgtggtatcgtccgtaccgagttccaggccccatcccacggaggcgaatccggtgaatcctccggcgtgggatctgtcggcagtcacggcgaccgaagccgtaatcgaattattgacagcataggcattggccatggcaccgttgaagccgccggcgtagtcttcggcctgcacggtgatcttatcgtcaccgtttaccgtcaggccactgttttcgatgaggctctgcggacgcagcgcagacagcaagtcgacgccaagcgagttaatcagaccgcccacgttgccgttgcgacttactccggcaaaaccaccggcatattgcgttgcccgcacggtgaaaccattcgtgctcgtcaccgaagagttctcaatgattgcaccaatctgtgcaccgacaaaaccgccggcctgcgagttgtccttgttgccgatcaccacgttctctttgaacccgttcaccgaactattcgagataaccgggttgtagtagccaaccggaatcaaggcattcagcccgagcgtgccggacagcaaccagtccaccaaatcgcccagcccgaggaacgggatgacacccaagatcttcgagagtacattggtgagcgctcctacgatgccggagactgcatcgtatcgggttgcgccctcaacatatcccacgaaaccaccggtcatacggcttacgctagataccgaaacatctgctacctcgcagtccgtaaccttggtgtccccgtagatacggccggcaaatgcacccgtggcgaggttggaaggattgtctttgtgcagggtgagcagaccttgaagattgaggtcaagatctacttgtccgaatgtcaatagttttaacgccttcaacagtgtgtcgagcagtaatcccactgccgaagtgagcataccgagcaaggtcggcggaatatacgattcactcgtatgattcgtcaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggacgagctgcggtagcgtgaaccacgcttgcgccatcggcaccaacagccttccacaggctggcttcggtgtcgccgtcattggagaccgcaccgagcatagtgccggagaacatgagcggagtccactcggtgttgttggtatctgccgcgttcttggacaggtcgatgtcacggaagatcaggtagttggcgtctgcggaataggtcaggccggtgttggcagcggagtagtccgtttgcgtgccatcagcacccacgccgtaatacttggtgcgggtcctgttgacgcttaacgccgtgcatgccagcagtggactgtcgtggtcggaggcatcagtatcgcgcaaaatatctgaatcggagagatcggcgtcaccggcgtattcggaagacggcgtgccgtccacccactgataattgagggctccttgctgcatgcaagtctgcgtgaccttgttgatgcggccaataaccttcttgccagaaccaatcgcacgcagctgctgctcgttaccaatcaggatgtaggtcttgccgttgatctccttcgtggcctgaccctcaaagtcacggccgccaagcgccgtcgcggcgacctgcacatcggccttcgccggcgattgatccgtcgcatttgaggaatcgttcttggcatcttgagaagaagcatcgtttggagcctgcgtttgggctccatcattagtggaattgccagcggtagcttctgctgagtcgtccgccttattgtctgtcgcaccatttgaggattcggaagaatcaccagtagtagaagatgaaggagatgaatcctgctgtgcgtcttgattcgtttcggaaggtgttggcgcaccgtttgatgtattggcctcttctgacgtcttatcgtcaacgttgacattgcgggcagaaggagcagctacgacagtattaccccccccccctccagaaattacggcgttaggagagctactcacatcgtctatattctgagcatatgctgcaggcaccatgcacacgatggacaaggaaacagcaataaccgaagcaaggcaacgcttcaaagacaggcactgccgtccagattcccgttctgttcctccgttaaacccgcaacggacgaacttcaattccgagctcattgtctcccctcatagattcgcaatcccctttcgggagattactgcatacaactatacggaagaggttgacaaaagaacaaaaaacgttcatttgctggggccggttagcgtatgtctttctgagcaaaaagaaaagccccgcagctatgcagggcttttccaacgaggtcatgagagaggaagagaacgaccccgtttaatggttgacgaagctttaggacctcgccaaatcactcatcattccgcactttcaagtttatgccaatcccgttttcgattttacgctgttttgactttcgattttacgccaatctcgttttcgattttacgccggcaacactgctgacgattgcatttcgatattcagaaatcataagaaactacaggaaagcagcaaaaagggcataagaaagcccgcccggaaaaagggggaagaccgggcgggttgaggaagggaagaaaaagaagtcagctatgaagggttacttggccgtctccttggacttgctcttcggcataacccagaacttgagcagcgggtagctcacgatcacggcgagcagggtgttgaccacggaagcgatggtgccagcaatgccagcgcccatgccccaaccctggcacagaccggtcacatagcccggcagcacaaggttcacaaccacgatgatcacagcgaggatcacgtacttccaagcggcatccttgaagctggagtcagacttgaacacccacttcatctgcacgaagaagttcaccacctgggcgagcgcctcggcaagcaggaaggtgaggaagccgcccagaccgttgccctgagtgtcgtagttgaagatcaggaagtggaacggctgcgtcaggcccatgccactgatgaagatggcggtgccgatccacgtcaccacgaaacgggtgatggtggagatgttcgacagcacgttgaacaggatgaactcccagatgttcgggtggtccttgatccactggcggatcggaccgaccttctcagccggctgcgttgcgttgttatcagtcattgttcagctcctttgcagtgcgcttgtttgcggattggttgcggaagaagccggcgatgacgccgcccaatccgcggaaggtgtgtccgttggcgattttgacgatggcgtcgaccatcgcggaatcgaccatgccttgggtcatcttgctcatggctcgcggaggcatgttcaggatgaacagggtgttgaggtccggagcgccggtcttctgacgaatcttggcctcctgcttggtgagcgtcttggcgacggtacgcgccacgaagcccttggaatccacccacgacatgatcggatcgttcacgccgaacgtcaccggcttgcccggtgccacaacctcatggccgaacagcacggccatttcggcgtcggtcacttccttgacgtggccgctgagataatggccgagcgcagtatccgcggcaaccggattgacatcgcctgcgacggtgtgcggaatcgtaagcggcaggtgttcggcgttgtcgcccaccatcagcgtccactcgccggtttccgtcttccattcgttgctggcaacgtcgaagtgacggaaggtgtaacggtcgaaatcgatgtgcacgctcttgctttcgtgtgcggcaagcgaaaccttggcgaagcccttgagctcgcgatccggacgcaacacaccaccctgcggaccgcgcacgtacagctgtacaacggtcgaaccggcaacatcggaatcgttgctgaccatcacgtcaatgccgttctcaccagcagtggcggcactgtaggtgaacgtggagtagctcaagccgtaaccgaacgggaagcgcacgggcacaccggcggtctcgtaataacggtagccaacgaacgggccttcgcgatagatcgcatcgcgaccaatcgccggataccaactggagctcgggcaatcctcgtaatgcatcggccaggtttcagccaagtggccggacggattgatctcaccggtcagcgcgcgcacggtcgcggaagcgccggcctgacccgacagacccacgtaaagcactgcggcaacgtcgtcaatccacggcagttccaccggagagccggcgacaagcacgaccacgatcggcttgcccgcgcccttcagcgcttcgaccagatcgttctgcacctgcggaatcgccatggtggaacggtcaaggccttcggattcgctgcgttcgtcaagaccgacgactgcaagcaccacatcaacgctttccttgccagccagcgcgactgcgtcttccacgagcacgcggtcagccttgccctggcggtcatagccctgctcatagccggcaagcacgaggccttcggcgttcttgacctcttcaagaatgttctcttccttggtggcgttcaccttggaggagccggaaccctgataacgtgcggttgcggccatatcgccgatcaccgccacgcgggtgccggccttgaatggcagggtcgcgttatcgttcttcaacagcacactggagccttcggccaccttgcgtgccacgtcgtgatgcgctgctgcgatatcgtctttgagcagatcgttacgtccaacaccgaccagcttggtcgctgccgcgatttttgcgacttctgcggcacgcgcgttgatatcggcttcagacagagttccagccttgaccgcgccttccagctcacgcgcggaagtgaagcccggagacggcatttccagcgatccgcctgccttgactgctgcgaccgcggagttggatccgccccagtcggagacgaccatgccgtcgaagccccattcgtcgcgcagaatctcctggagcaaatgtttgttttcgtgcgcgtagacgccgttgatctcgttgtaggaggtcatgatggtcagcggcttggcttcacgcactgcgatttcgaaaccggtcagatacaattcgcgcatggtacgctcgtcgaccacggagttgctggcctggcggcgcagttcctggctgttaaccgcgaaatgcttcgggcatgcggagatgccgttgctctggatgccgcggatcaggcctgccgccatacgtccggcgacgatcggatcttcggaatagtattcgaagttacgtccgcacagcgggttgcgcttgatgttcagacccgggccgagcagcacgttcacgtcaagatcgtgcgcttcgctgccgagggcctcgcccatttcttcggcgagcgccggatcccaagaattggccacggttcctgcggtcgggaagcaggtggccggcttggatacgccgatgccgagatgatcgccttcgccgagctggcggcgcacgccgtgggggccgtcgctcatcacgaagctggggatgtctgcgcggtcgttgcctcgcgaatcccattcggatccaccggaaagcattgcggccttttcaacgaccgaaagttcttcgagttccattggttctcccttgcactaactcctcgaacccgcttggccctccctgagcctgcgctgttcttgttgcggatgttcttggctgcatcgcatgtgagcatccgccgctagtttgattgaaccagcctttcgccgccaatctgcgccccattacacaacctgtcgttttgcccgcacaatcggacattccttaactgatttcggaatcaaaggaactcacatggcagatacgtttttaccgctccgccgcgctttcgtatgcgttccatacacaccatacggcgtaggaaatgagtggacagatggtggcggaaataatcacgtcggtcggatagtgcaagccgagcagcaatcgagaacaggcgaccgccacgacaagcgcgacagcgccgatgaccgccctgcggaggaacacccgtcttccgtttgcacgcccgtcatcttctccgtcggggaagcgtttgcgcgcgaaattacgcacggtaagaatcatcatgaccgatacgatcaccgcggctgccgtgtgaccactcggaaaacttggatcgcctggcaatagatcactgccgacggacgtgatcggacgggggcgttcgaccagccatttgacaccggtcacgtacagtatcggcgccgccgacacgacgacatcgcggatgacgacgcgcctgctgccggtaatacgcaaatcgacagcggcaagcgcggcgacgattgcgatgcagcctaccgttgaaaacaaatacgcaagtaccgtagagcagtcgcgcaacccttctggcagcgccgctaaagcctgcaaaatattggtctcacgcattgtcgcgattgccgaattgcgcagtgcgacgccaatcataggcacaatgccgcacaatatggcggttgcgattaccacagccgccgctctcgcgatgcttccgttcttcatatgcatgatttcagttaagcacagttcaccataccgttgccgtatgttcacatccggggtatccccgaaaatcgaagattatccttcagggggcttccccgacacgcgcgctgcagacggccgcgcaacacaaatatggcatacccacacgggaagtaccgcgaacgatgcgagaatcggaattggcgtttaagaaggaaagaaggaaatatgaccgaaccaatcgcaatgaccatacgccatatgaaaatcgaggattatccgctggtatacggactgtggacacgatgcacaggtttcactatgagggatatagacgattgcgaggatgcgataaagacgtttctcaaacgcaatcccgacacctgtttcgtaactgaggacgatgacggaaggatcattggcgcgattcttgccggtcacgacggaagacggtcacgcatctaccacacggcggtcgaccccgacgcacgcggtaggggcattggctcgatgttggtgggccgtgtggttgaaacgcttcgtgcaatcggtctgccgaaagtcgctgtcggagtgcccacggacaacgacgccggcaacgatttctgggaacggcagggctttgcagtccgtgacgatttggtttatcgagaactgccgttggaataacgaaccatccacgatgccgtgcacgtcgcccagcccacgttgttcgcggacagcaagtagaagccggccagcatgccgccccacccatggacacgtaggcagcggaggcgatgccgcggcccaacgcgttcattacgtggcgcagcagccacgtgtcaagaggcccctgccgtaacggaagtccgagaggccaccgatggtggatcgctgttcggacggaagacacggtttaggcgagcgagctatgccttggctagcttcttgtgcctgagagtgtaaacggcatcggcggaatcggcgacacgcttggaatgcgtcaccacaatgacacatttaccgagttgatgagcggcatgccgcaaaagatcaatcacctcatcagtcatttccggatccaggctgccagtcggttcatccgccagaatcgcgcggccgggcgccactagggcacggccgaccgccactcgctgacgttgaccgcccgacaggtgcatgatgttgcgcttcgattcctcacggctcagtcccaaatcctcgaggatcttcatatcggccttgggattgaccaaacgcagattctcttcgggagtgagatagtcgatcagattatggtcctggaacaccaaggacacgtgctcgcgacggtgctttgaataacccgtcgtagctatatcctcaccctcgaaacggaccactccatcagagggggcatccagaccggccaacagggacagcagtgtgctctttcccgctcccgatggaccggtgatcgcatacatctttccggattcgaaatcagcgttcacgtccgaaagaacgcggatcttcgccgcgccatatgagtaattgacatggtccaattgcagacagatagtcatgattaatatctcctaacgcatagaggaaagaatggatttcggggatttggccagcactgcggcgcacgacacggcaagcgcaatcgcgatgaccgcgcatccgagcagcaggatgagcagcgtctgttctggcggcagagcctccacctgcaatgattcaagaggcgcgactccagaatcgtgcagcagaagcgaggacacgtatccagacaatagggagcccgtgcccagcgagcacagggctgcgaccacagccatgagaccggtttcgattgcgaactgggcgataatctgcatcttgccgatgccgagagccagaagggtgcctatctcatgaatacgtgagcggatccagaagacaagcgccatgcccagtaccaacacatcagccaagcaaacggacaacagcaccatacgaaccagatcgcgcaccgtttccaccgactgcagcacgccggaaagccgcgccgagtcatcggtgacgccatacttgcttccagcgatttttttcgcttgggccactgcggcggagagagcctgcggattatccgaaagacaccggatcgtgccgacccgttcctctccagtcagcgcggaaaccacttgggcacccgcatagataagattctccgatgcgtccgatggcatagggctctgtgcctgcacattgccagagaagattccggccacgcgaacggtggaatcgcggtcttcctgactgagccggagtgttgatcccaccgatagcccattctcacgtgcgaaatcccggtgaatcagtacgttccggccattacctgaaatgtggtgtccttgttccaaccggtacagaccgctttggaactcttcggacaacgaggagtcagtggtgcccagcacgctgacctgcgtggatagaccggaatccagccgaggaccatgttcggggacaaccggatgcgctccatccacccctgccaaggtcttacgctcgtaaacggtttttcctacgccggggatgcgcgagaaccggctcgcttcctttagacttgcaggattctcgcctgtgtcgacagtaaaacctattcccatgcttctgccgatatcgtcggacattttctgaagtgccgttgacactccaacctgagccacaagactggtgaaaaccatcagcatcagcagtccgatgattccgctgcgtaccggtttacgcacgattgccagcgtggcacgattccacacgttcatgcccgtcatcggagctccgacaggcttcgcggcgacttgcgcagcatcggtatgcacgatatggcgacgcataccagcatcaccgccagcaggccgagcgacacatacagtacggcagtcgtgtcgatcgataccgtgagcgaatccaaggtacgaaccgacatattggattcgagatcgccgccaacctgccccatgctgctcagctccttcgccgcggaggcgttcacggaacggagggccgaagtgccaagccattgggccactcctcgtgcgcacaaccatccgagggccagggacggcagaccgatcagaatcatctcggttagatattgggcgatcagggatggcttgccgatgccaagggacaccagtacgcccatctcctgacgtcggtcgttcatccacagtaagagcatgagactgagaactatcacggccgaaatggtcacgccgatcaaagcgccgagcatcatggaacgcacacctcgggcggcattcagcatgctcgacgtatattggtcattgcgcgtgatctggtagttgttccaatccactggaagcttcttcgccgcttccatggttttctccacgtcgacacccttgtccagaacgaaagtggcatcctgatatatttccttgccggccttgtactggtacagagtacttgtagtgtccaaatcggtgtacacagtgttggaggtgagttccgcgcggctggatacctttctgtcgctgtctcctttgaatattccaacgatggtggttttgacggttgccgtcgaatgcgactcattgtcggcatcatatggattggccttgagcgtgagggtatcgccgactttaagtccattggttttggcgagatcctcatggaccatcgacatatgcttatcggatgtcttgagatgacgtccgtcgaccatgccgagcgtgtgcgacgtgaacacattgagttttgacgaatcgtttgtgcctatgacgttggccgtattgccgaactgctgttctttctccgcatcgtaatcatcgccgccggggaccttcaccacgctggctcccacgagatcggcggtggcgttctgcctgaccatgtacgagtcaacaccggacagcttcgagattcgttgcacatcagcgggacgaaccattccgcctccgcgaggtgtcagcatgctgccttgcaggttactggccagcacgaatccgccgaccgcctgtttctcaatctgtccggcctcatgttgcgctgcccgagaaactgcggttgcggacagcatactcgccgttatgatggtcagcacaatgaacagcactgcggtgcgcactcgctttctgagcacatagcgcgccgcccgtgagataaatgtcattaataccccctgtgaagctgggaccttctcatccgaaacaatgaaatctaattcgattcttcgattggtcattcgccaaaatacatggttcacctcggaacatggcaagatatgccttgagcgaaaaaacgaaacaacattggttgcattatgctccgggacatcggtcgttttgttcatttgacaaactttgaacggctataaaacagtgcatataccaatggaggccccaatcgaaattggggcctccatcagagagaaaggaaggagtggcaagtattggttatttattcggtcagaatcttggccttctcgttgacgcttcaaccgtctcgaccgtcttgacttcctcgtcggggatctcaccggccgcgagcttggcttcgagctgctcgacgatttcggcgtgtatcttctcgttgatcttcaccttgaaggcgaacatcaggcggactccaccgtccgcggctgttgcgttgctcattttttcttctcctctaagagagttggagccgaaatcacccattgatcttgtattgcaatacgccgttttataaacagaagtaaaaaacattagtaatcaaagcttttgccgacgtgttgcaacaattcccatgatgcaaagcctatccgtcaccgacttaaacatgtttaatgggagtacttgaaaaacagagggaactgtggcggtaaatacgatttgcttttcggtaaaaaacatttatcattactggtaaaggaagtttagcttcctcatcattcacaacgaagtaatgaaagaaagcagaaaacatgacaaacagcaatcgtgttgagcacgcatccgagacatggctgaccgacgcgactgtgttcgaggtcaaccgcacgccggcccattccaaccacaagtgtttcacgcatgatccgcagagcggtgagtactccgatctcacgcaaagccttgacggagagtggcgcgtcgagatcgtacaggcttctgacatcgatttcaacgaagagccattcgttgccgaaaacttcgatgattccgctttctaccgcacccaggttccgggccatctgcagatggcaggcctgctgaagaacaagtacgtgaatatccagtatccgtgggatggccacgagaatccgctggagccgaatgttccggaaaacaatcacgtggcgctctaccgcaagaagttcgtcgtgtccaagcgtcttgcggacaccaaggagtccagaggaagcgtctccatcgtcttccatggaatggcaaccgcaatctacgtgtgggtcaacggcctgttcgcaggttacggcgaggacggattcactcccaacgagtttgacatcaccgatctgctgcatgacggagagaacgttgtggcggtcgcttgctacgagtattccagcgcatcctggcttgaagaccaggacttctggcgtctgcacgggctgttccgctccgtcgaactgacggcacagccccacgtccatgtcgagaacatgcagctcgaagccgattgggacgccgagtccggcaccgcctctcttgacgccgcattgtccgtgcgcaacgcctccgatgccgccaccatctcagccacgttgaaggattccgaaggcaacgtggtatgggagacctcgaccaacgccgacgccaacaccacgttcgcgagcggttccttgcagggcctcgagccgtggagcgccgagagcccatctctgtacgaacttgaagtcaatgtcatcgatcaggccggcgacattgtcgaagccgtcgttcagaaggtcggcttccgtcgcttccacatcgaaaacggcatcatgacccttaacggcaagcgcgtcgtgttcaagggcgcggaccgtcacgagttcgacgccaagcgcggccgttccatcactgagcaggacatgatcgatgatgtgattttctgcaagcgccacaacatcaacgccatccgcacctcgcactatccgaaccaggagcgttggtacgatctgtgcgatgagtacggcatctacctgatcgatgagaccaatctcgaaacccatggcagctggtgcctgcccggcgacgtagtcaccgccgagaccgcggttccaggaagcaaggcgcgttgggaaggcgcctgcgtcgaccgcgtcaacagcatgatgcgccgcgactacaaccacccgagcgtggtcatttggtcccttggcaacgaatcctacaccggcgatgtgttccgtgccatgtacaagcacgtgcacgacatcgatccgaaccgccccgtgcactacgagggtgtgacaaagaaccgcgactatgacgacgtgaccgatatcgaaacccgcatgtacgagcatgccgatgtggttgaggaatacctcaagaacgatccgcagaaaccgtacatctcctgcgagtacatgcacgcaatgggcaattcggtcggcaatctggacgaatacacggcactggaacgctacccgcactatcagggcggcttcatctgggacttcatcgatcaggcgatttatgccagccagccggacggctccacccgtctgtgctatggcggagacttcggcgatcgcccgagtgattacgagttctccggcaacggactggtcttcgctgaccgtactcccgcgccgaaggcccaggaggtcaagcagctgtactccaacgtccatatcgacgtgaccgatcgttcggtgtccatcaagaacgacaatctgttcatctcgaccggcggataccagttcgtgctgcgcatcctcgctgacggggagccggtatggcagtccgagcgtcgcttcgacgtgcccgctgattcggcatgcacgttcgatgtcgaatggccggtggatctctatcgcgccaatgccaatgagctgttgcttgaagtgtcccagcgcctcgccgaggcgaccgattgggctcctgccgggtacgaactcgccttcggccagactgttgtggccggaacgaaggcagccgaagacgcggccctgcctgcggacggcatcgtcactgttggccgttggaatgcgggtgttcagggttccggacgagagattcttctttctcgcacccagggcggcttggtctcctacacgttcgacggtcacgaattcgtgctgcgtcgcccggcgatcaccacattccgcgcgttgacggacaacgaccgtggcgccggccatggattcgagcgagcccagtggatggcggccggccgttatgcccgttgcgtggacaatgtcatcgaacaggtcgatgaagacacgctcaaggccgtatacacgtatgagctggccacgccgcaacgcaccaaggtcaccgtcgaatacaccgccgataccactggccgtctgaacctgcatgtggaatatccgggcgaatccggcgatctgcccaccattcctgcgtttggcatcgaatggactctgccggtccagtattcgaatctgaggttcttcggcgctggtcccgaggaaacgtaccaggatcgcaagcacgccaagctgggcgtgtggagcaccgatgcgttcaaggatcatgctccgtatctcatgccgcaggagacgggcaaccacgaggaagtccgttgggcggagatcaccgatgaaaatggacacggcctgcgagtcagccgcgcgaacggtgccgcaccgttcgctgtgagcctgcagccatattccagcttcatgatcgaagaagctcagcaccaggacgagttgccggctccgaagcacatgttcctccgtgtgctcgccgcgcagatgggtgtcggaggcgacgattcctggatgtctccggtccactcccagtatcacatccccgccgatcagccgatcagcctcgatgtcaatctcgaactgatctgacgatcggatagcgtgtccctcctctgcgccttcctgtggaggagggacgacatcgtcttgcaaggttccttcaccttggtgtaacaggtgacgatgcttcataacgcagaagatgcggcatagattcatgttttccatatgccgcgtcttctgctcacatcaggcctctttcgtatggttttcataaagatggcacgaaactgtccctgaccaccaattttgcggaaatcctcacgtgctggtttacggatcgtctggtggacagcgcttccgacagcataaacaccgcggccttagctaattcgtctttgttgatgtcgtacgatgacaacgcgggcgaggtatactccgctatctcttggttgttgatgctgaccatgcgtatatctctcggcactaggattccaacggacgcaaatgcttgaagtacgccgactgcaatcggatcggcagcaatgatgacggcatccggaaggtcgttactgtgcatttgtatgagtttttcaccgagagcgcgtccgttctctatggtgaacggtccttcttccaagacgagaccgttgatgtcaagtccgagacgtactgaccaattccggaacgcgaacgcacgggaatcttccggatactcatgatcgcccataatgtttccgactccgccgacgaaagctatgcgtcggctcccggaggcggtcagcgtatccaacgcgtccaaaacggtttgttccaaatctggttgcaccgaatcaaacaagtctggtgccggattaatatcgatgaatactccatgctgaaaagcattatgcaatcgtaggagcacatccttcccaaacggtgccggaccgatcgaaataaaaccagcatgcttgcccttattcttgatgagatcgttcacattacgatactcagttatatgcatgcgctcatcttccgcatgctggtagaggaacgccttgagctcgttggagtacatgtcttgcaaacctttgtccggaacggcattgtccaacaaggcgatgtcctgaggaatggtgacacgctggtatcgcggcacattctcatatcccaattcaaggctggcgttcagaactttttgacgggtggcctctttgaccgacagcgaggaatcgtcattgagtatcctcgatacggttgcaggggagaatccagccctttctgcaatctccctgattgtagccatgacaatctacctcctcttggtagacgaaagctaaacaaatttagtaacaagtttatcatgtttcgctttagagattcactggaaaatggcgggaatctctttttccgtcaaaaaagattgcggaccgtcctcccctattaggaaagacggtccgcaacatttcgtaacggatataacgcaatacgttaacgccggatggatcccttgaatggcttatccggagatagcgcgacacgtcccatatcagtccccagaacgttcagcgtaatctccgtgggcttcgaacagcgcaacgtatattccactgtctgatccgtccatgtcgcatccacttggattccgcctcttgcgcggagcgcatggaaggttccctcatgccaatcctccggcagggccggaagaatgcgaatccagccatcgtggctttggacaagcatctccgacaaggccgctgggaatccaaggttcccgtcgatctggaacggcgggtgagcgcataatccgctgtcgtacacgcctccgcccaacagattggtttcagcgttcgcatccaccggccgcaggaacatgcctatgattcgtttggcatgctccgcatcacgcagacgcgcccacatgatcatgcgccatacgatgctccagccggagccatcatcgccacgcacttcgagggatttcctagcggcttcctccaggtgcggagtcttagacgtgatgcctgcaccaggatgcagttcgtaaaggtgggacagatgacggtgctgtggatcggattcgatgaattcgtcgttccattcgaggattcttccatcagctcccaatcgcgtttcagccagttgggaacggacggcttccgcttcacggaccagatctctgtcctcttcgtcaaggttttccaaatcgtgagaagcctgaattaaatcatcaagcagattacgcacgatggccgtggcattctcactgctttgtgcaacggacaccggttctccgttcaccaagaaacagttctccggtgatgttgcaggggacggggccagtccatgctctgtctccgataggaaatccatgcagaatcgcgcgttgtcccgcatgatcggccagatgcgggccaggtacgatgcatcctggttgaacagatattcatcgaacaggttccggcacatccatgcctgaccgaacggccagaacgaccacatcgggtcgccgttcgcaggaagggctctgcgccagagatcgacattatggaagaccgccgatcctcggcagccaagaatcctgtcagcagcgtcgtgccccggcgctagcagctcctcattcatggagacgagcggctcgatgagttcttggagggcgcatgggcctgtcatccaatagttcatctcgacgttgatgttcgtcgtgtaggcgctgtaccagttcgggaaatccttatggttccaaatcccctgcagattcgccggctgggtgtgtggcctggatgaggagataagcagataccggccgaaatcgaacattgcctctgccagcatctccagacgatgcgattctttgttctcatccgagcgaaggatcgccgagaacagtagttccgcatcatcagcatgggctgaaccgagatggatggccaccctgtcgaaatatctgcggtagtccgcgatgtggcggtcgagcatggtctgcaggtcagtcgaccactcgtcaatggttttctccagatggtcggcgataaccgtcatgcttcgttccggctgctggtcgcttcccttgaatccgctcatactgcggaagcggagcgataacccggtgatgttcgaacattgcagactgttgtcgcccacgttgatgtcgccacctgttacggtaagggagaacgcaccggcgtacgccattccggttccgtcctgctcatcttcccaaggattttcggaagggtgaggcagaagtccgatgttgagtccaggcatccgacccatgacgatgagggtagcccgatggccgtcggataccgtttccaacgaagcgcgtgattgcttgaggaaagtgccggagacactgatattcacatcaatcggcgcatccgatgacatcctgtagaccaacaggtcatcaggctcgctgcaccatgcgtcgacatgaacgttggcatcacccatctggaacgtttcaccggcgagcgcccttgcaagatccagctggcgtttcatgctctcacggccgtctgcagaggtcgagtactgaatacgggccgttccgaatggctcgtaaatctgctcgtctttttcctgcagtgtggcttccttgatgattcgcgtggcggtggcgtaatcgtcatgcaacgacgcctggcgcgccttggccacaatctccggcgtcaccggcgaggtttccgcgtgtggatatcctgaccaaagggtgtcgtcgttgagatacagcacgtcggtttccggttcggagcacaggaccgctcccatgcgtccattgccgagaggaatgccttcttcccagcacgaagagattccatcgaatgtaagtttcatgcgtaaagtctccttggcagatttgcttatttgagaatgctctggatattgcggtactgttcgtcggtcagctgcacggcgggttcatggatggacgtgtcgattggcagtcccttcgccttgaccgcgcccttgatggcgctgatgaacaggtcggcagtgtcgtacaggcgcatcagataggaaatgcgttcagccgatttgatggccatggcgtaatcaccggactgccatgcatgatgcaggctgacgaaagtctccggctccacattggtcaatccgcacagcacgccattgccgccgctgattcggttgacggtgtagtattcgtcgaatccggacagcacgctgaacgatggattcaccttacgaacggcagcgatgaccttcctggtgtggctgatggtgtcgacggtgtctttgacgccgatgatgttctggttctccgctgcgagatccgccaccagctcgggtgtgaggtcgttgcccgtcctggctgggaagttgtacagaatgaccggcagcgtcgttgccttggccaccgcagagaagtagcgcttcgcgcaatccggggatggtccgaaatagtacggggatactgcaaccaatgcatcggctccggctacttcgctttccgccgccaatgttctcacattgtctaggttggtgtctcccactccgacgagcaccttcatgcgtccggcgactttcgaaactgcgaagcgcactgcttctgccttcgtcttgacgtcgatggcgtagaattctccgatgctaccgaacagcagcacaccgtcgatgcccgcatcgatgagatgatcaaggtgcttgccccaattgtcgtagtcaatggtcccatccgcgttcgtgatggtgatggaggggcagaacacgccttcgaactgggcgttgcaagtcatgatattttcctttcgacgatatggtaggcgtttcgcgcgttattgaggaagaagtcgtcattccctgcgaaacggttaagcaggattgacagatgactgtcgaaatcggcgtatagaccgacgacaggccaattcgacgcatacagcaaccgcttgttagagaacgcggcttgtgcgagatcgagcagggttgagacgaatcgtgggtcatcggttggataccccgataccttgacgtatacgtttggcagctctccgagcctatgcaaggcatcggatgaggattcgagattgtgaagatcggatatgttgcccatatggtcaacgatgacgattgcttcgggcacctgctcacaagcctgagcgagatcgccaagttcatccacccttacgcatgcgtcgaatggcatgttcttatcggccataagctgcaaaccgcggatgaagtcatcttgcaggcaccgtccccgcggcgatgccggcgtatgcaatggctcacgaacgccatgcgcgtacagcggcacgcgcatggccggcccgacggtggaccgcatagatgttgccaacagcagaggatcatggttttcggacagcagccgatcttccaatgacgtatcgtccgtgtcgacttccacatacacaccgccgatgaaattgaccgcagcgtctgggtggtgctcattgtatgaggcataggcgtgtttgaggcagtccatgtcgtaacggcgggtgatggacccatccgtaccgtcgagccatgaaagcggttggacggatggatcccagatatggaaatgcgaatcgatgatcctctgcatgtcgcacgtcctagtcgagtgccctatcgaggtggacgtatccgccgtcggggaagacccattgtccggtggtgtgcgaagacctgtcggacagaaggaaagccacggtgtccgcgatttccgaagtctcggtcatgcggtggccgagaggaatcctgtcggtgatcttcgccaactgctcacgctgcgcctgctcgtcgccgaacgtcttgatccattgcgcgtacagcggcgtccatgcttcggccacgacgacggcattgacccgaacctcggccggggcgagggcggcggcccactcgcgggtcaggcccagaatcgcacctttcgctgcggcgtaggcgctagtcttgccctgaccggtcaatgcggtcttggaaccgatattgaccaccgagcccttgctggccttgagtgctggcacgcactgatgaaccagctcgtaatagtgggtcagattgccgtgaagagactcctcgaactgacgccatgacgtggtctcgagcgcgaggttgtcgtttctgccggcattgttgaccacaccatcgatatggccgtatttcttcatgaccgattcaacaatgggggcgatctcatcggtgttgttcaggtcaatcagataggtgtcatacgaatcggtgatctgttcgatatcctgtcggaattcgtcgtcggcaccatccgaacgattcagcaccaccggaatggcaccttcttcggccagtcgcagcgttatgcccttgccgatgcctttgaatcctccggtgacaataatcaccttgttcttaagatgcaggtccatctcaggtccttccgactagtccttgtgcaggtacttcatgcattcgtcgagcttcatctccgtgccgttgcccggagcgagcggcgcgacgtatcgtccgttcttgatgacggtcggatgtacgaaatactcatgctggttgtccacgtattcgacgacgcggtcctccatctcgccagagacggacacgtaatcgaacatcgcaagctggctgatggcttcgcacaggccgacaccacccgcgtgagggcagaccttgacgccgaacttcttggcgagcaggtattcgaggacgatttcctgggggccggcgactcgggtcgcgtcaatctgcatgaccttgaagctgccagcctgcaggtactgcttgtacatgactcggttctgcatctgttcgccggtggccaccggaatcggatcgatggccttctggattgcggcatggccaagaacatcatccgggcaggtcggttcctcaacccacgcgagatcgtagtccttgaatttgccgatccattcaatggcctgcggcacatcccagacctggttggcgtctacggcgatggcgatgtccgggccgaccgcttcacgggcgagcttgagcctgcgcagatcgtcttcgaggttttgaccgaccttaagcttgatctgcttgaagcccatgacctcggtctcttgcttggccaaacggaccatcttctcgtcggaatagccgagccatccagctgcggttgaatatcccggatagccgacttccttgaggtgggcgatgcgttccgccttgccttcctgggcggcacgcagaatctcgatggcttcctgcggagtgagggcatcggtcaggtagcggaagtcgagagtcgcaacgagctcttcgggctccatctcggaaaggagcagccagagcggcttgccggcgcgcttggctttgaggtcccacagagccgaaagcacggcaccgattgccatatgctcgacacccttctcagggccaagccagcgtagctgcgaatcgcgcacgaacatatcccatgcgagacgcatgttgtcgagcagttcctcgacgttgcgtccgatgagggtttcggacatggagtcgatggctcggacgacgacatcattgccgcggccgatggtgaagacgaatccgttgccggaatcaccggcatccgtggcgatgacaacataggcagaggaataatccggatcggggttcatggcgtcggagccggagaaggtggccgatgtcgggaatcggaaatcataggtggtgactttggtaataacgctcacgatgcgcttccttctttggaaaaatgtttaatctcaaaaagggagggcggccattcggccgccctccctagcggtggcgggcaaccggatgtcagtcggcgtcagtggtgaccttaaagccgttgtcttccgcgtatgccttgagcttctgctgagccttggccatggcgcctaccagatcgccgttctcattcatctccggcacgatgacgtcgttgaacacgacctccacctgagacatgaacgggagatactcccaatcggtattgacgttatccatggaatcgaaatagaccgagttaacgtccgtattcgcgaagtatccatcggtttctttcttctcgcgcaccgtcttatcgtcctgatagacggaagccgccatgaagtaattgccgctgttggtatcctgccaagactggatggcgtccggagcggaatcgagccagttgatgaaggcaagggctgctgcttgcttttccttcgggcatgccgcagccacgctcatcatggagccgacggaggaggactggaaatgctggttgttccaggatggcggagttgtgaccaccatctttcccttgaggctcgggttctggtccttatacatgttgcccatccagttttcgctgatgaaggtggcataacggccatcgttgaccgaacggttgaactcgtcagtgtagacggtaccgccttcaaggacgccatccttcaggcacttctgcaagaattccgtgaattcctttgcttttccgctgttcatagtcagttcgacgtcgttcacggaattaaccttccacagacgcgctccaacggagcggtagaggttggtgaagatggagatgtcagatcccaggattcccatatacttgttggaatcttctttgtggagcttcacgccctcgttgtagatatcttcccagctttctggcacctgcaggttatgttcgtccaggatatcctttcgcacatagttggccaatggcgtggcatcctgtggcacaccgtaaaggccgccggcgtaatgcacctgagcccatgcagtcttggtgtacaacttgctccatgccttgtcgatgctgtcgttggcaaaattcagcaatgcgcccgaaaccgcaaactgctggaatttattagcgctcatctgtacaacgtcggggatgtctttattggcctgaacgacattctggaacttggtgaaatggtcggcagcggcaccggtgttgacaaatttaatcttgatatgcggatacttctcctcgaatgccttgacggtaggctccatctgcttggcggaataggcccaaacggtcagttcgacgttcttcgacgtatcggtcagagcgctttccacttccttcgcggtcacttcgctcttagcctggcttccgttagtgtcggaaccacatgccgagatcccggccgtcattgccagcgccgcgatagcggccacaagcctgacactcttcttcttcatgattactcctttgtgtgtcatgaattactattttgttgttttttcaaaaggacggatgccgcacggtcaccaaggcaacgaatgggtgatcgtagggaccgtgcggccgagggttcactgcttgacagaaccggccgcgaggccagactgccagtacttctgcaggaacatgaatgcgatgatcaacggaacaactgcgataagcgagcccgtgatgatgaggttgttcggaacctgaccgttggcagttccctgggcacccatcttcagccacatgttcagaccgactgtcaacgggtagtcgttggtgtccgagagcatgatcagcggcaggaagtaattgttccagacgccaaccagcgtgaacagcagtacagtgacgaaacctggagacagcagcaggaaaccgaccttccagaagatggtccaagtgcttgcaccgtccagtttcgcggcttcaatcagcgagaccggaatcgaggtctgcgcatagatgatcatcaaatacaagccgaacggcgtagccagctgcggaataatcacggcccatggagtgccgaccagaccgatcttcgagtacatgaggaacagcggcacggtgattaccgtagaaggaattgacatgaatgccaaagtgacggccagcagggcgttacgtccggggaatcgcatggtggcgatggcatacccagcgaaagtggcaatgatggttgcaccaacacctgcgaccgctgcgtacatgatcgtattaaacagccagcgggtataggcgccattctggtaggcgaatgtgtcttgcacgttctgccagaacacattcttgtcatcgaaccacagaccaaaagagctgaagatgccctcactggtctttgtggaggagaagatgacccacagtagcggcacgaggcagtagatgaccatcaaaaccataatgatgtgcagcagccagttgagcacacgctgcttgccggtcagcttcggagccggctcacgttgctgcatgcgcttgtaacgcttgcttgccttaagcgccagtttggcgtctctgcgctgcagcgacttggaacgtggttttgcgattgcttcactcatcacttgttctcccacttgttgccgataatcttaacgacggcgaccaaggccatgacgatgatgccgacgaccagagagacggcagcagcatagttgacgttctgaccattgaatgcgaggttgtaggtgtagatgttcggcgtatagctgctgttgatcacgtccggggcagaagtacgcaagatgttcggttcgttgaacagctggagcgtgccgattacagagaagaggactgtcatcacgatggtgctcttaatctgaggaatcttcacggaccaagcgatgcgcagctccgaagcgccgtcaatacgggcagattcgtacaggtcgttcggaatgccgatcagtgcagaataataaatcagcatgttatagccaaggaagcaccaagtgcagatgtttgcgatggcgaatagcatgagctgcttcgacagcatattaggagccgttacgtcaagcatgccggcgatttgtccaaaaagaccatacttatcgccgtaaatgtatccccacatcagcgctgcaatgacgcctgggacggcataaggcaggaacagcagaattcgcagcactgcgatatggcggattctctgggagtccaagataagcgccgctacgagggacagaatcagattcatcggaatctgaatcgccgcgtaaatcagcacattcttaaagccgccccacaaagcctcatccttgaacgctcggatgaaattgtcgaagcccgcgaaggtggtgccaccgagaagggactgcttgaagaagctgagataaagcgcgtagaacattgggatgatcatgccgaacaggaagaccaccacgtatggaagacaatacaatatgcctatgtactcgcgcttcggcttgcgcatcccggaagtatccggtttcgccgttgcatttgtcatagtttttctctttcttcttaacccgtctgaatgagcctgccaacaacatcgttgccattgccgtttcatccatcggtacgttcaatatacaaggttctgcaaaaaagagcaaataaaacttcgttatgcgtggcgaaattttctttatcttattttttggccttggaaaggctttattgcaacgatatatgcacattacatccatcaggcaagcagcagaagatcaacgtccacggcacacatttccgctatatagacagcaacacgccgataaaatatctatttcaaggtaacgaaaatttcgctatcctgtaggtaacgcttttttacagcgtgcatacgaaaagagaagagtcatgaccacaatcaaaacaacaagcagaccgaaggtctccgatatcgcccaagcggcgggagtatcccccgccaccgtatccaaggtcatcaatggccgcaatggagtctccgacgagacacgcgatcgggtggaactgctcctcgaagaagccggattccgcaaaaaacttcccacaaccaaaaccatgcggtcaatcgaactggtcgtcaacgaaatgaccaacaacggctccgtggagatggtcaaggaggcaacttcatacgccagagattttggcatcggcatcactgtaagctgcgccggaccggattccgaagaacacgcgacaagaaacgaggccagcagctgcctccgcagcgccatcgaacgcaacccactgggcgtcatacttctcttatcaaatatttcatcggccgaggaatcgctactgcagacgaggaacatcccatatgtaattgtcgatccggtcgggcaggtctccgctgacgcattgggggtgggcattgataactggaccggaggaatgctcgccacgcaatatctcatatcattgggtcaccgacggatcgccgtcatcaccggccccaccaattcacaatcctcgcaagcgcgactgagcggatacatggcggcgctgcagaaaaacggcatcagcgcggatccgcatctcatcaaggttggcgactacgtatccgataaggcatacaaagcggcatgcgatctcctggaaatgagggaacaggaccgaccaaccgccatcttcgcgttcaacgatctcggcgcaatcaatgtctatcgcgccgcccgacagcacggcatcagtctgcccgaacagctatcgatcatcggcttcgacgatgtctatcctgcggcaagcatgtgtccgtccctgacgaccatcaggcaaccattcaacctcatcgccaggcaatgcatcgacctgattctcgaagcgcgggaagggaaggtggaacagaattacttcattcttcccacgcaactcgtcgaacgcgaaagctgcacatcgccagcactgccgtaacatgcaacggcactgttgccatcctccggaagcaacatcgcattcgtgagatcacttccagaggagaccgtctatcatccgcttacccccgccgatgtcgttccggttagtccaatcgggaacgatgcggaggcgctcgcatcgttcaaggatgatccgtggaccggcatggacggacgtcccgcgatcgtgtccaacgcgtacggcgatgagcgcaacgtgtacggcggagcacgtctgggccacaatggcatcaccaagagcctgccggccgacggggagccgatcgtcatgtcgtcggtcgagcgcgatggaacgattgctaccatcaacctcaatggcgtgctgatcatcaagaactaaacgccatcatccaatcggtggcttccagcttgttgcgggaagccaccgatttttcctttccccatcgaaaaacaccgcaaaacagagccttcctgtgattaaaaaacgcagagttcctgaggactgggtttacccggccttccatgtatcgcgcaccaaagaccatttgccaataagcttttgccccccatgacgtaaccgtacagtcccgctcgaacaagcatttcgataaaatctaaaaactatcgaaatcatcgaaattatttgttgaccaaaattcgcccgccttaggatatcgactaccggccaagacgcccagacctgcactccgcgtcgatgccgcttaacagaaagaaggaaaacgatgaagttttttatgaagaagaaaatgattgcgctttgtggcgcagcggcgatgattctcccattggcagcatgcggaacgactcaggcggggaccaccgatgaacagggtaagacagttgtcaacgtttgggcttgggacaacaacctcaaagccaacgccaaagtattcatgaagaaaaatcctaacatcgtcatcaaattcacgaacgccggcagcggtaaagatgaatatcaggcgctgaataatgctttggaagccggcagtggagtgccggacatagctatgattgaatactatgcaattcctgaatacgcaattaagggatcactcaaaaatctgaatgattacgggactgccaaatataaggatttctacactcctggcacttggaacgcagtgaactttaatggcggcatgtacggcatgccagtcgattcaggcccaatggctttttattataacaaggaagtgtttgacaaagccggcatatccgaagctccaaaaacttgggacgaattctaccaagatgcaaaaaagatcaaacaaactggctcatatatcaccaacgacccaggaaatgccggattcttcaacgcgatggtttggcaggccggcggccatccatattccacgtctaaggatggtaccaaagtcaccatcaagctcactaccgataaaggggtacagaaattctgcgatttctggcagaagatgattgacgaaggactcatcgaaacgaaaactaaagatagttccgacgactggtaccgctccatcggttctggagaattcgcgagcgtgatttccgcagcatgggctccgggaatgttcctgaacaatgctccggaaggcgccggaaagtggagaatcgctcaaatgccaacatggaatgccggggagaacgttagctccgaatacggcggctcctcactcgcattgatgtcatcttcgaagaacgccgatgccgcgtacaagttcatggaattcgccagcactaattctgatgccatcatgtcccgagtgaatcagggtggtttccctgctgatttaaagaccatgtctaacgatgaattcctcaatcagaccactatggtgaattccgatggagacacagtggactacttcggtggagaaaaattcaacgctgaatttgccgaagcggcgaagcatgtcacttccaagttcgagttcctcccctacgacgtttacgcacgaagcgttttcaccgatactgtaggagccgcttacatggggcaaacaacaatgaaggaaggcgtgaaggcttggcaggacaagcttgtcgagcaaggtaagagccaaggcttcacggtgaacgaataaaggatggtaatggttggaatcaaggacgtggcagccctcgcaggagtttccatcagcacagtctcctatgtgatgacaggaaaacgtccaataggagcaaaaactcgtcaacgggtattacaggccgcacgtgatcttggatacctagcgaaaaacggcagtccagctccattgaatggagagactcatttcgttgcgttgagctcgcccgtccatgattccaccagctacaccaattattgcgcatattttctcaatttcctcaaagcagcgagacaacttggctatgaaacattgctgctaaccgaagaaacaggggatgagcagctgcgttccatcattgacaccggaatggtagatggcgtcgcacttatggatgtgaccatgaatgatccccggatagagttagctcagttttcgaccatccctttcatttccatcggacatcccatggatgaaataaacgtaccttgcattgataccgatttcatcgaaatgggcgaaatgattatgcagacgcttcaccgcaatggacatgacagaatactgtttataggagggaaaaagattgattatgaacgcgctggaggcgcgaattaccttattcgactgagaacatcaatgcatgccgcagccgcgcgttacggaatccatatagatgaagaatttaccgacaatgatgatttcgatgctgcagagaacctacttgaacggttcatttcagataaaaaaatacagcgatcgtaacacaaggcgggccgttgttcttgaataaccttgttgcggcaacgagacagcgtggaataagaattcctcaggatctttcgttggtctcagcaggaacatacacggattctatgggtaaacgtctgcgaatagatgaattcccacttatgccagccgaattgtgccaactaggcatgaatatgctggttcatctcatggacgggaccataaagcgaaaggaaaacgccacactaattcatcccatatataagcaacgcggatctataacatcgctttgatgaagaacttgatttactaaggaaacaaaatatgactgatttcaatcgttccacccttcccgacaccgtgcgttccaacggcgcgaccccgaacccgtggtgggccaacgcggtggtctaccagatctacccgcgttccttccaggattccaacggcgacggcgtcggcgacctgaagggcatcaccagccgtctcgactacctcgccgacctcggcgtggacgtggtgtggctctccccggtctacaagtcgccccaggacgacaacggttacgacatttccgactatcaggacatcgatccgctgttcggcaccttggaggatatggacgagctgcttgccgaagcgcacaagcgcggtctgaagatcgtgatggatttggtggtcaaccacacgtccgacgagcatgcttggttccaggcttcccgcgacaaggacgatccgcatgccgactggtattggtggcgtccagccaggccggggcatgagccgggcactccgggtgccgagccgaaccagtggggttcctatttcggcggttccgcctggcagtacgatccgaagcgcggcgaatactacctccaccagttctctaggaagcagccggatttgaattgggagaatccggaagtgcgcaaggccgtctacaagatgatgaattggtggatggatcgcggcattgacggcttccgcatggacgtcatcaccctgatctcaaaacgtctcgatggccacggacggctgcccggagaaatcgactcggaactatccgagggcgagatgggcgaagagggatacacggacgcaagcccgttctgctccgatggtccgcggctcgacgagttccttgccgaaatgcgccgcgaagtgttcgaggggcgcgaaggctacatgaacgtcggcgaggcgccgggcatcactccggcacgcaacgagttcatcaccgatccggcccacaaggagcttgacatgctgttcctcttcgaccacgtgggcatcgaccaggaaggttccaagtggaacaccgtgccgttcgaagtcaagaatctgcgcgcccgcctcgccgaccagcaggaggctgtgaagaacgccggctgggccagcctgttcttctgcaaccatgatcagccgcgcgtcgtctcccgttggggcgacgacgctgatcgcgagtcgcgcgagctgagcgccaaggcgttcggcatgctgctgcacatgcaccgcggcaccccttacatttacgagggcgaagagctgggcatgaccaacgcccacttcaccacgctcgagcagtatcgcgacctggaatccatcaacggctaccgccagcgcgtggaagaagcaaaatgccagtccgcagaatcgatgatggcggcgctcgcgctcatcggccgcgacaattcgcgcacgccgatgcagtgggatgcctccaggtatgcaggtttcaccgcgccggacgcggcgacggaaccgtggatcggcgtcaatccgaatcatgtcgagatcaacgcagccgaggaattcgacgatcccgaatccgtgtacacgttctacaagaagctcatcgccatgcgccacaacatgccgataatcgctgtcggcgatttttctccaatggatgcgggaaacgatgatgtcattgcttttcaacggcatctggaagatacaaccatcatggtgatctgcaatttgtcttcaaaaaaggcaaccatatcggaatcactcagaattaatgacaacaaacaacaagtactgctttccaattactcgacagctcacgctttcaaatctatgcatgatggcgtacttgatccgtgggaggcgataacagtccagttgtgaaacacaacttttacgacacgcataccaagaaaatacttaatgccggaccgatgatgtccggaatgattcgcacgtaactatatgcaactactcggattgagatatcgataacaaaggaagaagattgatgataaagcagcgaagcgtgaatcagattacgggaataaagagttcgtcggtgcgtgtgaacaggcatcgggcggattggcgtggttggaagttcatgtggccgttcgcgttggtgttcacttttgtgttcatcattccgattctgtacgcgatctacatcagcttcttccagaagcagatggtcgggggtacccagttcgtgggaatcaacaattacattcgcctgttccacgaccagcagttctggagctcggtcggcagggtcgcgctgttcacctgcgtgcaggtgccaatcatgctgttcctgtcggcggcgatggccctggcgttggattccatgaagctgcacggcgcgaagttcttccgcatctccacgttcctgccgtacgcggtgccggccgtggtgtcgactttggtgtggggcttcatgtacggcgcgaagtacggtctggtcggctccctgaacgactggctgggcacgaacctcgacgtgctgagcccaagcgtgctgctcgcttcgatcggcaacatcgtgacgtgggagttcaccggctacaacatgctgatcttctacagctcgctgtccacgatcccgcattcgctgtacgaggccgcctcgatcgacggggcgtccgagtggcagatcatcaagtccatcaagctgcccgaactgaaaggctcgctcgcgatcacggtgatcttctcgatcatcggctcgttccagctgttcaacgagccgagcatcctgcagaacatggtgccgggcaacgcgatcaccacgtactacacgccgaacatgtacgcgtacaacctgagcttcgcgggcaaccagtcgaactacgccgccgccctggcgatcacgatggccgtgatcacgatggcgatcgcgtacgcggtacagctcaacagcatgaaggagcagatgaagtaacgcccggtggcgcgaaccatccgcatataggggaagaaacgctaaggagcatcgaaaatgagtgacgcaacaatcgccgcgggcacggagcagaggctcaccgctcaggagctcaaagcccaggagaaggccgcgaaaaagaccgagaaggaacgcctcaagagggtcgcgcgcgacgagaaggccgagcgcaagagggctgcgaagtccggcttcgcgaacgtggcgaacccgcgcaggagcacgctgctgaccatcgtgtgcgcgctgttcgcggtgtactgcctgttcccgttcgtgtacctgctgatcaacgccacgaagacgcaggcggacttcacgtccacgttcggtctgggcttcggccgcacgttcgctttgtgggacaacatcaagaccgtgttcacctaccaggacggcatcttcggacgctggttcctgaacacgatcctgtacgtggtcgtgggcgccggcggcgcgaccctgctcgccatcatgggcgggtacggcctggcgaagttccgtttcccgggacgcaaggccgtgttcgcggtgatcatcggcgccatctcggtgccgggcatcgccctggccgtgccgcagttcctgctgttcgccaagctgaacctgacgaacaccccgtgggccatgatcatcccgagcctggtgtcgacgttcggcctgtacctgatgtggatcttctccgagcaggcggttccgacggaattgcttgaagccgcgcgagttgatggagcttcagagttccgcacgttctttcaggtgtccctgccgctgttggctccgggcatcgtgacgacggccctgttcacgatcgtggcgacgtggaacaactacttcctgccgttgatcatgctgaaggattcgaactggtatccgctgacgatcggtctgaaccagtggaaggaccaggcgagcaccgctggcggtcaggcgatccagaacctggtgatcacgggctcgttgatcacgatcgtcccgctggtcatcgcgttcctgtgcctgcaaaagtactggcagtccggtctctcggccggcgccgtcaaagaataacggagccacagtcccaccgactgccccgcaccacgattgttgacgaaaaacggtaatcgaaggcgcattatgtgcataaggaggacagaataaaacaagatgaagaggtgtgtgcatctaatacttgcacacacctcttcatgtattgcggcaaccgagatatgcggatagcatccgagcttcacacagaatcagcctccatgaagcacccctgtatatgcaacatgtctccatcacaagcatttatttctgtttactagatgaagatacaaaagaagcgatgaaactgacgagatttcacatcagaggtatgcctacaatgaagccacaacggaaaaacggctccgcacgaagcatgaaccaacaaacgaaacgacgagccgcgtgaaaggaagaaaaatgcagaacaataccttcgaccagatcgccagcgccaacaccgtttccatggatgccggcctcagccagttcgccttcgccaaagcctcctccaccttgttcaagaaggttttcagcaagtaagattcctaaaagtctttatcaaacgcctcggctgctgtgatgaaccggttcagcagccgaggcgttctcatatatgctcctgtaacgggcggagacctccccgcccgttacagaccgtccggcggccagtcgaaacaaatcgcggttacgcgccgaccaattcgagcatctgcggaatgctcttcttgccgaactcgacccgctgcgtgccgtcggcccgtgtgatgacgatgcagggcacgctcattgcgccgtattggtccttaagctcaggaaaatgcgaaacgtcgtaggcctcggcgcgcacggcagggtttagcgaggcgaggcgttgggaggcgagcactgtctccgggcacatcgtgcaggtgagcgagacgagaatcatgatattcagcgggcttgcaatggactttgcccgttcgatcagatcatcgcccaacggctgaccaggaccagccacgttgtacaggcccagcacgaacgaattaaattcatgaccggagggcacgccatggaaggcgagaccagtcggctcgccatccaccaccatgcgcacgcatggacgcgctgccggcagcacgctgtcgacgtcgaataccgcacgacccgtatcatccttctcgtactcaccatcatccaccgtcgatttcagcttgccaccggacagcgcgaccaacgcatcgatgaatccccgcagttccgtggacagcggcgtatcgtccagttccagagcaagcgtgaccggccgagacatgcggccaaagaccacgttgagctgctgtctggtggcgtcggagaacaattcgccgggcttcctaacggcgttcgccgcggcatcggcgttgcgtttggtggcgggcgcaggcgtaggtgtaggcgctgtagcgtccaacgaggcagcatctgtcttcgttgtggactgctcgtaggcgcaagagaccgggcgctgtggcgtcaaaccggttttctcgctcatccgcttggcgtaccgttccaactccactgcggcaatagcgccatcggcggtggcagtaaccacttgccgcaggttcttggcccgcagatcaccggctgcatacacgcccggcaccgaggtttcgagatagccgtgcgtgaccacgtaaccataatcgtccagctccaccacgccgcgcaccagattcgtggcgggcacatatccggcgaacacgaacacgccgaacgtgccgccatcaacaggtttccacgtttcggtctggccagtggcccggtttaggatcgaagcttcacgtaaaccaccttgcccggcagtgacaccttgcagctcgacctggtaacgcacgtcgatcttcggattgttttttgctgcggcggccaccgcagcgtcgcaagtgaagtcctgttcccgtacgagaacggtaactttggaggcgtatgtggtcagaaacacggattcctcggctgctgcgaaccctccgccgaccaccagtacttccttgccggcaaagaactcgccatcgcaggtggcgcagtaggccacaccgcggccagcatattcggactccccttcgaaccctagtttgcgtgggctggcaccggtggcgatgagaataccaaaagctttcaagtcgccgcgcgaagtatgcacggttttgacatcgccatgcacgtcgaggccgatggcttcggcggaaaggaattcagcgccgaaatcctgcgcctgttgacgcatggtctgggtaagcgcacggccagtggtgcggccaacgcccggatagttgaccacctcattggtgatggtgatctgtccgccaaaatcatctttctcgagaatcagtacgcgatatcgggcacgggccaaatacaatcccgccgtcagaccagcgggaccgccgccgatgactatgacatcgtacaaatcatttcgagacataacgactcccttcgtgccttgatctggctattcaggaggtgcccggaggattctcctgggcaccccgtcggattagcttgacaagccgtccgtcaagcgacgatcacagttgaccaacaagatcaaggctaggttcaatagtgtcctcgcctggagtccagttggcagggcaaacctgatcgccatgttcgtggacgaactgagaagcttgcacacggcgtagcagttcttcggcattgcggcccacattggaagagatgacttcataagccacgaccttgccttcggggctcacaatgaagtcaccgcgttcggccatgccatcgacttcgttgtaggtgtcgagatccttggccaatagagcggtcgggtcggcaagcatcggatattgaatcttggcgatcctttcattggcgtcatgccatgccttgtgcacgaagtgggtgtcgcaggagacagagtagacctcgcatccaatttccttgaacttggcgtagttgcgggccagatcctcaagttcagtggggcacacgaaggtgaaatcagccgggtagaagaagaacagggaccagtggccgagcacatcagccttggtcacctcatggaactcgttgttctggaacgcgttcaccttaaaatcggtcagttcatgctgcaggagagtcatcatcggtcctttcgctgattgtcaattatcgggcttctgccgttttccatcgtaacgtgattctctggaatccgcgcgggcgtaacgcgtgagcctcatcacatcattactaacagtcacgctgacggaccatgcgatgcaagggtgttgtggattgggagcctcccgcgcgccgcgggaaacaagaaccaaaagacaaaaaaaggggttcccggagcgtcacgctcgacgggaaccccgacgttgaatgcggcggcgtgctactctcccacaccctctcgagtgcagtaccatcgccgcgaccaggccttagcttccgggttcggaaagggaccgggcgtctcacctgggccatgaccaccgcaaaaccaatataacggccaaccacaaggatcggccggcagaaccggaaccacgccacgattccgatcgtggcggtccgggaaccggacaacggacgcgagcaaccaaacgcttcaccggtatcgtttccgtgaccacaagaaacaatgctccttgccatccaacgaaagaaaccaccacaggacgagacccgacccaacaagcgggtcggaaaaagtgtgccgcgttcgcccgttagtaccggtcggctccacccctcgcggggcttccacctccggcctatcgaacacgtgttcaacatgcgggcttcggacgctccggggagcgtcaaggaatcctaatcttggagcaggcttcccgcttagatgctttcagcggttatccctcccgaacgtagccaaccggccatgccgctggcgcgacaaccggcataccagaggtccgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgcccgaaccgtcgttctcgcagtcaagcccgcttgtgcgattacactcgaaacccgattgccaaccgggctgagcggacctttgagcgcctccgttactctttgggaggcaaccgccccagttaaactacccgccaggcactgtccctgaacaggatgactgttcgaggttagacgtcaaacgagaacagagcggtatttcaccttgcggctccacacgggctggcgcccatgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcaccccaaaaggggctgacggatcctcttaaccttccggcaccgggcaggcgtcagtgcatatacagcggcttgcgccttcgcatgcacctgtgtttttggtaaacagtcgctaccccctggtctgtgccaccccccaacgctccgagggcaagcctcttcacgcccgggggtctcccttataccgaaggcacgggagtgatttgccgagttccttgaccaggattcgctcgatcgccttggtattctctacctgaccaccagtgtcggtttggggtacgggcggcgacgcccctcgcgccgaggcttttctcgacggcctggaccaccggatatcgcgtccaaaggacgcccatcatcacacctcaccctatgcgtcccacggatttgcctatgggacgggctgcgtgcttgaccacggaaaaccacctccgcggccggctcccattccgtgtcacccctgtgcgctagcctaccaggactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccacaaggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctcccgcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaacccaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccaccaggggcatccggaaaaccgcacgcacccaaaacggatgcgggtggcggtccgggaacccaaaagcatatccgcaccactccccgccggccccaaggacccgcgaagccaacgatctcttccacaccagcacgcccacacgaacccgggaaccatccccggcgcatgggccacacgacggacgccagaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaactttgcagaaagccaacatgtgactctcaaaaacaagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccgctcacccgcctcgaggcaccccaaccggggaaccactcgccgagcggcagcaagagataaacctacagcacaatcccattccacgcaaatcgggcatgacgaaacaagacgcggacccttgcaaacactggaaagcgtcggcgtgtcgaaatccgtctttcttacaccataaatcgcaaaaccaactccagcacaacccaaaaatcgtcagaaaaagctgattgccgcgtgtcacacaacgcaacaacacggcaatcagcagatcaacagcgcatcacagcaagtcacagacgatcggaaagccaatcgaacaccaaacgcaatgcgcgagcgctacggaatccgtaacaggcatggcaggcgttatcgagcttgtagaacgtcacatccttgccaagcgctttcaacgtggcatacaggcgacaactctgattgaacggcaccaactgatcgcggccaccatgcatgatcagcgttgacggagtgggcatatcggcactcagataagtcataggcgaagccggggcgctcaaatccggatgttcaagcacgtcaccgccatcaatcaccacaccttccgggcactgcggatcactgtggttctgcgaactcggataaaagttcatcttcgcgaaatcagtagggccatgccaatccacgatcgcgttcacttcgacgctttcctcggcataggcatccgtatcaggcgcgcgattgccagtgaacccagccatcaacaccgtatgaccgcccgaagaatcgccccacagcgcaatacgatccttgttgcaatggaagcgttcggcattcttgcgcatgaaacgcaccgcagtcttgcaatcctgcatctgcgcggggaacggcgcaatatcgctgtgacgatacttcagcgcagccaccacatacccctgctcggcaatacgcacgaaataattcgagcaatcggtcacattctgctcgtggaatgccgaaccgcgcacaaacacaatcactggccaaccaccttccggcattgcgccctcgggcatattgtcaacgccaggcgtgaacacccacatcggcaaatcaacactgctgtcatcagccagctgacgggtcacgtatgtaacctgctcgatattcacgggatatccgaaatcatcctggtccaagtcggaaatcacttggcagccttccggaaactcatcagtgtgcgggaagaacttagtctgctcgcggcgtcggaatcggggcaagctgtgtcggcgacggcggcgccaccatcgattcgatatcgattgccccgatcgccgtaaccgtctcggtcgtttcggcagtctcggccgcatcagcgccatcatctgcaatgttttgtgcaatatcagtagtcataatgcacctctcattcctttccatgcatgattattaagattgcttttctcgaatttgattgcccgatgttccctgtttcacgtgaaacatcagaagttacgtcgtgcggctatacctaagatatgagcaaaaagatcgcagtattgacgggggcggggatttccacgtccgcaggtattcccgacttccgtggaccggatggcgtctggactaagcaccctgaacaaacgcaagtgtatgacatcgaagcattcctttgccacgaggaagatcgcaagtattcctggcgttggcagaaggaatcacccgtgtggaccgcacagccgggcaccgcacataaagcgctcgtcaaactggaacaggctggcatgctgacgctgctcgccacacaaaacttcgacgcattgcatgaaaaagccggcaatagcagcgacgtcatcgtcaatctgcatggcaccatcggtacctcgcactgcatgaagtgccatgcaaaatatgacaccgccgacatcatggcgaatctcgacaacgaacccgatccgcactgccatcgcagactgccctacagcggcaacatgccatgcaacggactcatcaaaaccgacgtggtctacttcggcgaggcgctgccggacggcgcgctcgaaaaatcgtatcgactcgcaacgcaggccgacgaactgtgggtcatcggatccacgctggaagtcatgcccgcggcaagcatcgtgcccatagccgcagaggcgggcgtgccgatcaccattatgaacatgggacgcacgcaatacgatcggttggccgaccggcttatccacgacgatatcgccgtcgccctgccgcagctcgtcgacgaaaccatcaccgccgagcagtaagccgcacagtaaatacgttttctcgtacgtcttgcagtaccggcacaaatcgttggaattacaccggttttggttggtcgttaccaaaatccgaatttttcaacgacaaaaatccgaatgacgtaacggctagtcaagcaatataaacaacaaaagggtcttggattgctttgcgacaatcagaaatcatcgcaaggctttccaagacccttattggttatcaaatactgaaaaacggtactgaaatcagtaaatgcgcttcggctggaaaccggcttcccgcaatgcctcgagcacacgatcaatgtggtcgggaccattcgtttcaaccgtcacgcccaaagccacggcattcgcgtaatggctggacgccttgaactggtcgtgatccagcgcgataacgttcgcacgctgctcggccagcaatgtggcgaccttcaccagctgtcccggggtatcgggcagctcgacctcgaaatgcatgatgcggccacgcgtgatcatacccttctgaatcacagcgccaatggacacagtgtcttcattaccgccagacatgatcggcaccaccacatgcggacccttcgcctcagcgaacttgcgcgagcgcaggttgaggtgctcgagcgcagccagagacacagcgccggcagcctcaaccaccagcttgtgcttttcgagcatgagcaggatcatctcgttgatgtcacgctcggtcacggtgacgatgtcgtcaaggaattcgttgagcagcgcgaacgtgagatcgcccggacgcttcacggcgacgccctcggcggacgtgcgcacctggtcggcggcaaccacatgacctgcggccagcgaattcttccatgctgggctaccctccggaatcgcgccgatcacgcgcacttccggcttgaacgtcttgatggcgagcgccacaccggcaccaagaccgccaccgcccagcggtacgaccacgtcggtgacgttcggcacgtcttcgaggatttcaaggccgatggtgccctgaccgcacagcacctcgtaatcgtcgaatggcggcacgtagatcatgccttcggtgtcgctcaattcctgggcgcgggctgcggattcgtcgaacacctcgccgtacagcaccacgtctgcaccgtacgccttggtggcgtcaaccttcagcggcggagtgatctgcggcatgcagatcgttgccttcgcaccacgttcgcgagccgcataggccacgccctgcgcatggttgcccgcggaagcggtgacaatgccgcgagccagctgctcatcactcagggatgcgatcttgttgtaggcgccgcgaatcttgaacgatccggtgacctggagattctcaggcttgagcagaatctcatgtccggtcatgtcggacagcaccttggacggaatgatttccgtgtggcgcgcagtgcccttgagtcgttcggcggctagtttcagttcagctgcgtgatcgcgctgcaatgctttgagaacctcgttttgttccatgagcgttattgtaagcgtacgtctgccgaaactgccttatcatgcggctttcgcgatgaaaagtgagattgcttgcgaaaagtaatcacaagcaatcaggaataatcgcaatacataatctgataaatcacaatacaaataaagaaaaagcgttcgtacgatcccgtgatgaatcgcacgaacgctttttgcagagagtttataggaaagatcgatcagagctgaatcacgaccccctcccagcgagcgagctcgccgcgagcgaccgactttacgctatgcacagcatcataggtgctgagcagtacctgcgactcgcccacgccatcctcaagcagttgcgcgacctcagcaggcacctgcgccgtcctatcagtgagattgacgatgacgagaatcgtgtcgtcgccgctggtacgggtgaaggaatacacctgctcgctgtctgccgcgaccagattccattcgcccgtcgcgatggtcgcgttgttgtggcgcatggcgatgagcttcttgtagaagctgtacacggatccgggatcgtcgaattcctcggctgcgttgatctcgacatgattcggattgacgccgatccacggttccgtcgccgcgtccggcgcggtgaaacctgcatacctggaggcatcccactgcatcggcgtgcgcgaattgtcgcggccgatgagcgcgagcgccgccatcatcgattctgcggactggcattttgcttcttccacgcgctggcggtaggcgttgatggattccagatcgcggtactgctcgagcgtggtgaagtgtgcgttggtcatgcccagctcttcgccctcgtaaatgtaaggggtgccgcggtgcatgtgcagcagcatgccgaacgccttggcgctcagctcgcgcgactcacggtccgtgtcattgccccaacgggagacgacgcgcggctgatcatggttgcagaagaacaggctggcccagccggcgttcttcacagcctcctgctggtcggcgaggcgggcgcgcagattcttgacttcgaacggcacggtgttccacttggaaccttcctggtcgatgcccacgtggtcgaacaggaacagcatgtcaagttcgccgttcttcggatcggtgacatgctcgttgcgtgccggagtgatgcccggcgcttcgccgacgttcatgtagccttcgcggccttcgaacacttcgcggcgcatttcggcaaggaactcgtcgatgcgcggaccgtcggagcaccatgggaacgggctggaatagccttcctcaccaaccggataatcctcaatctcgcagccgtcttctcccggcagcttgccgttcttatcaacagtcttcgaaacctgcgtgatcacatccatacggaagccgtcaatgccgcgatccatccaccaattcatcatcttgtagacggccttgcgcacttccggattctcccaattcaaatccggctgcttcttggaatactggtggaagaaatactcgccgcgcttcggatcgtactcccaagcggaaccgccgaaataggaaccccactggttcggctcggcacccggagtgcccggctcatgccccggcctggctggacgccaccaataccagtcggcatgcggatcgtccttgtcgcgggaagcctggaaccaagcatgctcgtcggacgtgtggttgaccaccaaatccatcacgatcttcagaccgcgcttgtgcgcttcggcaagcagctcgtccatatcctccaaggtgccgaacagcggatcgatatcctgataatcggaaatatcgtagccgttgtcgtcctgcggcgacttgtagaccgggctcaaccacaccacgtccacgccaagatcggccagatagtcaagacggctggtgatgcccttcagatcgccgatgccgtcgccgttcgtgtcttggaaggaacgaggatacacctgatacaccaccgcgttggcccaccacgggttcggggtcgcgccgttggaacgcacggtgtcgggaagggtggaacgattgaaattcgtcatgtcgtggagctcctttgcttgacgtttgttggattttcgttcgatctttcgtgactgactctgcccgttttcagctcatgtcagcttcatgcagaagatcgattttgcctactcccctatggtatgcaaccctgtttttctttctttcccgcggcgagttgtgcaaagcaagaaaagaatacgcttcttacggacgcgaaaaaccaatccgcaaaaataaaaacgcgggacgttccagaaagggaaatggaacgtcccgcgctggggagtgggataggccagtcccgctcggtgctgtgaagtgttacttcctgaacggacggcctacggccgcgttgtccctgccttcactcgcctatcggctcgctcagggagagcctatgaacagaccactgggctgctcacttaacggctcccctcatcactccaccgacgacccacttctgggcgaagatgtagacgatgaggaccggagccatggccatcaggtaggacgcgaaggccatcggatagttcgacgtgaactggctttggaacacgtactgtgcgagcggaatcgtctgattgctctgatcggtcagcgtgatcaacggcagcaggaagtcgttccaagcccacagtgcggtcaaaatcgcaatcgtggcattaatcggacccatcagcgggaaaatgatcgtccagaaaatacgccaggtggaagcaccgtcgatacgagccgcctcttccaacgaaatcggaatcgaacgaatgaaaccaatcgcaataaacagattcgtaccaataccgagaatcgtgtacaaaataatcaaaccaagctgattatcaagatgcagcgaacccatttccttcgcaatcggaagcatgatcaccgtgaacggcacgaacatcatcgcaaggaagaagtagtacaggaaacggaagaatcgcttatccatattccttgccacagcatacgcgacgaacgtgttcgtcagcagcgtcaacaccaccgcgcacacggtgatgattgcggaattaagcgcggccttcggatagttcaccttattccacgcatcggcgaaattatgccattcccatgtggtcggcaagctgaacgtaccagcctcgctcggagtcttcaacgcggtgaccacagcgaaatacaacggcacgagcacggtaaggctcaacacggccacagccgcggtcagccaccagttgaccttatgatccctgcggattttctccggctttgcctgcgattgagtagtcttggctgcagtctttgcaacagttgcgctagtcatgatatttcctctttaccttcagactttcagacccttgctcagaccttctccttgccgctgaagaacttcagctgcacgaaggccaggattgccagcacgatgaagaacgtgaccgcgttcgccatctggtaggagtattcgccattgccaaggccgttctggaagatcagatacgagacggtttcggtcttggaatccgggccgcccttggtcaatgccatgatctggtcgaacgcgccgagcgaattcttgaggctcaacaccatgttgatggtgaagaacgggccgatcagcgggaaggtgatctgccagaagttctgccaagcgctcacgccatcgatcgcagccgcctcataaatctcgttgtcgatggtctgtaggccagccaaatacagcagcgtggagtaggccacgccctgccagattgacaggaacacaatcgggaaccatgccaaatccggattggaaatcattgacgtcgacagccaatcaatatgcagcgcctgaccgagcgccggcagcggcgtcatgaaaatgtacttgaacacatagccgatcaccaacaccgacaaggtgtacggaatgaagaagatcgcacggaatccgtttttgaacgcgattttcgaattcagcagcaccgcaaggaacatgccaagaaaattcgtgccgatcgtaatcaaaattgcgatgagaatagtgaacaggtacgcgtgaccgacgcgagaatcctggaacatcgcaatataattcttcaatccgatgaatttgaaatcaccataaccctgcgaattggtgaacgagtatgccgcgccctgcaggaacggccaatacaggaagatggacaccagaatcacagccggaacggtcatccaataaaatgccggatcgaccttgcgcttggaatatttcgaaaccttattcttggaattttctgccgagttcttcgcagtatttgcagtatgtgcggtagtcatgtccgttcctcctctcacctgaagtttctggcttcgatcttgtcatattcggattgcacgctgttcaggaatttttcggtgttgcccgactgaaccagcgtctgcaggaagcctgcgaggttgatgctggctggcacgtaatggtcgcagaagtcggccagtttgcccgcccggtagaagtcgagcacaccgttcagcgcttcatcgcccacatacgtgtctttgtagggggtaaatgcggactgccgcttggagtagtccttgatgttttcgtcgttcatcaggaagtcgatgaattcgcgcgcttccttctcatgcttggtgtgcgcacccatggtcagaatcacgtcatcgcctgccgtgagctgctgttcgctggcatcgtcggttgccggcatttgcgcgaaccgcaggttggcatcgctgttgatgagtcggatctgcggaatcgcgtaggtgccgagtggcagaatcgcggctttgcctgcggccagatcctgcgtggcctgctggtaagtgacggccggattcttctgcgtgtagttctggtagatctcgaccagctgatcgctgacagtgccccacaggtcggagaatttcttcgatccgtctttgagggaaagatattcggattccggcaccagcgtggagttgagtgacgccagcggcgcctggagtgtccacggatcggcggtgctcgcttcgatcggtacaatgcccttgctcttgaagcgttgcagcaggtcgatgaattcgctccacgtctgcggtggattgtcgggatcctcgcccgcttcctcccacacgtcggcgttgatgatgtagccggacgcgttgcccgcatacggcaggccgtacaggcgcttcttggattcgtcgttggtttgtacaaggctcttggcgatgttcaccatgcctggattgagttcgtcgacgatgtcatcgtcggtgaaatcgtggaaaacacccgcttcggcgagcatgccgaaattaatgtcgccattgatggtgatgacgtcgggttcacgatttttcaccagtcgcgtacgcagatcggtggttgcgtcggacgaattgttgacgttgactttgatgttgggatgggttttctcaaattcctttgcttttgcggtgaaccagtccgccgcttcggctttgaattggaagaaatccaaagtgacggttccagcggtgctgttgccgcaacctgcaaggccggccgtcaacgcgattgcgcatgcggccgtaagagcgcggtatacaatcctcctgaatttacctacactagtggtggaatcaggtttcattctcgactcctttgtatcttttctctattacggtggagcggcttccttaccacaccaccgttactgagaattatagaagggggcagttttcattcccagctcagcgcgcctgtgcggggcggaaaacaaaaacgacgagattttgttactctgagaaagtaatttgacgcacgatgtgcgcgaacgggagcacgaaggatggttcagatggcggtttcacctctgccacagtggtttgaaggctcggaatatacccataaagtcgcggcttgcatcatgaaatatggtccgatttcacgcattacgttggcgcagattttaggactttcgcagggtgctgtttcccgaattaccagcgatctgatttatgcgggcgtgattgaggagacgccgatgccatccggcaaggccggcaaactgccgaaaggtttcgtgcagaaagaaaatacggaacgtcgcggccgcccgcaaaccggattgcaggtgattgcgaatgcgcgatctttcgttggcatgaaaatcaacgcgacgcatatttcggcagttgcggtcaacgcaatcgggcagatcatcaccggatgccatgatctgaaaatcgaagacgcttccccgcagaccgtggtcgcgctgatcaaacaactgacgaccgactgttccgacgaggcggagatggcgggctggccgaaaccgtgcgctgtgggaatctcgcttggcgggcatattgtcgacggtaccgtggtgacgttcgcaccgttcatgcactggtcgcagcccgtggaactttccgtcatggttcgtgaggcgaccggattgcctaccggaatttacaacgatatcgattcgttggtggttgacgcctgcctgtttggaccgggcgttggattgaatagcttcgcggtgctgacgttcggcgcgggcgtcggctattcgttgacagtcaacggcgagctggtaagctgtccggataaaagttacggtttggtcgggcatattctggtcgatccggatgggccgcgttgtgtttccggacacaggggatgcgcgcaatgcctgtccgacaactcgatcgcggcggaatattcgcaaatcatcggacatcccgcatcattcgacgatttcgcacgtgacgcacgcgcgaacaaaccgcaagcgacgaatctggtgaaccgcacctgcttccgtctcggcaccctggtggcgaccatcgccaatcttgccatgccagacaaaatcatgatcgccggagaatcgtcgttcatcgcaaaattcggcattgacgacttgcgcaacggcatcaacatgtatcggcatagccaggccgcgccagtggattttgaaattcccgaccacgattgggctttgtgggccaaggcggccgcatcacaggcaattcggcaatatgttggctgattgattgcgattgattgcgattgattgtcttgcaatacaaaaaatcctcccctttgtttcagggaggatttttgttatgcgattacggcttattcagcgctctcgacgggcgcaagcacggccttgaaaaggactgcttgcgccgggtgcagtgccggcgggcggatgccgtacgtggcgagcgcgcgtccggtcatcctcacgcctccggccttccaccagccgagcgggctctgtccgttggcgatgtcttgcttggcgagatcgaggctcacgtcaagcggcgacacctcatacaccttgtcagggtcgagtccgggcaggcgtgccggcgcggccgggtaggtctgcgaggtggtgagctgggtgaaacggtagatggcggccgcttggttaggcatgaccacaccgtccaagcgcactgccggatcggctgcgtcggaatgcacgactgtgtcgacggcgaaccattcgcgatgcttcttgaattcggcgacccattcggcgagcttgtcgatatcttcctgcggttccttgagcaggttccattcgatgcccatgtgtccgaagaaggccatggccatacgcagttcctgcgtggtggcgcggtgcgtggagtgcgccggggatgcgcccacatgttcgccgatcatttccggcggcacgagcaacgaggtgtagcgctggatgtcggcgcgttccaccgggtcgacgcagtcggatccccaaatgcggtcggccacttcgaggatgccgaggtccacgcggccaccgccggaagagcagctttcgatttcaagtcctggatgcgcggccttcagatcagtgaaaatgcgatatacggcgagcgtctgctggtgcactgccgggcgtccggtgcgcggggagacggcttcggtgacgagtttgttgtgatcccacttgatgtagtcgatgccgagttcgccgacgagcttgtccattgcgccgtaaatgtagtcgtaggcgtccggattggtcaggtccacgacctgctgggtacgtccttgcatgggcagacggccttcggtgggcttcaacacccagtcggggtgtgcgcggaacaggtcggaatcagggttgaccatttccggttcgaaccacagaccgaattcgagtcccttgccgtgcacgtaatcggcaagcgccttgagcgacttgtcgccgtcgggccacacgtcctgcgaaatctgccaatctccgaggccggaggtgtcgtcgcggcgggagccgaaccagccatcgtccacgacgaagcgttccacaccactttccacggccttgtcggcgagtgcggtgagggtgtcataatcgtggttgaagtagacggcttcccatgtgttgagaatgaccgggcgcggcttgggcgcgatgttgtgttcagcaagccagtcgcggtgcactcggcgaatgtagctgtggaagcgggctgcgacttcgttgaggccttcgccgtaggagccgatgagccatggggtggtgtaggactctccattggcgaggctgatttcgccgccgaacagtacttcgccgccgccgatcacgccgctggtgtatggcaggcgttccgcggagagcacgctgttaccgctccatgccacgtgtgcggagtagacgttgccgtgcgtgaagccgaagcctttttcgccgacgctgagcagcagggtggcatcgaagtctgggcgtccggccatggatgctttggcgaagcggccgagggtgaagtcctggcgctgcggggagcgttcgcgcagatggtggccggtggtggtgaggatttcgttggcgtcggccggcacggtgaatgcgagttcgatcttgccgacttcgagctggccttcgccggtgttcacgacttcggcgttctggcggatgaggccggtttcgtcgagttcgcaggtccagatgagtttcacatgctgttcctcgtcttcggcggtgacggtgacggttggggtttgcttgggttcgtcggccacgctccagttcgggtatccgtctttttcgcccatgacgtaggttttgccagccgccacggtttcggcggtgatgttgctgactgcgaacttgcagaacagttccacgccgtcgcgacgcacatcaaagcgggttgcgccgatccaggattcggattgcgtgggcagcacgctcggccatgaggtgtagtcgagtgcgccagaaacacgctgtggcatttgcgcgtcgaacatgtcgatcacggttgccggggctgcgagcgggcgaccccaatgcacgagtcgcggcagatcattgccggggaatacgagcgcgaacgccacgtttgcggctggctgttcggcgtagaccgcagtgagttcggtaccgttggtagcgttgccatggaaggtctgaatgagcgtcattgcagcatcctttacatattgcgattgccttgtactgtcaccttcgatggtatgacaagcttcatttgttgacgtcgccgagcgtgtttctttcggtcggaaagtatttcttgcgaccatagaatcgcaagaaatattattacgtaaacattaccgttgaaatcgcaatcatctttaccaagatttacttggcatttcaatatttcttacgtttttgcgactacaaaatcgcaattatcgttttccagcgaaaaaatcagtcatcaatcgtgcgcattccgattcacgaacgccgccgataacttccggaacatgaccgacatgcgggtcgcgaggaatgtcccaaatcgaaccgcatgcacccaacttggcatcccacgcgccgaacacgattcgtccgacatgcgtttgcaggcacgcgccggcgcacatcgggcacggctccaaggtaacaatcaacgtgcaatcggcaagattccacgtaccaagcgaccgagcggcctgcgtcatggccttgacctcggcgtgcgccaacggatcggcgtgcgcctcgcgcagattacggccactgccgatcaccgctcccccagcgtcaagcacgacggcaccgaccggtacctcgccttccgcggcggcctcgcgggccaattcaatcgccagctccatgtcgtcactccactgcatacccgccactatacggttgctcgcgtgaagcaaaagacgaaacacgcccataaatacctcttggtaggctggaagggtttggaaaatgcgcgcaaaggaggcacgttggcggcattcgagttgattgtatgtattatcgccgccgtcgtactatcttcattcctcagccgtttcattcccaaggtttccacaccgctcgtgcagatcgcgttgggtgcgctggcgtcgcaattgccgtttttcccgaacgtcacgctcgatccggaactgttcatggtgctgttcatcgcgccgctactgtatttggaagcgcatgaaatcgacaaaagcgagctgctgaaatccgttacattgtcgctttcattggcaattggactagcgatcgcaaccatggtggccgttggtttcgcactgcatgccgtatggcccgcaattccccttgccgcggcactggcgctcggcgccgcacttggaccgaccgacgcggtcgccgtatcgtcgctcggcaaggaagccgcgcttacgcaacgtcaaaccagcgtacttaaaggcgaatcgctattcaacgacgcgtccggcatcgtcggcttccagttcgcgatcgcggcggccgtcagtggcgtgtttacagtgggcgattcggccgcacagttcgtgttctcattcttcggcggcgccattttcggcttggcagtaggcatggtcgccgacctgttatttgaatcgttgcgatctttcggctgggagacgaccacaagccgtattttgatggaattgttcctgccgttcattctgtatttgggtgcggaagcggtgcatgtttccggcattctttcggtggtgacggccggtttgatcatccgtttcgatcgcaccggcatcggcccgaatgtggctcgcaccaacattgtttcgtcaagcgtatggggggtattctcgttcacgctcaacggcacggtgttcattctgcttggcatgttgctgccgaatgcgatgagcgcaagctgggacgatccgcaagtcagcaattggctgctactggttgcgattcttacggtttccgcagtggtaatcatcatgcgattcctgtggatttcattgatgctacgtctcgcgcgagataccgtcaccggcaagcgacgcaagatgacggcgcaacgttggcgttcggccgcggtcatgacgttcggcgggccgaaaggcaccatcaccctgtcattgatgttcacgatcccgtacaccattacgggaggcgcgtggttccccatgcgtgacgaactgatcttcatcgcaggtggcgtgatcgtcgtaaccttgctgctcgccaacttcctgctgccgctgctggcgccgaatcgcaataaagacacttccgtggaaatgaccgaaatcaccatcgaagtgctgcgacggaccgtggaggaactgacgggacgagtcacacccgacaatcgtcgtgcggtgctgatgatcatcgactcgtatacgaaacgtatcacacgactgaagcagcgcatcggagaaatcgatccgcaagggtatatgcaactgcagatcgacgcgctcaactgggagaaggaatacgtcaaggcgcgactggcgaaagtcaaggcgacgacgaacgacgacaaggcagcgcacgatctggaaatcgaagcatgcgagcgcctgctcgaccagatcatgagctctctgcgccatatcgaaacggaacataattccggacgcaccatctggcgagtcaaaggccgcttcagggcgttgcagaggcgtttgggcacggtggtgaagcgtgtgaacagccgcattcgccgcactaccccgctgttcagcgacgacgagctgttcgcgcacacccgcgcggtgcaggtggatgccatcgaacatgtgatcgaccgcctgtatgaggagatgggccgcgacacgtacaatacggaacattgctcggcactgctgctggattaccgacgaggcgaggctacgctgaggtcgcgcccgaatgtgggcacgagcgcggaggcgcaggcgcaggcggaagaggtgaagcgcgaaagctacggtatcgagctgggtgtgatccaagacatgtacgaggcgggtgacattacgcgcgcgcaatccaagcagctgcgacgcaacgtgtatgtgatgagcgtggacgccgacgcgcagatctagcatccaactgatctgatgggatcagcaagctggcgtgagccggtgatccgcagcgagtttgtctgcggacgaactgtggaaacgtgggggacgagacaactgtaggaacggaacacggcgtggaaggcggcaaactggaggccattccacaatctaaaacatgagggaattgaaattctcagatatttcccagaaaacaccagacatgtactcagcatcgtctgtttatataggagatgtcagcaaaagagccgaccaggaacccacagcagttcccgacaattgaaccctttcttcttctctctcctttctctccccggtggttttctctccaccggggtttctttttgccctcaacgggtggattcctccagccagtgggagaatccgcccgctggcagctcactcaaagtccagaaaccgccactcactggaacaatcaccccgctggcaagccgcccaacgtcccaatccttccagtgactgggaggattgccccgctggaacgggtatattggaggcatgagtgaaatacgcgagcacgagaccagtgattcccacgactccagcaacccaaacaccccgaccagtctgatcgggcgcgaatcgcaggtggttccagggaggttcggcgagccgctgcaggtcacgcacgtacagtattcgcgcgggggcggcaatgcggctccacgacgcccgctgttcctctgcctgcacggttggggctccaatgaggccgatttggccgacatgatgcgttacgtggctccttataacgatttcgcgtcgttgcgcgcgccgctcgtgctgcaggaggctggttccggtgaattcggtttcggtcagggcgcgtattcgtggttccatgattgcgtgccgtccggcgaagatctggatcgagacgcttatgctgccgctcaagccattgacgattgggttgcgcgcaatgttcccgaagatcgcgctgtagtgccgatcggtttttcgcagggcggtttgctggcgattcatctgctgcgcgtccatccggaacggtacgccgcgtcaatctcgctttccggcttccttgcgccgggaatcgtcgccggtagcgcgccggccgacagtcatgtcgcggaattgaatattcctgtgttctacggctatggcaagaacgataccgtgattccgatgccggagcttttcgcaaccgccgcttggctggacgagcatacgttcctcacgtcgaaaagctaccgtggactcgatcatgcggtcagtctcaacgaattcagcgatttgcgcgactggcttgccgcgcacgatatcgcgccgggaatcctgtaagaaatcctgcggaagaatcccgtagaaaaatcctgcagaaaaatccgatgcaacggattttgcgtaccaagcacacggcaatcgttacaacccgatataagccacgatatagcgataccgcgttagactagagccagctaataatcatttcgcaattgccggcattcgcacgctcaaccatgcgaacgttcgaatgttggcgagcgccataccggcacattcgcgtgcctggcaataaggagtttcgatgctgctgtccgatcgcgacattctcgccgcgcaggccgaaggtcatatttcactcgatccatggaccccggaaatggtgcagcccgcttccattgacgtgcgtttggaccgtttcttccgtctgttcaacaatcatgcgtacacgtatgtcgatccggctgagaatcagggcgagctgaccgagcagttcgaggtggctccgggcgaaccgtggattctgcatccgggtgagttcgcattgggttccacgtgggagtacgtgaagcttgatccgacgattgccgcccgcctggaaggcaagagctcactgggccgcttgggcattctcacacattccaccgcaggcttcatcgaccctggtttcgagggtcatatcacgttggaattgtcgaatgtgtcgacattgccggtgaagttgtggccgggcatgaagatcggccagatgtgctttttccagctcagctcccccgccgaacatccgtacggttcgcaaggcaccggctcgcattatcagggtcagcgcggtccgacgccgagccgttcctacgtgaacttctacaaagccgacatcaccgactaatcatcaaatattcttggattatcgcaatatattgtcgatatatggcgattgatattccaccaaaaatacaaaaagattggctatcacatatcgcatgatagccaatcttttttgcaatcttctattgagatttcttgttgcaatgtcagcaatatcgaatgatattaaaagatactgcaacagcgattggtaacgccttttagcgcttgtggatcgcgatgtgtgagatgccaggttccgcagaattcgcaccgatacacccatagttcagtgccgcgttcacgccagctctggtcggcggcctgccgggccgtcgctttgtcgcgatacatgattttgttcgattcgacgcagcgtttgggtacgaaataatgcatagttccccagtctattccaccatcggataagggcaggaagctcccctggaattcctgggatcccccagcgtcccgggactcccagtgactggaggaatcatcccgccggcagtccttccggcgtccaaaaacctccaccgaatggaggaagacacccgtgcgcgggaataaaaaaggaccttccgggaaccccgatggggctcgaccggaaggtccataagttgaatgcggcggcgtgctactctcccacaccctctcgagtgcagtaccatcgccgcgaccaggccttagcttccgggttcggaaagggaccgggcgtctcacctgggccatgaccaccgcaaaaccaatataacggccaaccacaaggatcggccggcagaaccggaaccacgccacgattccgatcgtggcggtccgggaaccggacaacggacgcgagcaaccaaacgcttcaccggtatcgtttccgtgaccacaagaaacaatgctccttgccatccaacgaaagaaaccaccacaggacgagacccgacccaacaagcgggtcggaaaaagtgtgccgcgttcgcccgttagtaccggtcggctccacccctcgcggggcttccacctccggcctatcgaacacgtgttcaacatgcgggcttcggacgctccggggagcgtcaaggaatcctaatcttggagcaggcttcccgcttagatgctttcagcggttatccctcccgaacgtagccaaccggccatgccgctggcgcgacaaccggcataccagaggtccgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgcccgaaccgtcgttctcgcagtcaagcccgcttgtgcgattacactcgaaacccgattgccaaccgggctgagcggacctttgagcgcctccgttactctttgggaggcaaccgccccagttaaactacccgccaggcactgtccctgaacaggatgactgttcgaggttagacgtcaaacgagaacagagcggtatttcaccttgcggctccacacgggctggcgcccatgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcaccccaaaaggggctgacggatcctcttaaccttccggcaccgggcaggcgtcagtgcatatacagcggcttgcgccttcgcatgcacctgtgtttttggtaaacagtcgctaccccctggtctgtgccaccccccaacgctccgagggcaagcctcttcacgcccgggggtctcccttataccgaaggcacgggagtgatttgccgagttccttgaccaggattcgctcgatcgccttggtattctctacctgaccaccagtgtcggtttggggtacgggcggcgacgcccctcgcgccgaggcttttctcgacggcctggaccaccggatatcgcgtccaaaggacgcccatcatcacacctcaccctatgcgtcccacggatttgcctatgggacgggctgcgtgcttgaccacggaaaaccacctccgcggccggctcccattccgtgtcacccctgtgcgctagcctaccaggactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccacaaggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctcccgcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaacccaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccaccaggggcatccggaaaaccgcacgcacccaaaacggatgcgggtggcggtccgggaacccaaaagcatatccgcaccactccccgccggccccaaggacccgcgaagccaacgatctcttccacaccagcacgcccacacgaacccgggaaccatccccggcgcatgggccacacgacggacgccagaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaactttgcagaaagccaacatgtgactctcaaaaacaagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccgctcacccgcctcgaggcaccccaaccggggaaccactcgccgagcggcagcaagagataaacctacagcacaatcccattccacgcaaatcgggcatgacgaaacaagacgcggacccttgcaaacactggaaagcgtcggcgtgtcgaaatccgtctttcttacaccataaatcgcaaaaccaactccagcacaacccaaaaatcgtcagaaaaagctgattgccgcgtgtcacacaacgcaacaacacggcaatcagcagatcaacagcgcatcacagcaagtcacagacgatcggaaagccaatcgaacaccaaacgcaatgcgcgagcgctacggaatccgtaacaggcatggcaggcgttatcgagcttgtagaacgtcacatccttgccaagcgctttcaacgtggcatacaggcgacaactctgattgaacggcaccaactgatcgcggccaccatgcatgatcagcgttgacggagtgggcatatcggcactcagataagtcataggcgaagccggggcgctcaaatccggatgttcaagcacgtcaccgccatcaatcaccacaccttccgggcactgcggatcactgtggttctgcgaactcggataaaagttcatcttcgcgaaatcagtagggccatgccaatccacgatcgcgttcacttcgacgctttcctcggcataggcatccgtatcaggcgcgcgattgccagtgaacccagccatcaacaccgtatgaccgcccgaagaatcgccccacagcgcaatacgatccttgttgcaatggaagcgttcggcattcttgcgcatgaaacgcaccgcagtcttgcaatcctgcatctgcgcggggaacggcgcaatatcgctgtgacgatacttcagcgcagccaccacatacccctgctcggcaatacgcacgaaataattcgagcaatcggtcacattctgctcgtggaatgccgaaccgcgcacaaacacaatcactggccaaccaccttccggcattgcgccctcgggcatattgtcaacgccaggcgtgaacacccacatcggcaaatcaacactgctgtcatcagccagctgacgggtcacgtatgtaacctgctcgatattcacgggatatccgaaatcatcctggtccaagtcggaaatcacttggcagccttccggaaactcatcagtgtgcgggaagaacttagtctgctcgcggcgtcggaatcggggcaagctgtgtcggcgacggcggcgccaccatcgattcgatatcgattgccccgatcgccgtaaccgtctcggtcgtttcggcagtctcggccgcatcagcgccatcatctgcaatgttttgtgcaatatcagtagtcataatgcacctctcattcctttccatgcatgattattaagattgcttttctcgaatttgattgcccgatgttccctgtttcacgtgaaacatcagaagttacgtcgtgcggctatacctaagatatgagcaaaaagatcgcagtattgacgggggcggggatttccacgtccgcaggtattcccgacttccgtggaccggatggcgtctggactaagcaccctgaacaaacgcaagtgtatgacatcgaagcattcctttgccacgaggaagatcgcaagtattcctggcgttggcagaaggaatcacccgtgtggaccgcacagccgggcaccgcacataaagcgctcgtcaaactggaacaggctggcatgctgacgctgctcgccacacaaaacttcgacgcattgcatgaaaaagccggcaatagcagcgacgtcatcgtcaatctgcatggcaccatcggtacctcgcactgcatgaagtgccatgcaaaatatgacaccgccgacatcatggcgaatctcgacaacgaacccgatccgcactgccatcgcagactgccctacagcggcaacatgccatgcaacggactcatcaaaaccgacgtggtctacttcggcgaggcgctgccggacggcgcgctcgaaaaatcgtatcgactcgcaacgcaggccgacgaactgtgggtcatcggatccacgctggaagtcatgcccgcggcaagcatcgtgcccatagccgcagaggcgggcgtgccgatcaccattatgaacatgggacgcacgcaatacgatcggttggccgaccggcttatccacgacgatatcgccgtcgccctgccgcagctcgtcgacgaaaccatcaccgccgagcagtaagccgcacagtaaatacgttttctcgtacgtcttgcagtaccggcacaaatcgttggaattacaccggttttggttggtcgttaccaaaatccgaatttttcaacgacaaaaatccgaatgacgtaacggctagtcaagcaatataaacaacaaaagggtcttggattgctttgcgacaatcagaaatcatcgcaaggctttccaagacccttattggttatcaaatactgaaaaacggtactgaaatcagtaaatgcgcttcggctggaaaccggcttcccgcaatgcctcgagcacacgatcaatgtggtcgggaccattcgtttcaaccgtcacgcccaaagccacggcattcgcgtaatggctggacgccttgaactggtcgtgatccagcgcgataacgttcgcacgctgctcggccagcaatgtggcgaccttcaccagctgtcccggggtatcgggcagctcgacctcgaaatgcatgatgcggccacgcgtgatcatacccttctgaatcacagcgccaatggacacagtgtcttcattaccgccagacatgatcggcaccaccacatgcggacccttcgcctcagcgaacttgcgcgagcgcaggttgaggtgctcgagcgcagccagagacacagcgccggcagcctcaaccaccagcttgtgcttttcgagcatgagcaggatcatctcgttgatgtcacgctcggtcacggtgacgatgtcgtcaaggaattcgttgagcagcgcgaacgtgagatcgcccggacgcttcacggcgacgccctcggcggacgtgcgcacctggtcggcggcaaccacatgacctgcggccagcgaattcttccatgctgggctaccctccggaatcgcgccgatcacgcgcacttccggcttgaacgtcttgatggcgagcgccacaccggcaccaagaccgccaccgcccagcggtacgaccacgtcggtgacgttcggcacgtcttcgaggatttcaaggccgatggtgccctgaccgcacagcacctcgtaatcgtcgaatggcggcacgtagatcatgccttcggtgtcgctcaattcctgggcgcgggctgcggattcgtcgaacacctcgccgtacagcaccacgtctgcaccgtacgccttggtggcgtcaaccttcagcggcggagtgatctgcggcatgcagatcgttgccttcgcaccacgttcgcgagccgcataggccacgccctgcgcatggttgcccgcggaagcggtgacaatgccgcgagccagctgctcatcactcagggatgcgatcttgttgtaggcgccgcgaatcttgaacgatccggtgacctggagattctcaggcttgagcagaatctcatgtccggtcatgtcggacagcaccttggacggaatgatttccgtgtggcgcgcagtgcccttgagtcgttcggcggctagtttcagttcagctgcgtgatcgcgctgcaatgctttgagaacctcgttttgttccatgagcgttattgtaagcgtacgtctgccgaaactgccttatcatgcggctttcgcgatgaaaagtgagattgcttgcgaaaagtaatcacaagcaatcaggaataatcgcaatacataatctgataaatcacaatacaaataaagaaaaagcgttcgtacgatcccgtgatgaatcgcacgaacgctttttgcagagagtttataggaaagatcgatcagagctgaatcacgaccccctcccagcgagcgagctcgccgcgagcgaccgactttacgctatgcacagcatcataggtgctgagcagtacctgcgactcgcccacgccatcctcaagcagttgcgcgacctcagcaggcacctgcgccgtcctatcagtgagattgacgatgacgagaatcgtgtcgtcgccgctggtacgggtgaaggaatacacctgctcgctgtctgccgcgaccagattccattcgcccgtcgcgatggtcgcgttgttgtggcgcatggcgatgagcttcttgtagaagctgtacacggatccgggatcgtcgaattcctcggctgcgttgatctcgacatgattcggattgacgccgatccacggttccgtcgccgcgtccggcgcggtgaaacctgcatacctggaggcatcccactgcatcggcgtgcgcgaattgtcgcggccgatgagcgcgagcgccgccatcatcgattctgcggactggcattttgcttcttccacgcgctggcggtaggcgttgatggattccagatcgcggtactgctcgagcgtggtgaagtgtgcgttggtcatgcccagctcttcgccctcgtaaatgtaaggggtgccgcggtgcatgtgcagcagcatgccgaacgccttggcgctcagctcgcgcgactcacggtccgtgtcattgccccaacgggagacgacgcgcggctgatcatggttgcagaagaacaggctggcccagccggcgttcttcacagcctcctgctggtcggcgaggcgggcgcgcagattcttgacttcgaacggcacggtgttccacttggaaccttcctggtcgatgcccacgtggtcgaacaggaacagcatgtcaagttcgccgttcttcggatcggtgacatgctcgttgcgtgccggagtgatgcccggcgcttcgccgacgttcatgtagccttcgcggccttcgaacacttcgcggcgcatttcggcaaggaactcgtcgatgcgcggaccgtcggagcaccatgggaacgggctggaatagccttcctcaccaaccggataatcctcaatctcgcagccgtcttctcccggcagcttgccgttcttatcaacagtcttcgaaacctgcgtgatcacatccatacggaagccgtcaatgccgcgatccatccaccaattcatcatcttgtagacggccttgcgcacttccggattctcccaattcaaatccggctgcttcttggaatactggtggaagaaatactcgccgcgcttcggatcgtactcccaagcggaaccgccgaaataggaaccccactggttcggctcggcacccggagtgcccggctcatgccccggcctggctggacgccaccaataccagtcggcatgcggatcgtccttgtcgcgggaagcctggaaccaagcatgctcgtcggacgtgtggttgaccaccaaatccatcacgatcttcagaccgcgcttgtgcgcttcggcaagcagctcgtccatatcctccaaggtgccgaacagcggatcgatatcctgataatcggaaatatcgtagccgttgtcgtcctgcggcgacttgtagaccgggctcaaccacaccacgtccacgccaagatcggccagatagtcaagacggctggtgatgcccttcagatcgccgatgccgtcgccgttcgtgtcttggaaggaacgaggatacacctgatacaccaccgcgttggcccaccacgggttcggggtcgcgccgttggaacgcacggtgtcgggaagggtggaacgattgaaattcgtcatgtcgtggagctcctttgcttgacgtttgttggattttcgttcgatctttcgtgactgactctgcccgttttcagctcatgtcagcttcatgcagaagatcgattttgcctactcccctatggtatgcaaccctgtttttctttctttcccgcggcgagttgtgcaaagcaagaaaagaatacgcttcttacggacgcgaaaaaccaatccgcaaaaataaaaacgcgggacgttccagaaagggaaatggaacgtcccgcgctggggagtgggataggccagtcccgctcggtgctgtgaagtgttacttcctgaacggacggcctacggccgcgttgtccctgccttcactcgcctatcggctcgctcagggagagcctatgaacagaccactgggctgctcacttaacggctcccctcatcactccaccgacgacccacttctgggcgaagatgtagacgatgaggaccggagccatggccatcaggtaggacgcgaaggccatcggatagttcgacgtgaactggctttggaacacgtactgtgcgagcggaatcgtctgattgctctgatcggtcagcgtgatcaacggcagcaggaagtcgttccaagcccacagtgcggtcaaaatcgcaatcgtggcattaatcggacccatcagcgggaaaatgatcgtccagaaaatacgccaggtggaagcaccgtcgatacgagccgcctcttccaacgaaatcggaatcgaacgaatgaaaccaatcgcaataaacagattcgtaccaataccgagaatcgtgtacaaaataatcaaaccaagctgattatcaagatgcagcgaacccatttccttcgcaatcggaagcatgatcaccgtgaacggcacgaacatcatcgcaaggaagaagtagtacaggaaacggaagaatcgcttatccatattccttgccacagcatacgcgacgaacgtgttcgtcagcagcgtcaacaccaccgcgcacacggtgatgattgcggaattaagcgcggccttcggatagttcaccttattccacgcatcggcgaaattatgccattcccatgtggtcggcaagctgaacgtaccagcctcgctcggagtcttcaacgcggtgaccacagcgaaatacaacggcacgagcacggtaaggctcaacacggccacagccgcggtcagccaccagttgaccttatgatccctgcggattttctccggctttgcctgcgattgagtagtcttggctgcagtctttgcaacagttgcgctagtcatgatatttcctctttaccttcagactttcagacccttgctcagaccttctccttgccgctgaagaacttcagctgcacgaaggccaggattgccagcacgatgaagaacgtgaccgcgttcgccatctggtaggagtattcgccattgccaaggccgttctggaagatcagatacgagacggtttcggtcttggaatccgggccgcccttggtcaatgccatgatctggtcgaacgcgccgagcgaattcttgaggctcaacaccatgttgatggtgaagaacgggccgatcagcgggaaggtgatctgccagaagttctgccaagcgctcacgccatcgatcgcagccgcctcataaatctcgttgtcgatggtctgtaggccagccaaatacagcagcgtggagtaggccacgccctgccagattgacaggaacacaatcgggaaccatgccaaatccggattggaaatcattgacgtcgacagccaatcaatatgcagcgcctgaccgagcgccggcagcggcgtcatgaaaatgtacttgaacacatagccgatcaccaacaccgacaaggtgtacggaatgaagaagatcgcacggaatccgtttttgaacgcgattttcgaattcagcagcaccgcaaggaacatgccaagaaaattcgtgccgatcgtaatcaaaattgcgatgagaatagtgaacaggtacgcgtgaccgacgcgagaatcctggaacatcgcaatataattcttcaatccgatgaatttgaaatcaccataaccctgcgaattggtgaacgagtatgccgcgccctgcaggaacggccaatacaggaagatggacaccagaatcacagccggaacggtcatccaataaaatgccggatcgaccttgcgcttggaatatttcgaaaccttattcttggaattttctgccgagttcttcgcagtatttgcagtatgtgcggtagtcatgtccgttcctcctctcacctgaagtttctggcttcgatcttgtcatattcggattgcacgctgttcaggaatttttcggtgttgcccgactgaaccagcgtctgcaggaagcctgcgaggttgatgctggctggcacgtaatggtcgcagaagtcggccagtttgcccgcccggtagaagtcgagcacaccgttcagcgcttcatcgcccacatacgtgtctttgtagggggtaaatgcggactgccgcttggagtagtccttgatgttttcgtcgttcatcaggaagtcgatgaattcgcgcgcttccttctcatgcttggtgtgcgcacccatggtcagaatcacgtcatcgcctgccgtgagctgctgttcgctggcatcgtcggttgccggcatttgcgcgaaccgcaggttggcatcgctgttgatgagtcggatctgcggaatcgcgtaggtgccgagtggcagaatcgcggctttgcctgcggccagatcctgcgtggcctgctggtaagtgacggccggattcttctgcgtgtagttctggtagatctcgaccagctgatcgctgacagtgccccacaggtcggagaatttcttcgatccgtctttgagggaaagatattcggattccggcaccagcgtggagttgagtgacgccagcggcgcctggagtgtccacggatcggcggtgctcgcttcgatcggtacaatgcccttgctcttgaagcgttgcagcaggtcgatgaattcgctccacgtctgcggtggattgtcgggatcctcgcccgcttcctcccacacgtcggcgttgatgatgtagccggacgcgttgcccgcatacggcaggccgtacaggcgcttcttggattcgtcgttggtttgtacaaggctcttggcgatgttcaccatgcctggattgagttcgtcgacgatgtcatcgtcggtgaaatcgtggaaaacacccgcttcggcgagcatgccgaaattaatgtcgccattgatggtgatgacgtcgggttcacgatttttcaccagtcgcgtacgcagatcggtggttgcgtcggacgaattgttgacgttgactttgatgttgggatgggttttctcaaattcctttgcttttgcggtgaaccagtccgccgcttcggctttgaattggaagaaatccaaagtgacggttccagcggtgctgttgccgcaacctgcaaggccggccgtcaacgcgattgcgcatgcggccgtaagagcgcggtatacaatcctcctgaatttacctacactagtggtggaatcaggtttcattctcgactcctttgtatcttttctctattacggtggagcggcttccttaccacaccaccgttactgagaattatagaagggggcagttttcattcccagctcagcgcgcctgtgcggggcggaaaacaaaaacgacgagattttgttactctgagaaagtaatttgacgcacgatgtgcgcgaacgggagcacgaaggatggttcagatggcggtttcacctctgccacagtggtttgaaggctcggaatatacccataaagtcgcggcttgcatcatgaaatatggtccgatttcacgcattacgttggcgcagattttaggactttcgcagggtgctgtttcccgaattaccagcgatctgatttatgcgggcgtgattgaggagacgccgatgccatccggcaaggccggcaaactgccgaaaggtttcgtgcagaaagaaaatacggaacgtcgcggccgcccgcaaaccggattgcaggtgattgcgaatgcgcgatctttcgttggcatgaaaatcaacgcgacgcatatttcggcagttgcggtcaacgcaatcgggcagatcatcaccggatgccatgatctgaaaatcgaagacgcttccccgcagaccgtggtcgcgctgatcaaacaactgacgaccgactgttccgacgaggcggagatggcgggctggccgaaaccgtgcgctgtgggaatctcgcttggcgggcatattgtcgacggtaccgtggtgacgttcgcaccgttcatgcactggtcgcagcccgtggaactttccgtcatggttcgtgaggcgaccggattgcctaccggaatttacaacgatatcgattcgttggtggttgacgcctgcctgtttggaccgggcgttggattgaatagcttcgcggtgctgacgttcggcgcgggcgtcggctattcgttgacagtcaacggcgagctggtaagctgtccggataaaagttacggtttggtcgggcatattctggtcgatccggatgggccgcgttgtgtttccggacacaggggatgcgcgcaatgcctgtccgacaactcgatcgcggcggaatattcgcaaatcatcggacatcccgcatcattcgacgatttcgcacgtgacgcacgcgcgaacaaaccgcaagcgacgaatctggtgaaccgcacctgcttccgtctcggcaccctggtggcgaccatcgccaatcttgccatgccagacaaaatcatgatcgccggagaatcgtcgttcatcgcaaaattcggcattgacgacttgcgcaacggcatcaacatgtatcggcatagccaggccgcgccagtggattttgaaattcccgaccacgattgggctttgtgggccaaggcggccgcatcacaggcaattcggcaatatgttggctgattgattgcgattgattgcgattgattgtcttgcaatacaaaaaatcctcccctttgtttcagggaggatttttgttatgcgattacggcttattcagcgctctcgacgggcgcaagcacggccttgaaaaggactgcttgcgccgggtgcagtgccggcgggcggatgccgtacgtggcgagcgcgcgtccggtcatcctcacgcctccggccttccaccagccgagcgggctctgtccgttggcgatgtcttgcttggcgagatcgaggctcacgtcaagcggcgacacctcatacaccttgtcagggtcgagtccgggcaggcgtgccggcgcggccgggtaggtctgcgaggtggtgagctgggtgaaacggtagatggcggccgcttggttaggcatgaccacaccgtccaagcgcactgccggatcggctgcgtcggaatgcacgactgtgtcgacggcgaaccattcgcgatgcttcttgaattcggcgacccattcggcgagcttgtcgatatcttcctgcggttccttgagcaggttccattcgatgcccatgtgtccgaagaaggccatggccatacgcagttcctgcgtggtggcgcggtgcgtggagtgcgccggggatgcgcccacatgttcgccgatcatttccggcggcacgagcaacgaggtgtagcgctggatgtcggcgcgttccaccgggtcgacgcagtcggatccccaaatgcggtcggccacttcgaggatgccgaggtccacgcggccaccgccggaagagcagctttcgatttcaagtcctggatgcgcggccttcagatcagtgaaaatgcgatatacggcgagcgtctgctggtgcactgccgggcgtccggtgcgcggggagacggcttcggtgacgagtttgttgtgatcccacttgatgtagtcgatgccgagttcgccgacgagcttgtccattgcgccgtaaatgtagtcgtaggcgtccggattggtcaggtccacgacctgctgggtacgtccttgcatgggcagacggccttcggtgggcttcaacacccagtcggggtgtgcgcggaacaggtcggaatcagggttgaccatttccggttcgaaccacagaccgaattcgagtcccttgccgtgcacgtaatcggcaagcgccttgagcgacttgtcgccgtcgggccacacgtcctgcgaaatctgccaatctccgaggccggaggtgtcgtcgcggcgggagccgaaccagccatcgtccacgacgaagcgttccacaccactttccacggccttgtcggcgagtgcggtgagggtgtcataatcgtggttgaagtagacggcttcccatgtgttgagaatgaccgggcgcggcttgggcgcgatgttgtgttcagcaagccagtcgcggtgcactcggcgaatgtagctgtggaagcgggctgcgacttcgttgaggccttcgccgtaggagccgatgagccatggggtggtgtaggactctccattggcgaggctgatttcgccgccgaacagtacttcgccgccgccgatcacgccgctggtgtatggcaggcgttccgcggagagcacgctgttaccgctccatgccacgtgtgcggagtagacgttgccgtgcgtgaagccgaagcctttttcgccgacgctgagcagcagggtggcatcgaagtctgggcgtccggccatggatgctttggcgaagcggccgagggtgaagtcctggcgctgcggggagcgttcgcgcagatggtggccggtggtggtgaggatttcgttggcgtcggccggcacggtgaatgcgagttcgatcttgccgacttcgagctggccttcgccggtgttcacgacttcggcgttctggcggatgaggccggtttcgtcgagttcgcaggtccagatgagtttcacatgctgttcctcgtcttcggcggtgacggtgacggttggggtttgcttgggttcgtcggccacgctccagttcgggtatccgtctttttcgcccatgacgtaggttttgccagccgccacggtttcggcggtgatgttgctgactgcgaacttgcagaacagttccacgccgtcgcgacgcacatcaaagcgggttgcgccgatccaggattcggattgcgtgggcagcacgctcggccatgaggtgtagtcgagtgcgccagaaacacgctgtggcatttgcgcgtcgaacatgtcgatcacggttgccggggctgcgagcgggcgaccccaatgcacgagtcgcggcagatcattgccggggaatacgagcgcgaacgccacgtttgcggctggctgttcggcgtagaccgcagtgagttcggtaccgttggtagcgttgccatggaaggtctgaatgagcgtcattgcagcatcctttacatattgcgattgccttgtactgtcaccttcgatggtatgacaagcttcatttgttgacgtcgccgagcgtgtttctttcggtcggaaagtatttcttgcgaccatagaatcgcaagaaatattattacgtaaacattaccgttgaaatcgcaatcatctttaccaagatttacttggcatttcaatatttcttacgtttttgcgactacaaaatcgcaattatcgttttccagcgaaaaaatcagtcatcaatcgtgcgcattccgattcacgaacgccgccgataacttccggaacatgaccgacatgcgggtcgcgaggaatgtcccaaatcgaaccgcatgcacccaacttggcatcccacgcgccgaacacgattcgtccgacatgcgtttgcaggcacgcgccggcgcacatcgggcacggctccaaggtaacaatcaacgtgcaatcggcaagattccacgtaccaagcgaccgagcggcctgcgtcatggccttgacctcggcgtgcgccaacggatcggcgtgcgcctcgcgcagattacggccactgccgatcaccgctcccccagcgtcaagcacgacggcaccgaccggtacctcgccttccgcggcggcctcgcgggccaattcaatcgccagctccatgtcgtcactccactgcatacccgccactatacggttgctcgcgtgaagcaaaagacgaaacacgcccataaatacctcttggtaggctggaagggtttggaaaatgcgcgcaaaggaggcacgttggcggcattcgagttgattgtatgtattatcgccgccgtcgtactatcttcattcctcagccgtttcattcccaaggtttccacaccgctcgtgcagatcgcgttgggtgcgctggcgtcgcaattgccgtttttcccgaacgtcacgctcgatccggaactgttcatggtgctgttcatcgcgccgctactgtatttggaagcgcatgaaatcgacaaaagcgagctgctgaaatccgttacattgtcgctttcattggcaattggactagcgatcgcaaccatggtggccgttggtttcgcactgcatgccgtatggcccgcaattccccttgccgcggcactggcgctcggcgccgcacttggaccgaccgacgcggtcgccgtatcgtcgctcggcaaggaagccgcgcttacgcaacgtcaaaccagcgtacttaaaggcgaatcgctattcaacgacgcgtccggcatcgtcggcttccagttcgcgatcgcggcggccgtcagtggcgtgtttacagtgggcgattcggccgcacagttcgtgttctcattcttcggcggcgccattttcggcttggcagtaggcatggtcgccgacctgttatttgaatcgttgcgatctttcggctgggagacgaccacaagccgtattttgatggaattgttcctgccgttcattctgtatttgggtgcggaagcggtgcatgtttccggcattctttcggtggtgacggccggtttgatcatccgtttcgatcgcaccggcatcggcccgaatgtggctcgcaccaacattgtttcgtcaagcgtatggggggtattctcgttcacgctcaacggcacggtgttcattctgcttggcatgttgctgccgaatgcgatgagcgcaagctgggacgatccgcaagtcagcaattggctgctactggttgcgattcttacggtttccgcagtggtaatcatcatgcgattcctgtggatttcattgatgctacgtctcgcgcgagataccgtcaccggcaagcgacgcaagatgacggcgcaacgttggcgttcggccgcggtcatgacgttcggcgggccgaaaggcaccatcaccctgtcattgatgttcacgatcccgtacaccattacgggaggcgcgtggttccccatgcgtgacgaactgatcttcatcgcaggtggcgtgatcgtcgtaaccttgctgctcgccaacttcctgctgccgctgctggcgccgaatcgcaataaagacacttccgtggaaatgaccgaaatcaccatcgaagtgctgcgacggaccgtggaggaactgacgggacgagtcacacccgacaatcgtcgtgcggtgctgatgatcatcgactcgtatacgaaacgtatcacacgactgaagcagcgcatcggagaaatcgatccgcaagggtatatgcaactgcagatcgacgcgctcaactgggagaaggaatacgtcaaggcgcgactggcgaaagtcaaggcgacgacgaacgacgacaaggcagcgcacgatctggaaatcgaagcatgcgagcgcctgctcgaccagatcatgagctctctgcgccatatcgaaacggaacataattccggacgcaccatctggcgagtcaaaggccgcttcagggcgttgcagaggcgtttgggcacggtggtgaagcgtgtgaacagccgcattcgccgcactaccccgctgttcagcgacgacgagctgttcgcgcacacccgcgcggtgcaggtggatgccatcgaacatgtgatcgaccgcctgtatgaggagatgggccgcgacacgtacaatacggaacattgctcggcactgctgctggattaccgacgaggcgaggctacgctgaggtcgcgcccgaatgtgggcacgagcgcggaggcgcaggcgcaggcggaagaggtgaagcgcgaaagctacggtatcgagctgggtgtgatccaagacatgtacgaggcgggtgacattacgcgcgcgcaatccaagcagctgcgacgcaacgtgtatgtgatgagcgtggacgccgacgcgcagatctagcatccaactgatctgatgggatcagcaagctggcgtgagccggtgatccgcagcgagtttgtctgcggacgaactgtggaaacgtgggggacgagacaactgtaggaacggaacacggcgtggaaggcggcaaactggaggccattccacaatctaaaacatgagggaattgaaattctcagatatttcccagaaaacaccagacatgtactcagcatcgtctgtttatataggagatgtcagcaaaagagccgaccaggaacccacagcagttcccgacaattgaaccctttcttcttctctctcctttctctccccggtggttttctctccaccggggtttctttttgccctcaacgggtggattcctccagccagtgggagaatccgcccgctggcagctcactcaaagtccagaaaccgccactcactggaacaatcaccccgctggcaagccgcccaacgtcccaatccttccagtgactgggaggattgccccgctggaacgggtatattggaggcatgagtgaaatacgcgagcacgagaccagtgattcccacgactccagcaacccaaacaccccgaccagtctgatcgggcgcgaatcgcaggtggttccagggaggttcggcgagccgctgcaggtcacgcacgtacagtattcgcgcgggggcggcaatgcggctccacgacgcccgctgttcctctgcctgcacggttggggctccaatgaggccgatttggccgacatgatgcgttacgtggctccttataacgatttcgcgtcgttgcgcgcgccgctcgtgctgcaggaggctggttccggtgaattcggtttcggtcagggcgcgtattcgtggttccatgattgcgtgccgtccggcgaagatctggatcgagacgcttatgctgccgctcaagccattgacgattgggttgcgcgcaatgttcccgaagatcgcgctgtagtgccgatcggtttttcgcagggcggtttgctggcgattcatctgctgcgcgtccatccggaacggtacgccgcgtcaatctcgctttccggcttccttgcgccgggaatcgtcgccggtagcgcgccggccgacagtcatgtcgcggaattgaatattcctgtgttctacggctatggcaagaacgataccgtgattccgatgccggagcttttcgcaaccgccgcttggctggacgagcatacgttcctcacgtcgaaaagctaccgtggactcgatcatgcggtcagtctcaacgaattcagcgatttgcgcgactggcttgccgcgcacgatatcgcgccgggaatcctgtaagaaatcctgcggaagaatcccgtagaaaaatcctgcagaaaaatccgatgcaacggattttgcgtaccaagcacacggcaatcgttacaacccgatataagccacgatatagcgataccgcgttagactagagccagctaataatcatttcgcaattgccggcattcgcacgctcaaccatgcgaacgttcgaatgttggcgagcgccataccggcacattcgcgtgcctggcaataaggagtttcgatgctgctgtccgatcgcgacattctcgccgcgcaggccgaaggtcatatttcactcgatccatggaccccggaaatggtgcagcccgcttccattgacgtgcgtttggaccgtttcttccgtctgttcaacaatcatgcgtacacgtatgtcgatccggctgagaatcagggcgagctgaccgagcagttcgaggtggctccgggcgaaccgtggattctgcatccgggtgagttcgcattgggttccacgtgggagtacgtgaagcttgatccgacgattgccgcccgcctggaaggcaagagctcactgggccgcttgggcattctcacacattccaccgcaggcttcatcgaccctggtttcgagggtcatatcacgttggaattgtcgaatgtgtcgacattgccggtgaagttgtggccgggcatgaagatcggccagatgtgctttttccagctcagctcccccgccgaacatccgtacggttcgcaaggcaccggctcgcattatcagggtcagcgcggtccgacgccgagccgttcctacgtgaacttctacaaagccgacatcaccgactaatcatcaaatattcttggattatcgcaatatattgtcgatatatggcgattgatattccaccaaaaatacaaaaagattggctatcacatatcgcatgatagccaatcttttttgcaatcttctattgagatttcttgttgcaatgtcagcaatatcgaatgatattaaaagatactgcaacagcgattggtaacgccttttagcgcttgtggatcgcgatgtgtgagatgccaggttccgcagaattcgcaccgatacacccatagttcagtgccgcgttcacgccagctctggtcggcggcctgccgggccgtcgctttgtcgcgatacatgattttgttcgattcgacgcagcgtttgggtacgaaataatgcatagttccccagtctattccaccatcggataagggcaggaagctcccctggaattcctgggatcccccagcgtcccgggactcccagtgactggaggaatcatcccgccggcagtccttccggcgtccaaaaacctccaccgaatggaggaagacacccgtgcgcgggaataaaaaaggaccttccgggaaccccgatggggctcgaccggaaggtccataagttgaatgcggcggcgtgctactctcccacaccctctcgagtgcagtaccatcgccgcgaccaggccttagcttccgggttcggaaagggaccgggcgtctcacctgggccatgaccaccgcaaaaccaatataacggccaaccacaaggatcggccggcagaaccggaaccacgccacgattccgatcgtggcggtccgggaaccggacaacggacgcgagcaaccaaacgcttcaccggtatcgtttccgtgaccacaagaaacaatgctccttgccatccaacgaaagaaaccaccacaggacgagacccgacccaacaagcgggtcggaaaaagtgtgccgcgttcgcccgttagtaccggtcggctccacccctcgcggggcttccacctccggcctatcgaacacgtgttcaacatgcgggcttcggacgctccggggagcgtcaaggaatcctaatcttggagcaggcttcccgcttagatgctttcagcggttatccctcccgaacgtagccaaccggccatgccgctggcgcgacaaccggcataccagaggtccgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgcccgaaccgtcgttctcgcagtcaagcccgcttgtgcgattacactcgaaacccgattgccaaccgggctgagcggacctttgagcgcctccgttactctttgggaggcaaccgccccagttaaactacccgccaggcactgtccctgaacaggatgactgttcgaggttagacgtcaaacgagaacagagcggtatttcaccttgcggctccacacgggctggcgcccatgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcaccccaaaaggggctgacggatcctcttaaccttccggcaccgggcaggcgtcagtgcatatacagcggcttgcgccttcgcatgcacctgtgtttttggtaaacagtcgctaccccctggtctgtgccaccccccaacgctccgagggcaagcctcttcacgcccgggggtctcccttataccgaaggcacgggagtgatttgccgagttccttgaccaggattcgctcgatcgccttggtattctctacctgaccaccagtgtcggtttggggtacgggcggcgacgcccctcgcgccgaggcttttctcgacggcctggaccaccggatatcgcgtccaaaggacgcccatcatcacacctcaccctatgcgtcccacggatttgcctatgggacgggctgcgtgcttgaccacggaaaaccacctccgcggccggctcccattccgtgtcacccctgtgcgctagcctaccaggactacgctcccaacgaccgcggaccccgaaccccgaagggaacgacgccacgcgaccggaggttagtactcatccgttcggctcttacggtacgccgccggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccgcgcggtccacggcacggttccccggccgcttcgccccacgcgggacgctctcctacccaacggccgcaaaggccgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacgatctgggctgtctccctctcgacgacggagcttatcccccgccgactcactgccggaatacacatccacggtattcggagtttggctgctattggtacccgacacgggcccgcaagcatccagtagctctacccccgcgatgcaatcaaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccagggcgcgcgactcaaaacgccttttgagactcgccttcgctacggctcccccaccacgggttagcctcgccacgcaccactgactcgcagactcatttttcgataggcacgccgtcaccccacaaggaggctccgacggattgtaggcgcacggtttcaggaactctttcactcccctcccggggtgcttttcacctttccctcacggtactggtacgctatcggtcagacaggtatgcttagacttaccccacggtcggggccgattcacacgggattccacgaggcccgcgctacttgggacacatgatcggaagacggcaagcttccaggtacggggctggcaccctctgcggccaggccttcaagcctgttcccctggcaagccgttttatgactcccgcccggtccgtcggaaccgggacacacgctcccgcaacaccacgaacgcaacccccgacgggtatcacgcgcccatggtttggtctgatccgctttcgctcgccactactcacggagtatcccttcctgcaggtactgagatgtttcacttccctgcgtacccccggaacaacaaggttccgtgccggcccatgacggccggcgggttgccccattcggaaatcctcggatcgaagccatgttggaggctccccgaggcttatcgcatcctcaaacgtccttcatcggtactgtctgccaaggcatccaccatacgcccttcagggcggcacacgccccgaaaaaacccaatgatagcttcaaacgccagacgacaaatcatcacactgtaaaaaatgatcacaaaacgatcgatctcgaaaccagactccaaaaaagaagcctggcgaaatcgcgataaagcaaacgatgacatcacatcatcgcattgctcgcgtccactatccagttctcaaaccaccacgcgccccgaccggacccgacccgcggcccgcaaggccgacggcgtcccaccaggggcatccggaaaaccgcacgcacccaaaacggatgcgggtggcggtccgggaacccaaaagcatatccgcaccactccccgccggccccaaggacccgcgaagccaacgatctcttccacaccagcacgcccacacgaacccgggaaccatccccggcgcatgggccacacgacggacgccagaccggcgtcctgaaaaactccgtagaaaggaggtgatccagccgcaccttccggtacggctaccttgttacgacttagtcccaatcacgagtctcaccttagacggctccatccacaaagggttaggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttcagggatccgctccacgtcgccgtgtcgcatcccgttgtaccggccattgtagcatgcgtgaagccctggacgtaaggggcatgatgatctgacgtcatccccaccttcctccgagttgaccccggcggtcccccgtgagttcccaccatgacgtgctggcaacacagggcgagggttgcgctcgttgcgggacttaacccaacatctcacgacacgagctgacgacgaccatgcaccacctgtgaacccgccccgaagggaggccatatctctacggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactccagcccgcccgtacccggcgcagatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcacccgaaggcttgctcccgatcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgtaggctcggtgggccgttaccccgccgactacctgataggacgcgaccccatcccataccgatgaaatctttcccgacaccccatgcgaggagtcggagcatccggcattaccacccgtttccaggagctattccggtgtatggggcaggtcggtcacgcattactcacccgttcgccactctcaccaccaagcaaagcctgatggatcccgttcgacttgcatgtgttaagcacgccgccagcgttcatcctgagccagaatcgaaccctccacaaaaaaactttgcagaaagccaacatgtgactctcaaaaacaagaaaattgacgatcgccttataaggaaaggcgcatcgcacgaaaacctcaccgtccttcaaggcctcccggccactcgcgaacgagcggacgatgaactggcaatcattgactataaagaagtagtacaaatacgctcttgagttctcaaaccaccaccgctcacccgcctcgaggcaccccagccggggaaccactcgccgagcggcagcgaagagtcaatttacacgaaccccggcgatcacgcaaatcgacccttccaaagataccctagaaccgttgcaaataaacacatccctcggcgtgtcgaaaaaggcctccgaacagccgtacagccagtctagaccccgaagacaacgcctacatgaaccaaaaacaaactataaacggcgtgtcatacccatatacatctcattcccatgtgatgaatacccaaatgcaatcgcaaatcatgattccagcggaacagaaagaacagaaatacaaaagagacgcgaagaagcatgaaacctggctgcacttgcgacggcacgcacgctgaaatacaacaagagccgccgactcagggaagtcgacggctctcgctgtttcaattgttattcagttatgttttgacctgtgagaaggaagtgagatcaggcagtgacctcagccttggccttcttgcgatccatgtagcgcttgatagccagagcctcaagtgcgatcaccaggattgcggtcacgccccaagccacgtacatggcggtcttccagatcggggtggcgaccttcggctcaccgtctgcatactgccagctgttggcggcggtgtacagaatattgtgggcggcggtacgcatggccttcacggaggttgcggacttgtcggtgatgtggttggtgatggaggtggtagccagcatggaatcgttgccgttacggatttcctgatcaccgttctggtagccgtagccgccgaaataatcggtcaggacgaagcccttgaagccccactcgtcacggagcacggtgttcagcagaacgttgttgccaccggcataggtgttgccgatgtagttgaaggcgctcatcacggcctgtgcgccgccttccttcacgctcatctcgaacggcttgaggtagatctcacgcatggcctgctcgttggtccaggtgcagagcatctcagtacgcttggtttcctgatcgttcagtgcgaagtgcttcatgaaggagtacacgcccttctccttggcgccggcgatctcgttggatgccatgacgccggagagcagggaatcctcggagaagtactcgaaagtacggccggagaatgcgttgcggtggatgttcatagccggagcgtaccaaccagcaacatgcatgtcgtgagccatatcgccgatcatctcgccgaactgcttggccagatccttgttccaagtgcaagcgaatgcggtggaagccgggaagccgatggagccaacaccagtgaagttgttgttcaacgaggccgggccgtcagcgtcggtgagctggatcttgccgacggaggagacggccggagtgccgtagccgccgttggcaatgaggttgtccatatcgtcgaaggtcagctcgtcaagcagcttctcccaatcagcatcgtcgtaatccttgccgtacatgtcggccaggcggaggccattcttggcaccggtggtcggcatctcgtcggaatcgtcgttgaactgagacggatcgtagttggtgttgttgtagaaggtttcctttgccttatcagacatttcgaagttggtcggagcggcggtggcttccttgtagtttgcgaaatgtcctgcacggctcaggtaggtcacatcgcctgcagcatcatcgaactggttggtggccacggtctggtcgccattgtgggtgttcgaatcggagtcgtaggtgatggtgtcgtccacggtgatcttcttggagccgatcacagtgtgggagtcggagttgatggagatgttgtaatcgcccttttcgagcacgtatgccttggcattcttgtaatcataggaagccatgtcatcgtcttcgaattcgacggtcacgtcctcggaagcgcccggctcaagcttctcggtcttctcgaagccaaccaggttggcactggccttttcgatgccaccttcggtgtacggcgggttgtagtagacctcaacaacatccttgccagcggtgtcgccggtgttggtgacggtcacatcaacggtgaccttgccatccttgtacgtcacatcgttgagcttctgctcgaaggtggtgtagctcagaccgtaaccgaacgggaatgcaaccatggaatcgtaatcgatggcaccttcggccgctgcggtctcatagaacttgtagcccacatagatgccttcggagtagttcacaaagcccgggatggcggtgacttcgtcaccagtgaagcccgtgtacttggcggccttgtcttccatgttggtgtattcgaacttgccgaagttgttgtaagacaccgactgggtgagatccttcaggaaggtgtcggaagtcttgccggacgggttggtatcgccggcaagcacgtcaccgagtgcggagaagccggtctggcctgcaggcgggcaccacacgacggatttgatctgcggatagtcgttcaggaagtcgaactggaaggtgttggcgccgttgtagacgagcgtgaccttgttgaagttcttggtgaccaggtcgagcatatcgcgctcggtctggctcagctgcaggaagctttcgccgtccttgaagtcctcgtaatccttggagttgttctcataggtgatgccttcggccttcatgttcatcggaaggtcagcgccctcgccaccgacgcgggtgagcactacaacagcctcatcggagaagctcttggcatcggagatcagggaatcggaatactggtcggccggaacctcaggcagggtccaatcctgtgcccacatgccaacaactgggcgatctgcacggtaatcggtgtacagcttggtcaggtcggcgttggtctcgatgccggcttccttcatgccatcaagcagggaaacggtgtcatactggtcagacatggagccggagccggtgccgccgtataccgggttggtggagccccaaccaaacacgttgaccttcttgttagccagcggcaggttggaatcatcgttcttcagcatggtgatggcttccgactgcacttccttggccagctcgttggccttggaaacagtggtgtcagacagcatgtacttggtgatggtcgcgttgttgagcagcgtcgacagcggaccggacagcatcatggaaaccgcgacgacaatgccgaccaaagccacaagccaagactcggaatggatgatcttacgggtcgccacttccttcaccgtcttcttgttgacggcaaaagtaatgatcagcgcgagcacaaatagcacgccaatcgcaatcaggtacggcgtcaacgaaccgataacgttcatgacgtcagccatgttgatttgcagcatggtctgcctcctccttgattctcataaccaaacgacatgcaggctccgatttcctcatcgaaaccagaaatcatgcaacgctgccccgcgtcacgcaatttccagaagtgaagacacttcttcatgtcgatgtttcgatttcaccaaaatccgcgaaaaaagcaccctgatttttcccagcctgtcgtttcgcgtgcataatctgcataccacctgcgcatgtaaaactaccattcgtgcacatataatcccgttgcgcgcatgcatctggcacaatgtgcgctcatccgcagattgttgcaacatccttgccttgattgcggaaatcatcgatcttcattgcgcttccaactccataatcgcaattcctgcgatattttcggcacactacagcgagctgttccagcggcaacttacgtaaggcaagtaccatgggtgccatgagcgacttaagcgcattgaatctggaggcaggcaacctcgttggcggatacacgttgatttcccggcttggatcgggggcgatgggatcggtctggcgcgtgcgcgatgacggcggacaccagtatgcgatgaaaattttgcgcgattcccttgccgaggacgatgcgtccagcgaacgctcccgcgatcagctgaccgcacgcgagcgcctgcgtagggaggctatggcgctgcagaaagtgcgtcatccgggcgtgtgcggcattgtggatatggaattggatgatgctctggccttcattgtgaccgagctgatcgagggcaagaatctacgtgaagatgtgcgtaccaacggccggtatgtgggcgatgatttggaacggttgggacgcaagctgatcgaggcggtgaaggccgtgcatgcggccgggattgtgcatcgcgatatcaaaccgacgaatgtgatggtgtcgaataccggaccggtattggtggatttcggcattgccatgggcgagggcgaaagtcatgtgactcgtaccggattggtgatgggcacgcctggattcatcgcgccggaaatcatcgacggtgccgaatccgatgagatgagcgattggtggtcggtggcgagcgtgctggcatttgccgccactggcgagccggtgttcggcacgaaaccgatgatggcggtattggagcgtgctgccgcgggaaacgcgaatttggcgggattgccggctgggaccatggccgcgttccgttcggcgttggatccggatcgtacgaaacgttgcactccagacgagttgttgcaggcgattgcgttggatgcgttgaatccgcaagcttggatttcggggaatacttcggatgccgccgatagtgccgggtcggaggcgatgctcccttttgatggatcgcccgacaatccacgaatgctttggcgggcgttagaccatgtgacgggagaagacgccatcggcacgcgcaccttgccgcaattcgttgaggccacgcaggcaatcggcgcaaccgttattgctgacataaccgataccgttattgccgatgcgcccgatgtcggcacctcggtcatggatatcaacgcgcataccgcaaccattcctcttggcaccggcacgcgcgtgctgcctgtcaatagtggggataccagtgtgctgccgcaagatacaccgcaatccacgcgggtgatgccggtccaggacgcttggaatcccgctcaagaggccgcacagatcgacccggccatcaaacctgcattgcagcgcatcgccaaccagcggcctcctgccgtaataccgaacgcatcggttgaaatggcgcaaagtgcgcagccacaagacatgcaaacatctgccgtgccaaccgcaccggtcactccggccgcgccgctcaacccgaacgtgccgcagagtgtactgcagccgccgaatccggccgacgtgcaacgcggcgaactgctaggcagaggcgtgcccctctgcgtgctgatggcgattcctgtggccgcatgcggcctgttctcgccatggatcgccctgatcgcgggggcgctgctggcctggttgctcgccaccattggattcaatatggaggcgcagctggaacgcgaaggccgccgtgggggcagccgcaggacttccgactggttcgcccgcgccgccacgctgccttggcatgtgctcaaggggctgggttatgcggtgccacgcgcactgatcatggcggtcatcgccgcattaggattgacgattgccacagtcacgctgcaactgccgtttgccatggttgatacgtcgatattcggattcacgattccgctgccgacctggattgaagggccggtttcgcaaagcggcgtcgcccaggccggttgctgcgccatcggctggctggtatgcgccctcgctccgggagcattggtgctgcgattgggtgccggcgcattgcgcggccgcccgaaatccggcaccactgccgaatcgtacgatatgtagtgacgccatctcacgaaatacgcagcgaaaatcaaaaatcggcaaacgtttgcaatcatcagaaaaacatcagataatcgcacgtagtatggcaacgtgagcttttacgaaatacttcattcagcaatagcgtgcccacactactatggtgcacagcatcgtgatgtgaacatcgaaaggaatgtggatggcccagaacagtaaggatgcgcagaagcgcgccagccgcgccgagcgtagggccgctgaggccgcggagatgaaggctcgcgccgaacagatggagaaggagcgcaagcagcagaccctcatcggcgccatcgtgatggcggtgctggtgatcctggtggcgatcggcgcgttcaccgtgtatcacaacatgcacaagaacaccgaaacgcaggcttccacccagaccgtggaagaagcgtacgacaagctgcagcaagtcgaaaacacgccaaagctcgtcgataagaagggcggattgctgatttcgaaggatggctacggcaagtccgtcgaaggcgcaccgactgttgcgatctacatggatttcctgtgcccgggctgcggcaatctgcatcgtcagcttgatgaggatctgcagaagatggtcgacgcgggtcagatcaatcttgatttgcatttcatggcgtttatggacaagtggtccaccgacgattattcaagccgcgcagcgaatgccgcgatctatctggccgagcatgacagcgatccgagccatctgatcaccttcctcgaaaaaatgtacgccgaggatttccagcctgaggaaagctcgaattacaagtccgtcagcgacgatcagatcaaggaacagatgatcgcctcgggagtttccgaggatgtggcggacaaggcgttcggccgcgactaccaggattggcttgacgccatcgacacctatacgccgaagcgctccgaactgtggaacacgtccggaacctacaaagacagcatgaccaccccaacggtgaccatcaacggcaagttctgggatatgaaccagttgagcactgcgcaggagaccattgaggaaggcctgctggaggccatcggaatcaagtccgacgacatcggcaaggaaggcgtgatgccctccatcggctccgacaaggatccgatctccaacaccactggcgagtgatcagccctacgcaatcctcataatcgaaaaaatatacccccctactcgccagcgtgccagccaaagcgcagttccaagttgacggtatcgggcacgctggttatgctattcaatcgttgccgtttttatgcattatgctagaaagcggcacaagcctccttagctcagatggccagagcggccgccttgtaagcggcaggtcgtcggttcgatcccgacaggaggctcgaaacccgttttgacgggctttgacctcttaccatgggtaagtgatccagaagccttcccccaacttatggcttctggcgaccggacgaggcttcccccaacctgcctcgtccgggcagggggcaggacatccccttctctcctgcccccttttttctttactccttttcctcgaaaatgtggcggtatagataaagccagcggaaaccatgccattcgtcccgatctgaccgttacaatgacggcgatgtaggcagtcgctggaaagaggacgtatgacaagaaggtggaccccccggagattcgtgacgcttcggcgtgttcgagtgacggcatgcgtggtctcgttgacgctcgcctcgacgctcgcattcggcgtaggcgcgcgcaaaaccgtggctctgaccatcgatggcgaaaccaccaccgtaaccacatacgcgatgagcgtcgaccgtctgctgcaggaacgcggcgtgaaggtcaaaacgcatgatctcgtggaatccaccagccccaccagcatgctgagcaaccatgacgtggtgacggtacgaagcgcctaccagaccaccatcaccatcaacgggcaggaagtgcccttctggacagtggcgaccagcgccgaacagctgatcggattcttcgaacaaaacgaagcagacgcggcaaaagtcaccgtcaatatcgacaacgtgtacaacaaactcaccggcggactgatcatcaaccaaaacgggccggtcaccgtcatcgcagacgggcaaagctccgaatcgccgaatggcaaactgccggcggcctccattcttgactccaaaggcatcacgctgaacaaggaggatcgcgtcagcgtcgaaaaagacaacggcgaaacgatcctgcgcgtccgccgcgtgacgcacggcgaggaaacacgcacgaaagcggtgcctttcggcacgcaaaccatcgtcgatcccagcctgcagaccggcgaagtcgtagtcaggcaggaaggcgaggacggcgaaatccagcaaacgtacgacgtcacgtatgtggacggcgagaaggaaagcgagacgctgaccaacgaaacgaccacgaaaatcgccctcgatcagattatcgcagtaggaccggcagcatcttccgacgattcgggatcggatgacggatccggcaattccggagataccggcaattccgataattccggaaagaacgacaattcgaacaagaacaacaattccgataattccgacaagaaagacgatccgaacagtaattccggcaatacggataattcagacgacaacaagaaggacgattccggatcgaaaacggacccggatccgacgccaactccagacccgacccccacgccaactcctgacccgacccccacgccggatccgacgcccaccccgacaccgcaaccttccgatccttcggcaggatgccgcctctatcacccctcccccgcgcaggcacaggcctacgcggccggagccgcggcgcaatatggctggaccgggcaaaactggaccgatctggtgaaactgtggacgcgtgaatcgagctggctgtggtatgcggaaaacgcatcttccggagcctacggcatcccgcagtcgcttcctggcagcaaaatggcggcattcggcgcaaactggcgtgacgatgcggccgtgcagatcgactggggcctgagctacatcgcgcaacgctacggcagcccgtcgaaggcatgggagcattccgagcaggtcggatggtattaaacaacgccgatcgcaacaatacgcaaacgcaacagcgcacacttttcataccagttgaacggataatgaggtaatgacagaacacgcgaacgaaaccaacgcaaccgacgaaaccgcgcaaggccgcctgttgggggctgccgacattcggcgtatcgcggccgaggccggtatcagcccgacgaaaaaattcgggcagaatttcgtaatcgacccgggcacggttcgtcgtatcgtgcgcgaggcaggtgtgaccgccgacgatcatgtgctggaagtcggacctggactcggttcactgacattggcgattttggaaaccggcgccacgatgaccgccgtggagatcgacccgcccgttgcggaacgactgcccggcaccatcgccgaattcatgccggatgcggtggatcgtttccgcgtggtcaatcgcgatgcgttgaccgtgacgccggaaaatctgcctgatttccaaaatgatgattcgtttacactggtcgccaatctgccatacaacgtggccacgccgattctgctgaccttgctggaacgtttcgacaatctcggcacgttcctcgtgatggtgcagaaggaagtcgcggaccgactgagcgaaaagcccggttcaaagatctacggcactccaagcgtgaagctcgcttggtatggtaccgcggaacgtgtgggcattatcgggcgcaatgtgttctggccggcaccgaatgtggattccgcgctggtgctgttcaaacgatatgagggcgggcacacgccttcggccaacaatcccgacggttccgtagtggaccgcgaaaacgtgttccgtcttatcgacgccgcattcggccagaggcgcaaaaccctgcatgccgcgttgaagaagatcgtgccctccgaagcgttcgagcaggcgggcatcgatccgacgcgccgtggcgaaacgcttgccatcgacgaattcgtggcattggcacgagccgtgggcgaggtgtcgcaagcatgagcgacgccaacaccgcaatcaacacggtcagcgtggactgcccggcgaaaacgaatctgaccctgcacgtaggcaggccacgcagcgaatggggtggccgacacgagctcgacaccatctactgcgccgtcggcgtgtacgacaccgtcaccaccagtcgcaaaaagcccggatccggtttctccctgaatcttgaaggtgcctatcttggcgatctggcctcctccggcagcgacatgcgacgcaaccatgccgtactcgccctgttcgccatggccgaagcgagcggccatgaaccggatgtggcgttgaacattgaaaaacgcattcccgttggcgcgggcatggcaggaggttccgcggatgcggccgccacgattctggcattgaacacgctatggaatcttgattggtccattgaacggttgcaacaggttgccgccacattgggcgcggatatgccgttctgcctgaccggaggctatgcgcgaggcaccggcttcggcgagcagatcgaacaactcagcgaaaacagcgacgccgtgctggaactgacggatcagggctttgcaggccgtctgctggtcggcgcgtatcaggcggaactgcgcacgccggaagtgtatgccatgttcgaccaaatcggcgccggcgcaaccgacaacaatcatctgcaacaggcgtcgatctcactgcatccacgcagcggacaggcgatcgacgaagcgttgcaggcaggcgccaagcaggcgttcgtctccggatccggcccttccgtaatcgcattcgtgccaaccgacgatgcggcacgcgccgtgcagtcggcatggcaacaaagccgttgcgtcgaccgcatcatcgccaccaaggcaccggcccatccgattgtgcatatcatcgcgtaacagtaaggttgaagtcaaccgatttttggagaaggactcgtacatgactcaggctaacgacgagcgcgccgcgcgcaaacagtacattcgccgccgtcaaaaggtggtgttcaccatcaccggcaccattttgacgatcgcattggtgatttccctgctgttcttcttccatgttggaggattgggcaatgtcaagtcggccgcggtacagccgaattacggccagcaggccccttgcgcagcacaggaacaggacggcagcaaaggcaagtacgtggaaaaccgcaacatcaccgtgcgcgtgctcaacggcactgaattcgccggcttcgcgcaagccgtcagcagcgcgttgcagaaccgcgagttcaacacccaggcagccggcaactacaccagctccaaagtggaacgcacgatgatcatcttcggcaagaacgccatcaatcaggcgtacacggtgaacagcaacttcaccgacgcgacgatggtgatggacgatcgtgaggatatgctgatcgacgttgtggttggcgcgactttcgacaatctgcagaatcagaagaaggtgccgaccgccggcaaggagatcgacagcttcgagggatgcgttaccgtcgacaagatgaccgacgtacagaaggcccccgaacacgacgccgtgtgatttgcagattttttgatttgcagattttcggattgacctcacgatttcgatttttcactgaaaatcaaggtcgtgaggtcaattcttatattcgtgggttaaatcgcgggcgaaatcctctagagaatacccccgaaaccgcacttttcggaaccgactgacctcacgattctatttttttcccgaaaaatcgaatcgtgcggtcatagaatccaaatcgtgaggtcagcaagcagactactcggcctgctgttcctcataccaacggttcaactcggcaacagcgacatcacgctcgaccgggccgttatcgaggcgatattccagcatgtgcttgtacgccttgccaaccagcggtcccgggtcaatgccgagcagctgcatgatttcgtcaccgttcagatcagggcggatcgcgtcgaaatcctccttctccttcagatcgcgcacgcgctgttccatctcgtccatcgccgacgagaacaccatggccttgcgcttgttctgcgtggtcgcgtcggcacgcgtaaggcggttcaggcgctcatacagcggacccgcatccttgacgtaacgacggaccgcggaatccgtccacggctcctccacgtagccatggaagcgcaagtgcagattgaccagctcgctgacgtcctcgaccatatgatggtcgaaatgcaatgccttaaggcgcttgcgggtcattttcgcgccgaccgcatcatgatgatggaagctcaccttgccacccgattcgaaacgacgcgtcttcggcttgccgatatcgtgcatcagcgcggccaaacgcaacgtcagatccggtgccggcacagggccgtccgggccggtttcgagggcaaccgcacgatcaatgacgatcatggtgtgctcgaacacgtccttatgacgatgatgttcgtcgatttcgagctgcaatgccggaatttccgggaagacgatatcggcaagaccggaatcgaccagcgcttcgatacctgcgcgcgggcgatcggacagcagcattttgaccagttcgtcgcgtacgcgctcagcggaaacgatttcaatgcgatcgaccatgtcggtcagcgcttcagcggtttccggttcgatacggaagcccagttgcgccacgaaacgtacggcgcgcatcatgcgcagcggatcgtcgtcaaacgactggcgaggatcgaccggcgtgcgcaacacgcccttggccaaatcgttcgcgccgccgaacggatcgacgaattccaattccggcacacgcaacgccatggcattcaccgtgaaatcacggcgggaaagatcgccttccagcgtgtcgccataattgacttccggcttgcgcgagtcggggtcatacgtgtcggaacggtaggtcgttacctcaacctgcacttccgtgccatcctcacgcctgcgcatggcgcccaacgtgccgaatttacggcccatatcccaaaagccatcgcgcccgaaacggcgcaaaatgtgttcaaactgctcaggacgcgccgatgtgcaaaaatccaaatcatgcgatttacgatgcaacagcaggtctcgaacgggacctcccaccaacgccaattcatagccttccgcggcgaacatacgccctaattcaatggcctctggccacacttcgaagttcacgccatccctttccggcaccacaagtttctgccttaccagcataccgttaccccacctgcacacagaattgagtatggttggaatcatgattacgcccgcagaccttgcacgcatgcttgcccatgctgcggacgaccatgcccaaaatccgatggaaccagacaaactgctgtacacatcgcagtccgtttccttgcggcaagagaccatcatcacgcccaacgcacccaccccggcaataatgccgcagcggcgcgccacggacggtccgaccacgttcgcctcgctcgacgcgcaggaactgccggtagtgcgcgaatattcggcgggaggtctcgtattcgacgacaagggccgtgtggcgatcatcgcacgccactcgcgtagcggacatttggaatggtgcctgccgaaaggtcatatcgaaaaaggcgaaacaccgcagcaaaccgccgttcgcgaagttcacgaggaaacaggaatcctaggtgaagtggtcgattccatcgccaccatcgactactggttcaccggaaccagccagcgtgtgcacaagctggtgcatcatttcgcattgcgtcagatcggcggcgagttgacggtggaaggcgacccggatcatgaggcggaagacgcgatttgggtggattttgctgatttggacgacgttctcagctacccgaacgaacgaaagatagcatggttgtacgcaaggaaactcaacagacaggcgtgaaggtgaatcaacccgcacaacggaacgttccgcacggcatgcgtgcgctttcggcaatcctcgccatggttatgaccatggcgttgatgttgttatacgcacctgtgccgaaagccgaagccgaagaaacacaggaatcgcaatccggcaccatgctgtcgatcgactcctccaccgccgtgctgaccgacacttccggctatcatttgagcgcgacggtgaccaacaccaccgatcaggaaatcccttcaggcacgctcacccttgccatgaacgccttctacacgttcgtgtcgcgcaacgatatccaggaatggtcggaaggcatcgggcagattcccacgcccaatatcgttgggcagagcgaggttcccgcgcttcaaccgggagcttcggcgaacgtgcacatcgacgcggactcgaatcaggagacgctggcgtccgtcaactcctgggggccgaaaccggtcacgctcagttatgaggccaatggcgttcaacaagacgaagcgcacactttcgcaacacggaccggagctggaatcaatacccccgacacgcccgcgatgaatatcaccatcgtgcagccgctcgaagcgcaaggatggaccaccgacaacaccatgctggaacagctcgtcaacaaaggtggcgtcacctccgcggaactctcgaaaatcgccgttcccggcaaagaagacgaggcacgactcaagtcgctggaacagacgttcaccaagcatgacaaactgcaggtggtggccgatccaacctatctgaaggcgatgccgatgccgacgcaagtcgacggcatcacgcaaccggccctgttcgacatcaccgcctattccgcgctgaacgacagcaaaacctatgattcggcaggcgtcggcacctcgcaatggaacgccgaacaggccttgaaaaactatcaatcggcgttgggtgacccgaacgcgagtatgaccacgtatgcatggcagggcaccggcaattggaccgcagacgcgctggcgaaagccaagcagcaggggtacgacaccgtcatcgccacgcatgatttcgaagaggatgatgcggccaccgcggaaaccggcaagaccgtagtaaccaccgacgccggcgacatcaccgtactgaccgcgcaaagcgtgctttccaaccttgcacaaggcaaggcgaccagtgccgacgccgaagcggacggcgagggaacaacggccgggcgtctcgcgcgattcgtcgcgcaaagcgcgttctaccagatggagcagccgtattcggaacgcaatctgctggtctgcctgaacggcaactctgatccggccgtcgtggacgcactgatgacggacgtcgaacaatcgccatggctgaacatcaccgatctgaacacgctcaacaacgccgaccccgccttgagcggcgacgatgcagccgcgatcgtgccgcaatccgacggaatcaatgatgcgacgcaagccaatctcaggcagacgctcaacacactggcagcctcgacaaacgacatcaaacgattcaacgcatccatcctcaccgacgtcgccgacgatgccaagcaggcccccgcaggcctcaaagcgtggcgcaggcagctcgtcaacgcgcacggcatcatggccctgcacgcgctaggcggcgaaaatccagccggaagcaccatggtggaaggagccgggcaactggcgtccctgctcatcaacggcgtggccatcacaccgacggaaaacgtcaacgtggtcagcgaaaccgcgcaaatgcccgttaccatcagcaacagccacccctatccggtcacggtaaaagtctcatcattgaccaactccatgcagatcgtcacttcgcgtttcgacaccgtggaagtgcccgcgcacggcgaagcccaagtggcgttcattatccgcgtagccacctccggcaccgcggacgccacgctcagcctgcaggacaggcagggcatcacattcggagcgacacaaaccacccacatcaccagcgcattgcagatcagcgacaaaaccggcttcatcatcatcggcatcgccgtgctgcttggagctttgggactgtggcgccaatcccaccgtaagaaggatccagacgaatgagttcttccgttggccgtaattcactgatcatggcctccggcaccgcggcctcgcgcgtgaccgggcaaatccgtaccattctgctcgcttgggctttaggcaccaccggctatgcggcgaacgcctaccaagccggatccatgattccgcaggtgatctacaccttggtttccggcggtattttcaacgccgtgctcgtgccgcagatcgtacgcacgttgaaggcaaaagacgccgaaaccaaactcaacaagctcatcacgcttgccatcaccatgctgttggcggtgacgatcctgatggccctatgcacgccgctgctcaccaagctgtatgtgaacggtagccccgaaaccatggcgttggcgacctcattcaccctgtggtgcatgccgcagatcttcttctacggcctatatacggtggtcggccagattctcgcagccaaagaccatttcaccgcgtatgcgtggagttccgtgggtgcgaacatcatcagctgcatcggcttcggcacgttcatcgcgctattcggccgtgccaccgagcatccgcttgatttttggaccgccgacaaaatcgccctgaccgcaggcacgtggacgttgggcgtggcattccaggcgctggtactgttcattccactgaccaaaatcggattgaaataccgccccatcttcggccttcgtggcattggattgcgttccatgggaccggtcgcggcttggagtgtcggcattgtcgtaatcgaccagctcgccaatatcgtaatcacgcgtacctccactaacgcgccgatgctcgcgcagcagcagttcggcatcaatccgctcgacgtggccggcaatgcttcataccagaacgcgtacacgatttacatgttgccgtattcgctgattgccgtttcgctggcaaccgcgattttcccgaaaatatcccgtgcggtcgccgatcataatatcgccgaagcgcgcatcgatctcagccaggcgctgcgcaatatgggtgtgatcatgtgctatttcgcggtcgctttcgtggtgatgcccgttccgatcattctcgcgttgctgccgtctgtgagcgtcagagaggcgattcttatggcgggaccgttggtcacgcttggcgtgggacttccgttcgccagcgcgtatctgattatccagcgcacgttctatgcattcgaagacggcaaatcgccgttcattttcatgctgttcgccatgggcattcaagcggtaagcgtgatcatcggcgcgaaactactcccccctaccgaatggacgacaatgatcggcatggtaggagccatgagctacatactgccgatccccatcctgtatgccatgctgcgcaaacgattcgaaaacaatatcgacggtccgcgcatagccatctcgtatctgaaatcgattggcgcggcagtagctaccatgttcatcggcgtgacggtacgtgacagcgtctaccagcttgtcggcgcccaaatcggagcggtggacggtcatatgaactggattcaggcagtggcgtgtgccgcactgctggccatagtggccttcatcgtttacgtaggcatgttgcggctgctacgttccgaggaattcaaggaggcgatcgcactgatttcctcacgtattcccggacttcgcaagccgaccagccccaacgatagactggaacaggacgacgccgaaaacggcgagtgaccataggcagaacaaacgtttacaaaaagttgaaggaacccatgaaacctcagctgggagataccatcagcaatcgctacgtgctcgtttcgccattgcgcgaagaaaccggactgcaggtctggaaggccagcgaccatgtgctcgcacgggattgccagctgtttattgtcagcagcagcaaggcattgcaggaagtcaacgcaaccgcttccatgctggctatttcgcatgattcccacttcacgaaagtgctgcagctccagcatgccggccaggtcgcgctggtggtgacgcagcttgacgaaggcatgaccctcagtgaatatcttgcgctgaacgccaaccagccgttgagctatacagccatgcgctccatcattggcgaagtcatcgaatcattgcatgcgctgcaaaaagacaatctcacgcatttctccatcagcaccgacacggtgcgactgacccgttccggcattcagatcgcagatgctccagtgagcatcatgcttgccgacacttcccgcgcgcaggctttggaaaatcgggaacagcttgcgatccgtcaaatctcagcgctgttgtacgctatgctgatccgacgcccgtccacgctgtcgacggatttccgtcttgaagcgctcgcgccgaccacgccgatggaattccgcgtgatctgcaagcgcggtctcgaacttgaagaggacgacggcttccccaccgttccgatggcaaccattgcggaattggaagcgttgcttggcgagtaccaaccgctgtcatcgttgggaagcatggatatcacgttgccttccatggattcggaatgctcaatcgccaatgttccgttactgcagattcttgagaaggatgtgctcccgctgccggatacgctggcagcggctggaagcattccggaaatgacgttcacggctcccgaaccgcataacgatttttccgatggcaaggaggctttggcgaaaggcgtcgcggccaccagtggagcggtgaaatcgttgtggagcagcggccgtgaactgctgagcgaagaagacatcgatggcgtgaccgacaccagcgattctcccttctccttccccatcagggtttccgtaccggacgatggcatgtcatccgacgattcccagttggaaaaaaccggtcgcattccagtgatcggcgcggatggtcaggtcattcagcccggcgaggagtccgcccgtgcgttgaaagcagagcaggaggcgatcgatgccgcgtatgccgccggtcgagccgcggttccgccgagcttcacgccgaagaatccttcttccgcttcggcgaatactgacgttgccgacgcgaaactgtttggcaagctgaaaacgaaggtcgttgcgattatcgttgcggtcatcgttgttgcggttgcgcttgggtttgcagttcatggtttgatgcagccttcagattcggttacgactgattcaaaaggaccatggccggaaataaatcttgacgaagtgccgttcggcgaaggagatcagtcggatgcgaattccgcggattcttccaattccgatacgtccggcaataccgattcgtccaattccaaggattcttccgatgcttccgccaatacgccggcatccggcgagtctacggcgtccaagcaacccaagaaaaccgaggacaaggtcgtgaccgccgataagcagtcgaagaaagtgccggatccgaagcagccggaaaacacgaccgcgtacgaaatcgacaatcgtcagttcctgtcgaatcctgacggacagcagggctacggatattacgtgcatctgagccagccgcagaaggcgtatcgcatggtcatcaaaattcgttcttccggtggtcagggatatattcgcgtgaatgcgacaaacagcccgtcccaaggcgaacaggtggcgcagttcgagtttgacgcttccggcacgaccgacatcaagttcgacaaggccgtggaaacgcaggacatcatgctgtgggtcccacttgatagcctgccgggcaaccagctgtacatcgaaagcattcaagtgttctgatcgtcagcacatcgcaatatccgattacttctgaagattgcgatacgaaaagagcctgccatgcgtcacctcacgtatggcaggctcttttcgtatttatttttggaatatggtcgtagtcgaaaagcgatggaacttggctcaagaatcgacaaccaacttttcgccatttttatcactctgatgtcagaactctaatgtcagattcgggagcgtgctcgcggatgattttatgctgcgcgacggctacccccgtctctacagttccgaaatgccgcttgaactcttcttttcgtcatatctcagcacatatgtcgagcgagacgtggccggttatctcaatgtgcgaaacgtgaccgctttccacaaattcctgcgtctttgcgctctgagcggcgctttgtggcggctcgcgtggaatcaagttttcaagccaaagacgagcaggtatattccgccgcagactggctgacgcgctgaaacgtctaccccagcattagtctgacccatgatctggtttggctggcctcatgattgtgatctggcgacctcacgatttcaatcggggacactcttttccagatcgtgaggtcgccaaaacaaaatcatgaggccagatagaagaaatcgtgcggtcaactgacaaatcatgcggtcgctcacataatcccgtccgcacaacccgcacctaaaaccgattaccagagtcacacggacggaatcgcagctaccgccagcacaccccttactccggccaggattcgaagagggtgaggagcgtttcaacgttggtgtcgctccaactgtcgattctgggaccagcatacgtactgttgtatggctgatcgaacacgaccacatgctgccctgcctcacgcaaagtttcgatattcgccggcgaatcgtcaatatgaatcgtggcctgcatactgtctttcagcccagtaaagcacagactcatgtacggaatgcggttgctgtccagccattgcgcggtgtcggaaacgaccatctgatgctggccggacacgaacagccggtgcgtgacaatgcgaatgtacacatgctcattcgccaatcgctgcaatgcctgcgcgacccccggaagcggcttcatcgtcgcatacagatgctcacgctccgcggctttgtgcgtttcgatgtaatcgtcgagcgtctcgaacggccatccgtcctcgcgcgtgagattgtaatgcgcggtctgcagcgcacgttccggcacgtcaatgccctgccgctgcaggtaatcgcggatcgcgcccttgtaatccgcgcaaacgccgtccaaatcgagattgagcacgcgatatccctgcacgcccacgcgctggctctcatattgttcaggaatagtcgccatatcacgttcctttcttatgcccgacaccaatcagcctgtcgaacagccacaccaatcagcccagcccaatcagcccgatatcaatcaatgtaacctgacattcgccggcaacaagcgcaaatactcccgcaaataaggaagatagaaaatggatagaacaatgccgaccttgcgaaaagtcttacgggagaacgattttgagactttcatagaaaagatagaaaagatagaaaatctgaagatcgcgccgtttcttttgcgacggcaatactgccctgcaatcgacgattgatgttcatcacagcatcgttacgtttatttcaagattagccgatgaaaatacaaaagaatcgacgatcgttgcatgacatcgacggttgagcctgcctatgatgaaggcacaacagaacaaagagacacgatgcggcaggaaccggagagaaaaccggagccgcaccccacacgcggggaaacggcaacgccacccgcgctgaacgtaaccaaaaagcaacagacttacggcagcggccagaggaaagaacagaaaacaagaacgccgccaagccgaacgaaaggaaacatcatgaagaacaacactttcaaccagatcatcaacgccaacctcgcttccgtcgatccgggcttcggccagttcgcactcgccaaggccagcgccgatctgttcaagaaggtcatcaacaagtgatccaaggcccgcgcaggcaggcgtcacattaacacgaccgaagggcttgcgctccatgtggagcgcaagccctttctcatgttccgatcaagcgacgccaagaatccagccaccccagcaactgcacacacagcaccgcacgcaaccacgcacaacagctggtgtttcacgtgaaactctgtagatgatccggcttggaaagcacttgataatacgccataagaaaaaggaatgcgtgaaattgtgcagtgcgcggctggttgctttggtggttcgctacagtgggaatatgagtgatttgcgagatgtgattattgtcggatccggccctgccggatataccgcggccatatacttgggccgggctggattcaaaccactggtcatcgcgggtgcgctgaccccaggcgggcagctcgtcaacaccactgaagtggagaattttccgggtttccccgacggcgttatgggaccggaactcatggataatatgcaacgccaggctgagaagttcggcgcggaaatcgtttgggatgatgttgtttccgtgagcaacaatgacgtcaccggcgtgaaaaccgtgagcgtcgatcagggagacgtttttgaaacccatgctttgatcatcgcaaccggatcggaatatcgcaaactcgacatccccggagaggcggaatattccggcaagggagtgtcatattgcgcgacctgcgacggcttcttcttccgagataagccgattattgtggtcggcggcggcgatagcgcattcaccgaggctgattttctttcacgatttggatcgtcggtgacgttgattcatcgtcgttctgaattccgcgcatcgcagattctcgtggaacgcgctcagcagaatccgaagatcaccatcgtcacggattccgtggtggaggaaatcttgggtgacgacaatggagcccaatccgtgaacattcgcaacgtcatcaccggagaaaccagcacgattgccgcaaacggcatttttgtggcgatcggccactcccccgccacagcttttattgacggcattgtgcagcgagatgcgggtggatatattcaggtggacggcgccagcacacgcaccagcactgccggcatttttgcagctggcgactgtgttgatagtatttaccgtcaagcgatcagtgccgccggcatgggctgccgggccgccctcgatgcccaagcctacctccagcagtaacacttcccatcacggtcataccctacaaaaacttgaaaaacgagcggaaggggcggcatattctgttcacgactgtaagcttggccaaacggccttgagtgtgtcgtgaacagaatatgccgccccttccgcggacaccaaaaaacttaagaaatactatttttcggcagtgggcatgagcaggtcgacaatgcgcttcatgtcgtcttcggatttgaacacgatttcgatgcgtccatgctccttggatcccttgatcgacaccttcgtaccgaacctcttttcaagaccgacctgcatcggagttccggcccaagggttcagcttattggttttcgctttcttcggctggtccgattcagcgaccttcatcgacacgatttcctcggtgctgcgtaccgacaacccttcggaaataatgcgcgtcgcaagctgttccatgtcagcttccgtcggtaatccgagcaatgcgcgcgcatgaccggccgacagcaacccggaagcaaccttcttttgtacggtcgcaggcagattcagcagtcgcagagtattggcgatttgcggacgcgacttcgacaccgactttgacaattgcgcctgcgtcaagccaaaatcgtcgatcatctgctgataggcggccgcctcttccaatggattcaacgcaacgcgatgcaggttttccagcaaagcgtcacgcaacatatcgtcgtcggcagtggttttgacaatcgcaggaatcgttttcaaacctgcgatctgcgatgcacgccaacgacgttcacccataatgagctcgtacatgctatccatgcgcccgtcgaacatattgtgcgactcggcatctttagcggcgttctccttgcgagcagcctcaatctgcgcgagtggacgcttccgtacgacaataggctgcagcacgccgacttctttgatggaatcggcaagctcacgaagatcatcctcatcgaaaatggtacgcggctgatgcaggttcggtccaacatcactcagtcgcaattcaacgagataaccgccctgcaccggcaacagttcaggttcgtcattcttcttatcttcggtcttttttaccgcagcggtttcacgtgaaacactttcctgcttcacttcggcagtggcaacaggactggtggaaccgaagaacatgtcggcaggatgagcagtctcattcaacgtgatggaaggcatactggctcgatggccactccccttcttggtttcacgtgaaacgttcttcttcatgtcatggacggcatcgacggaagccttggcggttgccacggaactcttgaccgcggtcttccccgcggattgcccggcaacagtcgcaccaccggctacgttttctgaaacctttccagcgatcttgttatcagcctttgcacccgcaacagccacagccggttcagtagtggcttccgatttcgccgactctcctggaagagacggaaacagtgcgccgagacccttgcctaaacgtgatttcgtagccatgatcagttctcattccttcttgcatcgatagccttcagcaccgtctgcgagcgacgtgcgatttccaatgcggcctcacaataggcaatcgctcccattcccttgggatcgtaggcgatcacgctttgattgaagcttggagcttccgatattttcaccgttcggggaatcgtggtattcagtacgatagtcggataatgatttttgacttcgtcatgcacttcacggctgagtaacgtcctcttatcgaacatggtgatcagcatggtggaaaccagcagcgacggattgaaatgctcctgcaccagtccgatggtattgatgagctggccgagaccttccagcgcatagtactcagcctggatcggaatcagcatctcatgcaccgcacacatggcattaattaccagcaggccgaggcttggcgggcaatcgataatcacgtagtcgtagtgctcctcgctggtttccagaaactcgtcaaccgcggtcttcagaagcacattacgattttccatgtcggcgacttccagctcggcaccgctcaaatcgatcgaagctggaaccacatcgagcagatcaaaatcagggcatgtgcgcttgacttcggcgatggtcttcctgccttcgatcacgtcgtacaccgaaggctcccccgacgcatgcggagcgcccaacgcggtcgacgcattgccctgcggatccatatcgatcagcagcaccttggaaccgaactgagccaacgcagcggaaagattcacggccgacgtggttttgccaacgccacccttctggttggcgaccgcgatcaggcgcgtctgctccggctttgggcaaacggccttctgcaaggcgcgatagcgagtcgattcgtcggcaatctgcgaaccaagaggagaatccgatcctccgaaaattcgtttgatggtttccgttgccgattccatcgatgtcaggttatctggtccttcaggtccagtcatacactagccttccttacgatatgcttaacattcaagtttcatcattcgggtggacagaatcagctcatctcacccactgtgcacaaatgtgaatagctgtggatagtcggtggataacttacgttgttcgcaaaaagttatccaccgatctttcgttgctacttcaacatttttccgccgctttttttcgtcgattttccagttgtggacaatgtgcataactcaccgaaatggtggataacttactttttatccaccatgagcacatgggtcgattccaagcccggaccaacctcggcatccaccacccgcggacgaatgccaccgcatttggcgatctctttggaagccttttcgatctcctcttgcgcggaccgccccttcagtgcgaccaaacgtccaccgcgctcaagcaacggcagcgtccaccccgaaagtttggtcataggagccacggcacggcacgtcaccacggcaaacggatgtttcgcctgaataggcttgccatccaaatccagtacaggaccgcgaacggccactcccctgccgttcttgccgcctttgccgttcctggcgcttccattgccacgattgccgccttgagcgccagtagcacccgcaatggcctcgatcatctcattggccctggcacgcaccacggtaacgttattcaactccatatcggccacgcactcgttcagccattcgacacgacgttccatcggctccacaagcgtgaaccggtgatccggcaggcaggcggccgcgacaataccgggaaaaccgccgccactgccgatatcggcaaccgtcttgaactgcttcttggccgtggcttcctttacgaaaggcacaatggcggccgaattcagaatatggcgttcccaaataatgccaacatctcttggcccaatcagaccgcgaggttcgccttcttcggcaagtttcgcatggaaaacacgaagcttgcccaacgcatcccccagcacttcctcaagcatcggcgaatcatcaagttcgtctgtcacatcactcatgggcaccatcctatatcctgctcttcctcattgtcggtattccagcaagtacttcccgaccattgacggcaatatcacatgtccggcgcacggccagcatgaagtcactcaaaaaatcgcaataaaaaaagcgccaccaaatggtgacgccatgtttcacgtgaaacgagccgaactcaggcctcatcctcgtcttcagcatcttcggcagcggaagccttgagatacaccgtgacgtaacgacgcggttcctcgccgtgggaacgggacttcatgccctcctcacgcaccacatcatgcacgatcttgcgttcgaaggagttcatcggcttgagatcaaccggctcccccgtctcgcgcacctcgtcgatggcgtccagcgcgatgtcgtgcagacgctggcgcttgcgcttcagatagccgtcgacgtccacaatgagatgggaacgctcgccggtcttctgctgcacggccagtcgcgtcagctgctgcagagcgtcaacgacttcgccgttgcgtccgatgagatgcttgatgtccgtatcatcatcggcgacgatttgcacggtagggcgattgttgcgcacgcccatttcgatatcgccttcgtaatcgacgatatcaagcagtccttcaagataatcggcagcgatatcagcttcctcgttgagctgatcgatggtcttttcctcatcttgcgccatagtggttgtactcctttgagcggggtttctattactaaagtcttattgtgtaaagtctaattcctgtttaccacgtcgacaataaacgctgataaaagtggtgtgtcccgcgtttcacgtgaaacacgggacacacttttactcacttctttttctttttacggctcggctgctgacgctggtagccgctcttttccttcacttcggcggcttccttggccttctgcagcgcctcttcctcgagggatggcagaccggccttggctcggcgggcgttctcatgaacatgatcacgcttttccttcgcttcggcggccggagatcccggagtcgggaagacgtggatctgccagatggaacgcaacagattgcagatgttgttggtgagccagtacaccagcacagcgaacggcatggcaataccggagaaaatgtacatgatcgggaacatccacaacatcatcttctgcatcatttcggtctgcttgtttgccgcagactgagccatgttacgcttcatgctgttgtactgcatgaaccacaggcagaagcacatcaatgcaacgaagatggcgataactactttgccatgcacggcggcggtcgtgaagttatcagccacgttcacaccgaacactgtggtggacgtgaactgcttggctgtggcgatgtcgaaagcgccaagaccctgtccgtccctgaatttgccgcgtgcgatgtacggaatggctgacagcgtatagaacatgcacatgaatacgggaccctgcacgaacatagggagcatggaagtgcagccacccatcgggttcgcatcattgtcctggtagagcttcatcatctcgcgctgcatggcttccttgctggcgggatcgttcttgcccttgtatttgttttggatacgctgcatctttggctgcaggacggtcatctgggcctgcatcttgcgcatacccttcatggacttgtagaacagcggaaaaacgcatgcctggaccacaagtactaggaatacgatggacatgacccacgagaaaccgatctcgttcatgcccagcatcaccaggaacttatggaatacggccatgatctgcgtcatgagccactcgacgggatacaggagcttatacagccagccccagaaaccgctgtcgaggaggaattgattttgattcattacaggccagtctccttatcgcctataggtttttctacgttcagaggcgtgagccgaggttcctcgtgtgccttcgaccacgaacatctgtaaaacaaggaataaagctgcggaacgtcgtcaattcccccacggttccactgattgcagcgaagaaggcgcaataacgcaagaaggccacccttaaggcggccaaatcgttcaatcgcctgaatcgcgtaattggaacaacttggataatatctgcagcaaggcgcggtattcgcggaaatatgacgttggtaccagcgaatggcacgaatcatccaatttccgttacgaccggcgttcattaccgacgcacggccttacgattcaccgcttcaaaacatgctgcgatctgctgctccaacgatagaaaatcggcatgcgcagcacttggcttggcacgcaacacgatatcgcaggattcaggtaaggcagattcgtactttcgtgcaagcacgcggaaacgacgcttgacggcattacgcgtcacagcgttgccgacagccttggaaacggccaaaccgacacgtcggccccgcatcgccgcagaatcgtcgataatggcatcgtcgtgcaccaaataatgcacgacgatgtcttctcgcgataccctacgacggcgtttgagcaccgcgacgaaatcgcgatggcttttcagccgttccaccgctctatgccgttaaatcaggcagcgagggacttgcggcccttggcgcggcgacggttgatcagagcgcggcctgcgcgggtgcgcatgcgctgacggaaaccgtgcttcatgtgacgacgacggttgttcggctggaatgtcctcttcataattaatgctcccggtgttttttgccatgccaaggcacggctcctcatgagtcaagctctaccaagttactctgacccctgaacagagatgaatacgcatatcaaatccttcacattttcatggggattctccccacaaaacaatccacagaaacgttgatatgtcgccaaactccccacaaaagttatccacaaactacaatgatgttattcacaattcagtcttttcaacacgcttaccggtggataacttggggaaaagagagtacaaataaacagttgcacacttggaaaaagtctgtcgagaaaggggaatcc

SEQ ID NO: 7 - DNA, 18 bp, Artificial Sequence
  Forward primer
tcgcgtcyggtgtgaaag

SEQ ID NO: 8 - DNA, 17 bp, Artificial Sequence
  Reverse primer
ccacatccagcrtccac

SEQ ID NO: 9 - DNA, 26 bp, Artificial Sequence
  Forward primer
agccatcgtcaaggagcttatcgcag

SEQ ID NO: 10 - DNA, 24 bp, Artificial Sequence
  Reverse primer
cacgacgtcctgctgagagctcac

SEQ ID NO: 11 - DNA, 24 bp, Artificial Sequence
  Forward primer
ttccagttgatcgcatggtcttct

SEQ ID NO: 12 - DNA, 20 bp, Artificial Sequence
  Reverse primer
ggctacccgtcgaagccacg

SEQ ID NO: 13 - DNA, 1371 bp, Bifidobacterium longum
tcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacccc

SEQ ID NO: 14 - DNA, 789 bp, Bifidobacterium pseudocatenulatum
gctttgcttggtggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctg

SEQ ID NO: 15 - DNA, 321024 bp, Bifidobacterium longum
aacccggaacgttaagccgggaaaccacatgggacacggccagccaccaagaccccgaaccgttccccggcttaacaacaaacccggcttaatcggagttaaaccgatgtcggtttaattccgaccgtggatgccactaccggtgggacgaatggatccgcatctacggggagcacaggctgacgcggtcgatgagcgcgaagggctgcagtccggacaacgcggccgccgaggggttcttcggcaggctcaagcaggagttcttccacaagcgaagcttccaaggtgtctcgatcgacgagttcatcacgttgttggacgagtacatggtctggtacagggacaagcgcatcaaactcgaatacgggatgagcatcatggacaaacgcatccagctcgggctcgtcgcctgaacgtgcgcgctatcgttgcgaacgaccattcagacaacgaagtccaacaaaacgtcaccgcccccgtctttattaaaagcttccataaagcctgacttggtgtctcattgggaacgtatcggtggacgacactgagaaactcagagggaataagactttcagtagaaaaaaagagggtaagcctatgtctttgtcaattctgtagaaggttgtcgtattggggtctcggtgaccgtcgtgggtgtgcttcgtcttgctggctgatccgatgcttttgtctgccgcttgagtttcatgcggcgaggacacggtctgcggacgtccccgctcctcccatatccggacaagcattacattctgttctccaaggaaggattcaccgacaacatgaaacgtctggccgaagaggacggtgccgtccgactcgtctcgttcgatgagatggcctgaagcctatgttcggtttaccgtaacccgaggagggtgttttccgcggggtgcccccctccttgtaggatatgggggtatggctgatgaagttttctctccgaagaacgttattgtgaccggtggctgtggttttatcggttcgaatttcgtgcattacgtgtatgaccatcatcctgatgtgcatgtgacggtcctggatgcgttgacgtatgcgggcaacctggagaacatcaggggcattcttggcgaccgcgtggagttcgtgcacggcaacatctgcgacgccgagctgctcgacaaaatcgtgccgggccatgacgcgatcgtgcactacgcggcggaatcccacaacgacaactcgatcgcgaatccggagccgtttttgaagacgaacgtggagggcacgttccgcttgttggaggcggcccgcaagtacgatgtgcgctaccatcacgtgagcactgacgaggtgtacggcgatctcgccctggacgatccggcgaagttcacggagcagaccccgtaccatccgtcgagcccgtacagttcgacgaaggcgagttcggacctgctggtgcgcgcctggcaccgtacgttcggggtgcgcgcgacgatctcgaactgctcgaacaactacggcccgtaccagcatgtggagaagttcatcccgcgtcagatcacgaacatcctggacggcatgcgtccgaagctgtacggcgatgggttgaacgtgcgtgactggattcatacggacgaccattcgacgggcgtgtgggcgatcctgacgaagggtcgtatcggcgagacgtatctgatcggcgcggacggcgagcggaacaacctgacggtgctgcgcgacatcctgaccgtgatgggcaagagcccggacgacttcgactgggtcaaggaccgtcccggccacgaccgccgttacgcgatcgactcgaccaggctgcgcaccgagctcggctggaagccggtgcacacggacttccagaagggcctggagcagaccatcaagtggtacacggacaaccgcgcctggtgggagcccgccaaggccgccaccgaagccaaatacaagcagcagggccagtgagcggaatatgaaaatggccacacctcgaaggtgtggcccctatagcactaagaaagatacacatatgaatttgaaaaagcaagcggacaatgccgtgatggcgagtcgttttcttgctgacgcgcggttccaagtgtatctcgattatgcaagacggcatgtggatacagtcgatcgggaacggctggtcgatctggcggtgaggctgtaccgctggaacgtggaggcatccgccatcacaatcggttatatcggctatatcgagatattcgtcagaaacgcaatcgatcaccggctttgcgaatgggtgtccgggcagcagataacgggcatcccggactggcttgaagccggcaaaagcgatccgatcgggaggatacgggctttgatcaacagccccgagcgcgactatatcgcggaggcccggaacacggcattgcgcaagcagcggcattggcgttccgaccagacgcatccaaggcacggggatgcgatcacccgcgacgacgtgttctcccaattgacattgggcacgtgggatggcatgttgtcccgttccggcaaggaccctgaactcgcccatgtcctcatgggcgcgttccccaacatcgcggatgcatgggcgtcggaactgcgtcgtatgccgaagggaaggcttcccggcaacgacggcgacccgtttgaggacaggctgcgcaaggaactggtggaccgcctcaaatcggttcgtaccatccgcaaccgtatcggtcatgatgagaaccttctgcgggtcgagttcgcgaaactgagatacgacatgttcttcatcctcgatgccttgggccccgaatgcccgaattgggctttccccgataaaggggaggccttgaaaacgcttaatcctgcacgctgcatagcaacgtggcaaaacgattctgaagatagaaagtagggaacgtatgtcgttcgaattcgagaaggacttgaaggtcgaggagacgaacatcccgggcctgttggtgttcgacctgccggtacatggtgacaatcgtggctggttcaaggagaactggcagcgtgcgaagatgaccgcgttgggcctgccggatttcggtccggtgcagaacaacatcagcttcaacgcgacgaagggcgtgacgcgcggcatccacgcggagccatgggacaagtacatcagcatcgcggccggtgagatcttcggcgcgtgggtggacctgcggccgggggagagcttcggccaggtgtacacgacccgcctggacccgtctcgcgcgatctatgtgccgcgtggcgtgggcaacagcttccaggcattggccgatggcaccgtgtacacgtatctggtgaacgcgcactggagtctggaacagaagaagacgtacacgttcgtcaacctcgccgacccggaactcgacatccactggcccatcccgctggaggaaagcgaacgctccgaggcggacctgcatcatccgatgctcaaggacgccaagccgatggagccgaagcgcacgctggtgacgggctgcaacggccagttgggccatgcgatccgcgcctacgcggaggcccatggccttgagggcttcgagtacacggacatcgacgagttcgacttctccgacccggccgcgtacgacaggtacgattggagcctgtacgggacgatcatcaacgcgggcgcctatacggccgtggataaggcggagaccgcggagggccgtccggtggcgtggaaggcgaacgcgcagggtccggccctgctcgcgagggtcgcgaaggaccatcacatcacgctggtgcatgtgagttccgactacgtgttcgacggcaccgcggacctgcattcggaggatgaggcgttcgcgccgttgggcgtgtacgggcagacgaaggcagcgggcgatatcgcggtggcgaacgccccggagcactacatcctgcgttccagctgggtgatcggtgagggccgcaacttcgtgaagacgatgatgatgctgtcggaccgtgtcgcgaacccggacgaccagctggagcaggtgacggtggtggacgaccagtacgggcgcctcacgttcacgaaggacatggccgaggcgatctttcacctgctggacagccatgccccgtacgggacctataacctgaccgggtccggtgcggtcaagtcgtgggcggagatcgcccgtgaggtgttcgatttgacgaacggtaacggcgacaaggtcaagcccatctcgacgtccgagtatttcgctaacgcgaccagcccggtcagcccgcgccccgtgcacagcgcgctcgacctggcgaagatcgaggcggccggatacacgcctgccgactgggaggaaaccctcaaagaatacgtcacccgcgaactcaacaagcggtgaaacaggaagtgaaggaaaacaccatgaagggcattatcttggctggtggttccggtacgcgtctgtatccgttgaccaccgtcacgtcgaagcagttgctgccggtgtatgacaagccgatgatctactatccgctcagcgtgctcatgcttgcgggcatccgtgacatcctgatcatctccacgccgaaggacctgccgaacttcgaaaagctcctcggcgacggttcgcattacggcgtgcatttttcctataaggtgcagcccagcccggatggtttggcgcaggcattcctcttgggagaggagttcatcgacggcgagccgtgcgcgctcgtgctgggcgacaacatcttctacggtaacggtctgggcgccacattgcgcaaggccgtcgctaaggccgaaggcggcgagggcgcaagtgtgttcggctactatgtcgacgatccggaacgctatggtgtggtcgagttcgacgagcataaaaaggccgtctccatcgaggagaagccgaaggagccgaagtcgcattacgcggtgacgggtctgtacttctatgacgagcgtgtggtcgagttcgccaagcgggtcaggccgtcggctcgtggcgaactggagatcacggacctgaacaagatgtatttggaggacggctccctgaacgtgcgaacgctgggtcgtggttacgcatggctggatacgggtaccatggattccctgtacgaggcgggcgagttcgtgcgcaccgtgcagcgcgcccagggcctgcccatcgccatcgtggaggaaatcgcctacgaaaatgggtggatttccaaggaggagctcctcgaatcggccgaacgttacggcaagagcccctacggcaagcatctcaaggatgtggccgaaggcaaagtcgtgattgttcctaacgactgatcgactcggacgaatgcggaaacgccatagtattttgagattaatgctgagtgcgatagcagattacgcatttgccgatgtatatgacaacattgttcatcaatagtaaaagggggctgctgcattgcagtatgcagcagcccattaccatgtttggtaggccccgaccatcgaggcctaccaaacatggtaatgggcggacggaaagttggacgttttggcgtccggattggagtccgcatgttttcgatggaggatcggcgcagggccgttgacctgtatttcacggagggcatgaccatcaggaaggtcgtcgccaagctcggctacccgtccgagggcgcgctggcgaaatgggttcgcgaggacccgcgctgcacggttcctttggccttccataagttctaggtaaaaatatacacttatatacacatatatacatgaatatgtgagttcaagcgaactgatgctacgccggttcgtccccgtccccatcaaacttgtgctcatcctcgtaggcaacgatgtccatatcgcctcgatggagtttcttgagtgtttcagccactcgcgcctgctcatcatcaacaacagggcgctcgccggctaggcatgtgagaccatcggacactgcggaaaacactgccgaacccgcccaacaaacattgaagcaatacattttttatttgcttcgttactgcgtattctgtacttcacatgtgcgaaacgttggaattccgccaaaattttatttgcctggtatttgcttgggtgggtcgcaaagcgcggttgcggcacgattcttagtggtggtgccttatggcgtcgggctttccttgcaaatcgaggtaaggaaactggcccttaacccggaatttgaaaaagtaaaaggtccctggctgttcaccagccagagacctttttggtaacaactgaggttgaggaaacctcggcagttgggtccaacggggcgaaagtctgtggcgccgccgagaagattgccccgaagctagcgcgacctttctgctacaacacagcataccagcatccatcgaaccttccccgtacactggacagaccaaaccaaggaactactagcgtggcaccttggcacggtgtcattgtgccagcaggcatagtgactggttacaactaaagaggaggttctcatggaaggcaacgaccatgacaaccgtccgagatctgaccgacaataccgggaaggcctgatgacgggcctgttgatcgctctggccaaccaagttggacagggatggtcgacggctatcatcatcgccacactggtactgcttggattaagtctcagacgaggccgctgacttgtcagcggaacagccggaatcttttacgggttccggcccctcgtcttcaatcagggcaccatttcaaggcagaagaatcaggcggcctttttgcggccgcggcgcttcatggtgccagcggtggcgttggccacgtcgaagatcacggtcttgctttcggggtaggcggtaccgttgacggactggtaggcgatttcgccttccggagcctcaggcagagtgaagtatgccttcactgcttcaatgagcgtggcttccttgacgcttaccgaagcagcctgcttgccttcgggcttgctgaacttaatggcgttgtcggccttggcggtggtcggggttacggcgatctgcttggtcttgtcgttaatcagcaccttgacgtacgccgggaatccgagcacttcagcggtggctttgttgaaacgaatggcggaatcggtgacggtcagaacggtcttgcccaccggcttgaccagctgaacctcttcgaatccctgaagcaatgaagccataattgctctccttattgcattggtcacgtgttttttatttacgtcactaattgtaaccagctaatttcgcattatacaaatcatatgcatgcatgattgcataattgaagaacatttgacctacgtattgcgctcctcgaatagcactgatttaaccaataccaagaaaagcggaaacaagaacccgcaatatcagccgtattgaatatagcaatatgcaatttcaacatcgcaataactgacggcctttttgcttgctctattcgccgatatcgcattcaggccacagcgccgagcataatatcgacgccgtgcttgatttccgcatacacgcgttcaaacacctcgcgtgattgacgatgagggtcttcggtttcgagtgccgtaggcaaaaacggccgcagcataggtacgcaatccatgatttcgatgagcctgtctgcggcggtatcgccggcaatcggaccctcggcatgcatatgtttgcaagcgttcacgaagtcattgaacagaaatactttgcgaatagccagtggattctgttcaagcaaatcggaaatttgctcacgctcaaaacacagaatcaggtcggcttgccggctgatatcggtggtgagaggggtggaagaatgggaattcgcgtcaatgccgtcgttcttcagcaaatcgataaccatcggatcagcgggatgcgggggatagtgcagagtacccgcgctgcgcacggtgatattgccgctctgcaagccaattcctcggtcggcaagcttggctcgggtgtagtattcggccatcacggaacggcattgattgccggtgcatacatacatgatttgcataacaacgtcccttctcaagtgttgtgagcattccctcatatattccagtgagcattcctcgcgaatatgcgtgcgttatgtaccgtagcaataacatgaaaaaaccgggaatcatcgactcccggttcagtggtattcgcgaactatgcttcagcgtctactgtttattatgtcagtcacgtcagcgacgagtggtgttcttgcggacggcgaacagggcgatgcccgcggcggcaagcagcacaacggccacaccgtacggtgcgatggccgcaccggtgttggcggtggtagcagtcgtggtaccggactggtcaccggttccggttgccggaacctgaatggtggcggtcttggtaccggatacagcgccaacagccttgaccgcgatggtcttgccagcctggctggccttgaacgtgtacagcaaagtcaaggaaccatctgccttggcagtgaacgtcttggatacttcagcgatctgctggacgtcggcgacgatggcatcatcgtagtacacggtgacggattcgttcggctggaatgtgcctgcagggaacgtcacggtagcggtggtgccgctgtaagtaaccgttgcaccgtaatcatcagccatagcggtattcgttgcaaaaccaaagcccagaactgcggcgataacggccagcacggccataatcttcttcttcataacttcgaacctccacaatagaaccggttactatcaatagaaaatcggtcttttttcaattacaccccccaaccatacacccccttttgtcggtatataaggggtaattatgttaacgggtaagggggtgtgacaacgtggtcacaccatgtgacaacgttcgaacatactgtcgccgcattaccgttgcagcggggtctcctgacattctgaaaacgttgctattccaacgattttgctgactggcgatacgtgcatggcaaacaacagggaaattttttctgcgacacgccgacgggctactcggattctgatttgtactcgtcgtcaaaactgaacaggtcctctacggtggtgccgaacacccgcgccaaatccatggccagacgcaatgatggacagtattgcccctgttccagccttcctatggtctcacgtcgcacgttgaccagatcggcgaggtcggattgcttcataccgcgttggagtcggtgaagtttcaggctagtcttcatcgtcgccctcggtgccggcatcgtgttccagccatagatatcgaatatcggaaatggccagggcgcacatggccaatgcgggcaacagcattggcggaataatgtgaactatcgagcggtcaatcagattcagtgtggtgtagatgaaaccgacaattaccagaatgcccaccaaactgaccagcgcgaattgcatggccgcgctttgatgcatatcggaaagctcgtcgcgtcgcgggttctgccgtcggaatacagtcatgccccatacttcgccgccgatccacaacagcgccgcgatcgctgccacgattactccgagcaggttattgccaataagaaccatcagcatgcaggcaatggcacctatggattcaaggatggcacgaaagcaaatataccgattaaaggtcatggccgtctccgtgaattatgcgagcgatattgaattgcatacgcaattataaagttaggggggtaaccccttgtgtggtggttaggccaaccggcggaggctctttgcgtagaccgagaataatcgcaatcagtaattgttatgggcgatccagtagttgtacgctgcgacgatgccgccgtagcgctgctcgcagtagctgatgaaccacttgaactgggtcttgtagttggtctgccagtccgcgccgaaggaagccatcttgctaccggggtaggcctgacccaagccataagcaccagacgtggggttggtggcggtggggctccaaccggactcgtggttgatgatgtagttcgcagcggtgaagtccgcttcgctatacccgttgtccaacagatactgatgcgcccaggactgaacttctccagccggaacagtggtgccgagatcggccgacgatgatgacgacgtcgacggcgactcggtggaaccagtgcccaccaggatcaccttatccaccggggccttcttgacccatgaggcgaatacgttagaagagacgaccttgtcgccggctcgcttgaccagcgaggtggtctccataatgcccttttggccctcggtctcgaccttttcctgacccctgggcaggctgctggtctccttgcgcacttcattgaaggcgatctcggtatcgttggtctccacatcggcatccgcgcgattaatggtgaccacggtggcctcggtgaccttggatttcagcgagggagatacggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgtgccgagcagacctgccgcggccaccacagccgcgatcttcatccactggcgcttgttcaacggtctgagcatacgggtcggcttggcatgtctcgtcattgcgctccttgatcggatttcacactgaccaccatgataggcggcgcagtggatgaaggaaaatcaggcttaggcctgctggtcggcaccggactgggcggccttggcggcggcgaggtcgagtgccttggtctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatcaaccttgacgaatgcgatgttcgcgttctccggctcgttggaggccgcctcgaaaatcgggccgaacgcgcggcacgggccgcaccaggtggcccagaagtcaacgaacacgatttcgttgtcggtgatggtcttctcgaaatcggcggaggtgatggcggtggttgccatgatgttcccttcttctgtgttttccctggcatcgccgtacggccctcgtgcgtggccgccgggcgattgccttattcatgcaatacgtcttggcgcttggggccgtgcggttcgtggccgtcggctccctgctggctaccagcttcccagcaccacccaacatttgtgttgtattttccgccgccggccaaacgtttcccaagatttcgccgtaaggtgacgcgtggcgtgattttgcgcgcaataatgggatgcatgccagtcatgaatgatgaagtgcccgacgagggcgattatgatgccggccgtggccgcggcgaattcgacaacatcacgcccgaggacttcatccacggaggcggttccggtcacggcaacccgccgggctggctggggccgtccgacatcaaccgggcgcgccatcagatgcccatcgcgtatgtggagatcgtgcctgtgcgcaccgatgagatgggccgcatctcccaagtgggctcgctgctgcgcgtatccgaagacgggtcgatcgagcgtacgctgattaccggccgtgtgctgtaccacgagacgttgcgcgaggccatcgcccgcaatgtggccaaggacctgggcgatatcgccttgccgctgctgccgatcgggctccagccgttcaccgtggccgaattcttccccacgccgggactaagcgaatactacgatccgcgccagcacgccatcgcactgtgctacgtggtgcctatcgccggcgactgcaagccgcaggatgagacgctggatgtggaatgggtggatcccaagagcgacgtaatggacacgttcgtggcgcagatggtcaacggccatgggcgcatcgtgcgacaggcgttggcctgggccggaatctgacagttgttttgccttccgttggaggggatggcgcgtagcgacggagggcggtccgcgttgagaccgctcccagccgactgtgccgacagctccgccagtggggcgcgaatgtgaaggagtaattcatggcaatcgaattggccaatcatatctaccgcgacggcgaaggcgtgccggtggtgctgatgaacgcctacccggtggaccaccgcatgtgggacgtgtgcgcgaaggcgctcgccgacttcgccgacctgaacgacgtgccggacttcccgatctgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgcgacacgatggccgcgtccgacggcgtgggcggagagaaccgactgaagatggcggacgccgccgaacagacgaactcggtcgaaccggtgatgcacttcgcgcagccggccgatggcgattccaccgtcaagaagactcctgaattcatcgcgaccatgaccggctggatcaacgaacagaacccggctggtctggcctggcgtcagcgcatgacctacggacgtcctgaactgggggcggtgccggaaacgatcagcgcaccgagcctggtggtatccggcgaactggacccctccagcaatccgagtgtgatgcggccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacctcgatgaccgctgacattcatttctcgcctctggcactgacccatgcgctgccgttcctgccgctcgcacaaggcgacatcgactatcaggtggaccggcgaagcgaacccggcctgatcgacgagctgctggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagccgggaaacgccaagggtaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccacgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggcggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgaggaacatgcatgggtggaccgttcggtcgaccccgcaatcatcggcattaccgaatacgccgccgaccagcttggcgaacttgtgtttgtggatctgcctgagcctggcgcccgtgtggaggccggcgacgagatcgtggagcttgaatcctccaaggccgtccagccgctgatcagccccgtggcgggtacggtcaagtatgtgaaccgtgacgtggcggacgacccgtccgtggtcaacggcgatccgtacggcgaaggctggctgctgaaggttgagcttgacgacgatgagccggagctgctgagcgccgacgaatacgcgaaggtcgtgcggtagttccttttgagctcccctctctgaggggagccaagaaaatgaggcgtatggcctatattggtgtctatgagaagcccacgcgaggattttgaggcggcaggcaagcgactgccttgggatgctgctgctcgcagtgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaagtcaagccgccgatcacccgattcatacgtcgtgccgtcacccgcgtgttcggcgtatggtcacgcatctccactcaggtggtgcgccaatgggactggtatccgcgagtggaaccctatgtgggttatggcaccggcgattactcgcgtctgatctgccgcacggtatacgcccccaggcacgcgcaatccggcgaactgatccgcggcatccgcggcatgcttgccatacccgcgccgcgcacccacgtgcaggccagcattgatgacatgccgctcaacaccgtgcagatcggcgtctccgaggtctatgacaaggtggaccgcacgcgcgatctcggcagcgaatacgccatctccgattccgccggatatctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacctgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacggggctcacctcgacccagccgactccggtaaccgatgtgccagtattcaccggcaccacaggctcgaacattctgaagaccatgctgccgtatctgaagacggtgttgcgataggcgcggcgtgatgaacactgaatgcgtcccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgaggggcatgacttcttccggctcggcggcttggatctgagcaaggacggccgttggatgctgtacggcgtggatgttgcgggagacgagcgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcgtcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgctgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcatcgcgttgcatcgcaactttgtgtccctgagctaccgtgccgacggccagccgcacgtggcatacatgaccaagagcgcggctgccgccgacttcctggccggacggccgtggcggtttacggaactgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcaccgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggcctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtacatgaagtcgtacacgccatacgagaatgtgccggtcgccgtgctcgagggcggcaacgacgaggctgccggtgacggcagtgctgatggggctgccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgctatctgcgcgatggtgcgatcctgcccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaacaccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacatcgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgagcatctcggctttgatgatgcggccaagaagatccataccgccgtcgaagcggacatcgaggagctcggctccaccgtgcgctccaccgaccaagtcggcaaggacattctggcccgcatgtgacctcaaacctggctcccctcactgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatcccatgctttgttgcatgacctggaacgagctctaattagcgatgattcattgcggtccgtattggacgctcaccctagttgccaaattatcggcacagatgaaattgccatcaaaaccgcatacagccgagccgtaagcagcaacttgcccccgctggcgggggctccagcgcagcgggtgggggtgggcagccccgatgcgccgaacatcccagcatccatcaatgcacaaaccaagcagcccgacaaaagctctgaataccgggagcgctggaacgccctcaagcctcaactcaccgtgatccacgaccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggtggcggagcgatgtttatcgaacagggcaacaccattacctattctctgtatgcgccgctcgatttcgttcagggcgtaagcatcgaagaatcctaccggctctgtgactggtggctggtcgaagcgctgcgcgaacttggcttggatgtgcggttcgcgggcctcaatgatatcgcctcgcagtacggcaagatcgggggagcggcgcagcggcgcttccccgtaggctcaggcggcgcggtgctgcaccatgtgaccatggcgtatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccggtggccgtgcgcggttttgtcatgggcgagcgcggtaaccgcgacagtgccgtttttcgcggtaacgcattcgtcagcatgtcgtacggctatcggatcgtgccacacatgaagtgacgaatgagggcatgctcctgacgaaacctgtgggacgcgttacaatatgacggatgggcgacgacggtcataggacaataaggatggtgcgatgagcttggaaacgccaaacgcttttgctgacgaggaaaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtctgcggtgtccatgagccatggcacgcgcgtggtctggctggagcatgatgccctgttcgcatggcttgatgagcatccgcgtgtggccatcgacatgttgcaggtcatggccaaccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtggtcggtgccaataaggccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgacgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtacgatccgctggtcgaagagaaccagaaggaaagcgaaaaccaacgcaatatcgtgctcaagctgatgctgcaggaaggctacatcacccagaagcagtacaccgaagctgtgaacacgccgttgaaggacacgctgaaagcacaggacgtgaatgtcggctgtcaggacactggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgggcttcggtctgaatcgttactatgacgccactccggcagccgcgaacgatcccaccaagacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtggatcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagaacgtgccggaggaggcgggcggctggcctaccatggcaccgtctgaaatcgcgttcggtgggttgcgtacgccgcgcgcgctgtccgtggatgagattcatggtctggtcggcgcgttcgccgtggcggcgggccgtgcggtggccgccggcttccaggcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgcccctgagggcgtgccggttctggtgcgcatttcggccacggattgggccgccggcggttgggatttggaccagaccatcgcactatccaagatgctgaaggagcatggcgtcgatgtgatggacgtatccaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgtgatccatactggccgttgcgtgcagccaacaagctgggcataccgtccaccgagatcccctacgccccgcaatacgtggccggtgcgtactaaatcctcatggggcggtaactttcccatggggcggtaaaaccctcatggggcggtaacccaaaacggcggtattctgcggaatgtgaaatttggctaaccgccccatggggcaatcaccgccccatgagggttttaccgccccatgggtaatagggcaatatgtgagttcactccacgtctacgccgacggcgtcggagacgtgctcgaatccgtcgcggcgcagcagctgggccagaccgcgcttcaacacggtaatctgctgcgggcctcggtacatcagcgaactgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgctcggccagcacatcgagcagctccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcatcgaaatgcagtaatcctcaatgccttcgtccaaatcgccgcactggtcgtcgttggtgcgggcgatcgacacagacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcaaaaccgaagccggcatggtccagcaccacgggcatgtcgcagttcttgtcgaggccggcggacaggccgaacgggttggtgaaatcgacgcccatcacattcgtttccagaatggggtcggtgtagtcgagcatcagctgctcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgtcgtgccagaagctttcagaaacgtaagtcataccgcctattgtctcacgcttgggctggtgcggctaggcgattcctgcctaggcgaattggggaaggggctaccgcgtgtcgaggcgcacgcaggcgtcggctcggcagaagatacatgaatcgggatgcaccaggtatcaggcgtgactcgccgctgagcaacgcgctcgggagagtcgtcggtcgtgagtcatcgcgctagtggtcgctgcgagaatatcggttcgcacaatgtgcgattttgcgcggttttgtggaaatgaacacctgaattgcccggaattttcgagagattgtccccaaaacgctcaagccggtttggtttgtgagcttttgtgtgcgataatgttcacatgatttcgtcacaacgtcagcacctcatcttgagcaggttgcgcacgcgcggggcagtgcgcattacggcgctatcgaaggaactgggtgtgtcagcgatgaccatccgccgcgatatcgccgaactcgccgacaagggactgctgaagcgcgtccatggcggcgcggtgactaccagtaccttgctcagcgaacccctgttctctgtcaagtcccagatggatatcggcctgaaggacgccatcgcccaggaagccatcaaatatgtggctcccggcgatgtgatcgccatcggcggcggcaccacggcctatgtcttcgcccagcatctgctcgaatcgcagcagtccagcggcatcaccatcctcaccaattcgattcccgtggccgaactggtccaggccctcgaatccaaggacgtggaggtgatcgtcaccggcggagtgatcacccgatcgaactcgcttgtcggtccgatcgcggacaaggtcgtcgcctcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacatcgctgtcgctgtttgcgcgcttcgaccaagtggacacggtcattactgacgacgggctcgaccccgactccgccgccaaaaccaaggatttggtaaaggaactcgtgctggcccaccagagcgagatcattgaggaaagtgagtaaacccatggctgatttcgccaactacacccccggggagtatgcgaaggagcacatccgcatcacgccgacgacgcttgccgacggtcgtgacttcttctacctggacgacgaccccgagttcgtctccggtgccaagtcccgcgagctcaaggacccgcgcccgctggactaccgtttcgccccgcacctggacgccgacggcaacgaagtgccgtacgccgccccgcagatgcgccgcgacccgctgaccggcgactggatcccgatggccaccgcccgtatgaaccgcccgatcaccgccggccccggcgctaccgccaagggcaacccgctggccgcccgcaagcccggtgacccgtaccaggacggcgaagtgccggacaccgactacaacgtcgtcgtgttcgagaaccgcttcccctccatggtgcgcgtgcccggcgtctccgaggacgtgacctacgttgacggcaacccgctgtgggagaagaagctcgccgccggccgctgcgaggtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggccaggaaatcggcgtctccctcgctcacccgcacggccaggtctactgctacccgttcatcgccccgaagatggagaaggaactccagcacaccgaggcctaccacgagaagaccggcggcaacctgcttaaggacatcatgaacgccgagctcgaagccggcgaacgcatcgtgatgcgcaaccacagctgggtcgcctacgtgccggccgccgcccgttggcccctcgaggttcacgtggctccggtgcgcgacgtgctcaccctcgaccagctcaacgacgaagagcgttgggaccttgcctccatgtactcgcacctcctgaagcgcggcaacgccttcttcgacaagggcgacggcaagggcatggacctgccatacatcgccgcctggcaccaggccccggtgcacgacaagcgccgtgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtctcgcaagctaccaagctgttcgtcgacacctacggcgctgcgcccgagggcgtgtgggctgctccgggccgtgtgaacctgatcggtgagcacaccgattacaacgccggcctgtgcctgccgatcgctctgccgcaccgcaccttcatcgccctgaagccgcgcgaagacaccaaggttcgcgtcgtctccggcgtggctcccgacaaggtcgccgaagctgatctcgatggcctcaaggcccgtggcgtggacggctggtccgcctacccgaccggtgtggcctgggcgctgcgtgaagccggcttcgacaaggtcaagggctttgatgccgccttcgtctcctgcgtgccgctgggctccggcctgagctcctccgccgccatgacctgctccaccgctctggctctggacgacgtgtacggcctcggctacggcgattccgacgccggccgtgtgaccctcatcaacgccgccatcaagtccgagaacgagatggccggtgcctccaccggcggtcttgaccagaacgcttccatgcgttgcaccgccggccatgcgctgctgcttgactgccgcccggagttgaccccgctggagaacgtctcccagcaggagttcgacctcgacaagtacaacctcgagctgcttgtggtcgatacccaggctccgcaccagctcaacgatggccagtacgctcagcgtcgcgccacctgcgaggaagccgccaagattctcggtgtggccaacctgcgcgttaccgccgacggcatctccaaggccgatgaccagttccaggccctcaaggaaacgcttgacgccctgcctgacgagaccatgaagaagcgcgtgcgccacgtcgtcaccgaaatcgagcgcgtgcgttccttcgtgcgtgccttcgctcagggcgacatcaaggctgcgggccgtctgttcaacgcttcccacgattcgctggccgccgactacgaggtcaccgtccccgagctggacatcgccgtggacgtggcccgcaagaacggcgcctacggtgcgcgtatgaccggcggcggcttcggtggctccatcatcgcgttggtggacaagggtcgttctcaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcagggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggccgtgggcgactccgtgggtgaagtgctggagaagatcggcctcgagcaggtcggcgctcccggcaccacagcggcgctcgccatgctcaacgaccaggtcaagaagggcggcatcatggcgtcctcctacgtgggcggcctgtccggcgcgttcatcccggtctccgaagacaagaacatgattgacgcggcttcttccggttgcctgaccatcgagaagctcgaagccatgacctgcgtatgctcggtgggcctcgacatgattgccattccgggagacaccaccgcagccaccatttccggcatcatcgccgacgaggccgccatcggcatggtcaaccagaagaccaccgccgtgcgcgtgattccggtggaaggcaaaggcgtaggggagatggccaacttcggcggcctgatgggctatgcgccgatcattccggtgaaccagaccagctgcgaggccttcgtgacccgtggcggccgaatccctgcgccgattcacagcttcaagaattgattcggtagggtatctgctttcagagaggtacatttggcccctcgcggagagctatctgctttcaaagaggtacctatatgcggaaaccccgggtatgagcgttggaatatcaacactcatacccggggtttctcgattgcggtacctctttgaaggcagatagcattctgcaaacgctcgaatgtacctctttgaagacagataccagctcgaattacctttctggaggtctattcccgtttcgaggggctgattccgacctttctggaggtctacttccgtttcgaggggctggtatatatgaagaccccgagtacaagcattgatatttcaacggccatactcggggtctcgtcctttgacagccccttgaagcggcagtagacctccggcggatgccaaatccgcccctcgaaacgcaggtagccttatattcagcgttcatcactgcgcgaagctcagtgtttccgctctcgcgcctgtcggcgttcgttcggcgtcgctactcgaaggcccaccgggccttctcctcacgctccgcccgcaaaattgagctggcgccaggcttcgtagatggcgatggatgcgcagttggtgaggttcagggaacgcagggacgggcgcatgggcagccgcacttgttcggccacatgagggccctccatgatgtccatcgggtcggggatgtcgccgggctcggggccgaacagcaggatgtcagtcggcttgtattccacctcggtgtagagcttggtggcgtgcgcggtgaacgcgatgatgcgcgaattgggcatcgactccaccagattgtcgaaattcgggtgcaacaccacgtgggccatgtcatggtagtcgaggcccgcacggcgcagcttggtgtcgcgcaggttgaagcccagcggctccaccagatgcagaatcgtgccggtcactgcgcacaggcggatggccgaaccggtgttgccgggaatacgcggcgagtaatagcacaggtgcggcgtcacggtttcggtggcggcggccttctcggcggaaagcatcgcgtccaccacggagatggggttgccgtgtgcgtcggtcaccagctcgtccggcccgtaattcgacttgcgatagccgtattcgaacattttctcgactttggtttcgggattggctggattcggtgtgctctgggggttgtgttttgcctcgttcgtcatagctgctaagaataagaacgatgaacgacacagcaatttctttgcgattgggagcatggtgggaggccaatgcgcgtgacttgccatggcgcttcggacgggccacgccgtggggcgtgctggtatccgaagtcatgagccagcagacgcagatgagccgtgtggtgccgtactggaccgactggatggaacgttggcccgacgcccgctcactcgccgaggcccccaagaccgaggtgatcaccgcatggggtcggctcggctatccacgccgtgcattgcgcttgcaggaatgtgcccgcgtggtggccgagcagtacgccgacaaactgccgcgtacgtatgacgaactcactgcattgcccggcatcggcgattacaccgcctccgcggtgctgagctttgcgttcggcgaacgaatcgccgtgatcgataccaacatccgccgcgtgctgagccgtgtgttccttggcgtcgaatcgcgcgggggagcggccagcccggccgaacgcgcgctggcgaaccgcatgctgcccaaagacgagattctcggacgcgatgctgacgtcgccgataatgccggtagcgccgaacatgccgtgaacagcactatccgtggcggcaaacgctcccgactgcatcgtggcgaacgcccatcggtcacatggaaccagtcggtaatggaactgggggcggtgatctgcacggccaaatcgccgttatgcgacacctgcccgattgccgacgattgcgcgttcctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgtgggaacgtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttccccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgtaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacaatcaagtacctggtggccctgcacgacggtgcggcgaccttcccgggcaagcgcaacggcgaagacgttgacctgcgcgtggacgtcgacgatatcgatcacttcggcaaccgtcgtatccgccaggtcggcgagctgattcagaaccagctgcgtaccggtctgagccgtatggagcgcgtggtgcgcgagcgtatgaccactcaggacgccgaggccatcaccccgcagtccctgatcaacatccgtccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgctggtgggcaccggctccgaatggcgcgccgccaacgactccggcgacgtcatcaagtccgagaaggacggtgtggttacctacgtgtccgccgacctgatccgcgtgatgaacgacgacggcaccaccagctcctacaagctggccaagttccagcgctccaaccagaccacctgctacaaccagcgcccgatcgtccacgacggcgagcgtgtggaagccggctcggttatggctgacggccccgccatccagaacggcgacctggccctgggcaagaacctgctcatcgccttcatgccgtggaacggctacaactacgaggatgctgtgatcatctcccagcgcctcgtgcaggacgacaccctctcctccatccacatcgaggagtacgagattgacgcccgcgaaaccaagctgggtgccgaagagatcacccgcgacctgccgaacgtcggcgaggacgccgtggccaacctcgacgagcgcggcatcatccgcatcggcgccgaggtcgaggccggcgacatcctggtcggtaaggtcaccccgaagggtgagaccgagctgaccccggaggagcgcctgctgcgcgccatcttcggcgagaagtcccgcgaggtgcgtgacacctccctgcgcgtgccccacggcgagaccggtaccgtcatcggcgtcaaggaaatcacccgtgaggatgccgaggaggacggcgacgagctgcccaacggcgtcaaccagatgatccgcgtctacatcgcccagcaccgcaagatcacggtgggcgacaagctctccggccgccacggcaacaagggctgcatctcccgcatcctgccggaagaggacatgccgttcctggctgacggtactccggtcgacatcatgctgaacccgctgggtgtgccttcccgaatgaaccttggccaggtgctcgaactgcaccttggctggattgctcactccggttgggacatctctttggatccgaatctggaagccgagtggaagaaactgattccgtccggtgccgagaaggccgagccgaacaccccggttgccaccccggtgttcgacggtgtcaagcctgaggtcctgaagggcctgctgtccaccacgctgccgaaccgcgacggcgaccgtctggtcggccccgacggcaaggccaccctgttcgatggccgtaccggtgaaccgtacaccaagccgatttccgttggctacatgtacatgctgaagctgcaccacctggtcgacgacaagattcacgctcgttccaccggcccgtactccatgatcacccagcagccgctcggtggtaaggcccagttcggtggccagcgcttcggcgagatggaggtgtgggcccttgaggcctacggcgccgcctacacgctgcacgagatgatgaccaccaagtccgatgacgtcgacggccgtgtgcgtgtctatggtgccatcgtcaagggcgataacctgccgccggcaggcatccccgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacatcggcgcccgccccgacgcggccgccaaggaagaccagaaggccgaagagcccgaataccagtgatccctcgggctgcatgcggtcaatacgccgcgtgtagctccgccaacgtgaaataaataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggacctggagcgcgtgatttacttcgcctcctacatggtcaccgaggtgaacgaagacgagcgtcacaacgatctgcccggcctgcaggacgagttcgattccgagatcaagcgccttgagcagcgccgtgactccgacatcgaagcccgcgccaagaaggtcgaagaggatctcgccgcccttgaggaggccggcgaggccaagggcccggcccgcaccaagttgcgtaacggtgccgagcgtgatatggctgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgaacagcgtaagaccaaggccctgaagcgcctcaaggtcgtcaacgccttcctgaccaccggcaacaagccggaggccatggtgctcgacgtgatcccggtcatcccgccggacctgcgcccgatggtccagctcgacggtggccgcttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacaccgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcctgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacagaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgatcgtcaccgaactcggcgatccaacgcttcaagccgggataacagcgcggattcacggcgacattggcaccgaattccggattctcgtaggcgatttttgccagcagaatcggatccgcgttcggatcttgtacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgtgtgatgatgttgcgtggaatggtcgcctccgcctcttccggcaacatctgcccggaatcgatggcttcctgacgttgcgaatggtctcgcgtgatgcggatcagcgaagcggcgtcccacacgggaatgatatccgtggcgggagcatcggcatgcgccaacggactgagatggtaggtgcgggaatcgccaacattgaccacataggtctggtccgagaagtcctgatcatcggcgtcactgaacaaagcagcgctgcgggcgctggtggaatccgcatgatcttggggcagtaccaaaccggagcaggtcgtgccggccacgccgccaaggcggtctcccagatcaagaatgtcgtgctgggcccgtgccaaggtgtcgtcgatatcctgacgggtgcgtgaaggcatggcggccaattgtgcgaaatgctgggcagccaactggcttgcctgctcgccgcccatgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgtaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggctttcggactgccatgccgccgcgctcgtaccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcatcttggtctccttgggcgtcggatagaacgccacccatcccaggccctgcaatttgatttccacccaagcggtgacatcgttgccggtgaattcgattttggtgccattgcccgaggtcttctccgtgcgggcatcggtgatttcgccatcctcgtttttcggcaggaagcccaggaccacacgggagggcagtcccagatcacgagccatcagtgccatggcggaggcatattgctcggagtcgcccaccatggccgtgcctgccagcagcttgttgatgcggtagttgccatggccggcatcggagggatggtcgccttcaagtccatgagagaaccatccggagtctttcaatgtgtcagccaacgccgtggctgcggcaccgcccgaggactgcccgccggcaatggacgtggccagtttgctggccgaatcgggaacatcctgggcttctggttgggtgatgcgggccgcagccgcactgctgatctgcttatcggtgggcttgcgggcgataatgccggattcggtataggtgaggcctttacgcgtgccggcgggaataatggcggaatcggtatccgtgttgtagtaaaacgtgtcattgccgttgtcggcatcgttggcgaagctcacgccagtggccgctcccgccagcggcagccaggtgtcggtcagtccctgatcgacggtgaaggtcgcagtgaaggatttaccctgctcatccgccttgatcgtggtgcccacgcgatgataattcgaggagtccgtggcttcggaagaatcggacaggttccatactgtgccatcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgcccccattccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaaccacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcgccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgattcggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcaggctctatggcactggcgttgtcgaggaactccatggcgttgcgcggctggccgtgcgcgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaggcaggaacgcaataagacatgcgatgcctgcgcccgttaccgcccagcccaagggcgagacgtaggatgcgaagaaccgtctgatgcgtcttaccgcgcgcttgaacatgcgttcagcgcgccggcgacggcgtaatgcggcggatgtagatgccatggtcggatacctttccaggccctatcaggaaccgatggtgggggagggaacgtcttcgagcacctgtgcgatcaggctttccggagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagcgccaaagcgccacgcatggaggagccgactgtgatcttctcgttgtggcgggtcgcctcgacgagcctgacgatgtattcacgaatcgcatcatccacatagatttcggtggccacctgacgcagccgcatgacatcgtcaccgctcagcaccggggaaatggtctgcgcacggtcggtgatatcgacctgcttgaggatatcgacggacacatcatggcccgggtagccaatcgacgtcttgataaggaagcggtccatctgcgcctcaggcagcttataggtaccgagctgctcgatggggttctgggttgcgatcacgatgaacggctgcggtacatcatgggtgacgccgtcaacggtgactttctgctcttccataacctccagaagtgcggactgcgtcttcggcgatgcacggttgatttcatcggccagcacgatggaggcgaaaatcgggccctcgcggaactcgaattctccgcgcttctgatcgtagaaagtcacacccaccacatccgaaggcagcagatcaggcgtgaactgaatacgcttgaaaccggtggaaatggagttggccaagcctcgggccaactgggtcttaccggtgccggggttgtcttcaagcagaatatggccaccgaccatcagtgcggtgacgcattgcttgatgggaatggtcttgccgataaccaccttggagacattctcgaccagcgcattgaaggactgctggaaatcccggacctgagccgtgggctggggcagtagtccggaattgatgctggcgggcagtgccgatgcggctgcttgcgcggctttgctcgactgacgctgcggctgggattgcggctgggattgcgcggcggcctgctgattggctaccggcccgcgaccagccacggtttcggcgttggatgctgcggtcttgccggcggttgtggtcgtccattgacgggaggtctgggtggcgggggcagcattcgcagtagcggcctgcttgccggatttacgtccgaagtgcggaagcgcgactttgggcgtgctggtctttgccggcatgccgacctgctgcgggatggctggcgtcgcgtccttgcgcggcttgagcacggtgctgtcatcgcccgcaggaatggaggcggcatcagtagtaggagacggcttttctgacgacgcttgtgacggccgctgcggcaggttaggcaacgcaacgggttgctgtgccgtctcggtgttcggggtggtgccagtgtgcggttccgatgccagatgtgtggcatcggacaagtgcgtggcgtcggatagctgcgtgctgtcagacagctgcgtcgcgtcgtcgatgttctcgctcatggatgttctcctactgcttgtgaatggtggttgacgatattggggtattaccgaaaccaagaatccaagggttcttggccaaagtggtgacatcggtaccggatttgagcgactcggtcccctccgaggaatcagaggggcgtgtgcccgcgacgctgctgccgtccgccgtattgtcgagaccggagtatcccggcccgccggtgactttgacgctccacgtgtagttgccatcggcggccacggccaagtcggtgacgtccaatggctggccggggttccacgtgaacggttggccattgatgatgatttgtacggtggcctgcttgccatagacctcaaccgaaccgccggtgacgttaatgacgtgagcgttgtctgaccagcgcagctcctgcggtttgttgattgcagccttcttctcataggtgtaaggagcgccattgtacgggcctccggtggcggcatcgctggtagcgccgttgaacacctgttgcaccgatgcggtattgcatttggcccaaggactcattcggaagtcgagtgagttccggttagtagctgtaccggaatcgatgccatcggcagtcacgttgtaggactgcgcatgcccctgcttggtccaatgcacggtgcatgtactgccggatccggtggtgtagacgtcagtgggcggctggacattgtactgcgggacaaacctgctcttgcctgtgccggcggaagcatcgcgctgcggcaccacggtggccgttacggtgatttcccgggtgttcaaatcgttctcattgatatcgaacgtagcgccaccgtcactgcaatcgatggtgtccttgacgtctcctcccaaggaaattcgccggcagccggcattgcggttgttgccgagagtgactttcgccgttcctgtggtgtcgtcgttcgacagcgcaatggtcggcgcatccgggtctccccagatgtcctttggctgtgatgaggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcactgaatagttgtcgacggcgctgaaatcaccgctcggcgctttccacgtcactttggcggttttattgccacctgtgaccgtaacatcggtgggagcggacggcaccttgtccggtgtggcttcgacggcggtggacggtttggaccaaccgacgtcatttcgcgcggcgacggtgaaggaataggttttgccgttcttcagacccgtgacctggcatgaggtgacggcaccgcaatccttctctccggtggcggcgccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtgacttcacgatccttggacttgctgccgtcttgcacggtgacgagcacggtgttcgtggaagcacccggatcggatgcgacggcgatggtgacgtttccggaggcatcgcatccggcgatagtgagtttggcggcgtcatccgccttgcagctgatgacggtcagcgaggaatcggggaacggattgtacgcgccggtaagcacgttcacggcatcgctggcaccggccttgatcttcagcgtcttgtcgccgacgcgtgccagcggacgggtggaagacactacgcgcacggtcacaccggcattcacggtgcccgcgccgtatgcgatttgcacgggaatggacgcggtggtgccaggagcggcatccttggtggcggaaacctgcaagctgccggaacgggacaggttagcggtgattcgcccggacgatgagcttccgccggaatacgtgtattgcttctcgtcgtcatacacgccggacggtgcatgggtgagcgccgtcagatcaacggtcttggggttcgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacgtagaaatcggagttggaagccttggtggcgctgacggaatcagcgctttcgatatacggttccttgccggcaccgacgcgaacatagtcattgatgttgatttcaatggtctcacgcgaattgaccttcaattccggtgccttgggacgcaacgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcaccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcattcggatccacgtttaccgtgagggtggccgtatcggacaagccggccttgtctttgaccgtgtaggcgatataggcggtggtggcgctgccgggcgtggtgaaggagatcatgttgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcatccctggcgtatacgccggagtcggacgatccttggaatacgcccacgcggatctgcgcctgtgcgcgctgaccggtccaatcctccacggcataggagaaggtgtcggtgccggacgaatccggatacgattcatagaccaagtagtcggaaccgacttcggatatgcggcccagcgtgggtgccttgttgcccagacccaacagctgatcgtcgtcgccatccgtgtctatgccggtcagtgtgatggggatgcggaccttctgtccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagacccttgaacgtctccttgtcgtattgcaggttgttcttgagcttgaccgtggtgccatccgagtaggccacatggtcaagcacatccacggacacgatgccgccggtgcgcacctgggcattgatattgctggccttgggcactgaattcgaggtggtcagagccggtggctgcaacacgatggtgcccttggcggttccggaggcgttggccacggtgtaggtaagggcgacgggtttcgtgggcacctgacgcgcagtgatatacacgcgcttatggctgacgagaccaaccttgatgccggagtcggccggtgcgctcaccgtggtgacggacagcacgccgcccatcggatcgacgtcattggtgagcggctccacaatggcggtattatccgcgccaagcagggcgacatcgttggcggcaaccggtttggcggcctcgccggtggcgggctgtacctcgacgcgagccaatccggtggccggaatcgagccttgagtaatggtgtagggcacataataggtgccgggattggtggccttgaacgtcaacgacatatccgccgcattggtggtcgtcgaagcgccgttgggcgtatccacctgagtcagctgtgccggctgcaaggaagtgccatgcacgtaagaggacagcttgacgacggtatccgtgttgggaacggtggttttcgctaccgggtcgatgaccgcggccaaggtgttcgcgggcttgaccgagaaatacaccatgccggtgccggtcgccgtgccgtcggagacggtgacctcgacgcccacgcgtcccgacgccagcgcaccggtgttgaacgtaagctggccgtcggctcgggtggacacctgcaccgggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcggccatcggaaatatcgtaagtaaaggtaacggtgcctgcggatgtggcggaggcatcgagttgcagataccggccgtcgtaaatcggcgaaatggtgacgtctttgttgtttggtgcgccaaccttggtgattttcagcacggaacaatcggtctgctcgtcattgcgcagcacgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggcctgtattttgttccactgtattttgatgactttggtggaatcctcagggttccacacattgccgttaaccgtgtcgttgagcactacaaggcgatggttggtgcggaacaccaattcggaagtagtattgacggattcgagggtttgcggcttgacgctggtatccgcgggggagcaggcgcgaatgtagttgctggccttctggctccaagccgagtacacgcagcccttggacgataccggtcgtgccggattcgccttgcccccgttggctatgaaattcgccttggcattggacttcaacgggataagcgcaaggcctctcggtgatgccgcggccacccaatcggactgtacgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttggccttggcgctgctggaattgtcaagacgcagcaccataccgtcggatggacggtatccgtagaccttgccatcgtgggttactgcgatgcgcccgccctcgcccagcttcattttcggatcggaagtggtgggggccacggaatcaaggttttccgacaagccggtccacacattgccggtcttctcgttgatcagggctacggtatccccgccgaccacagtggtggtgttggctttgatgtcggtcttgacaccggtgctgaccgtggatgccttgatggtggaggctttggtcgtttcggtcaggatggtgtcgccattatgctgcgcgatgtcgaatcgtggggcggaggaggagacgccggcgtcggcctccttgttctttacgttgaatcgtgcggccttctggttcttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgaaccctggtttctctggttgctagtgtaatgacaacgctttacggttccaatacctgccgttcctgttgtccatttggtgaattcgccactgccgggcgcatgcctgatgcgatacgcaatgctaaggtggtatgcccggcagtggcgagcggatcactcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgtataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgtttccacatcggccggcacgtcggggcggttgaggcgaggcaatggctggttgacgatcagcgaaatcagttccgattgcgaacgtggatgatattcgtgctggaatggcgagcagccgacgaacatggcgtacagggtggccgccagtgaatagatgtcggcggcttccgaaccattggtcagatgctgaagcacctcaggcggtgcccacggcggcgagaatccggtttcggtgcggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggcttcgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctacgcgtctactttgcccaggatgactgggcgagactcatacgcgatgccggtgccggcgagatgcccggctctgccgcttccgcacaatcaagcctcccgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggagctcgtgtggtgcatgaggcattcgccgccgatcacgcggatgattccgaccggcctatgcgtatggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgtggatcgtatccggaatatctgatgcgccgtgccgtggaagggtggctgaaagccaaggaagaacagctggttggcggcagtaccggcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcagtcggacggcacggtgaccgccggcctgtaccgatcctcacgtgaggagctggatgatgtggtctggcgcatcaagcggacgcatcttgaccggcatattcggtggaacgacatggcggtcatcacccacgacaatgccgccgtgcggctgttcggcgaacgactgcgccgagatggcgtgccggtgcggtattcgtcggtcacccgtccgttgaaggacgagactttcgtgcagggattgttcgcgcttgtggagcttgcccgattgcgtgccgagggaatggcggaatgccagatgacgttggcttcctgcgcggcatatataaggactagagtggccacgttgatgaacggcccgttggtgagtgccgggggcagacccggtcaagggcgtcccgcaaggcttgcgccgatcgaatcggccatggggtcgttggagtcgctggcgcatctcgccacggatgatgccatgctgacctctctgacgacggcatgggaggcattgcgtgaaacataccatgaaacacggcgtgaaacaggtcgtgaaacatcctcgtcagtggtttcgtcgccagtgtctgtcgaaatactcggtgaaccgtccgacgatgacttggcctttggcgttgacgcgctgtacgtgatgcttgccgttgatgatgccgccgcgccggcgcaggctgcgctcgcatccatccatgcggtgcttggcaacgaccctcaggcccgcgcttttgcgaacctgtggcatctggtgggcagcgttgcttccggcttggagcggctgccggcaagccagcgcgtacagccgcgttatgcactgtctgttgcctggaacgccaccggtctggcaccggtctggcagcgtgcggcattattcaacacggcagaggggcgcacggccaatgaccggctggacgcggcaatgcgcctgttccagttcgccgatgattccaccgccagccgagacatcacgtcattcatggcacaggttcggggcatggaagtgcaggccgattccttggcccacatagggccggtggaagacgctgtgacattgaccacgccggcaggcgcggccggacgccactggggatatgcgtggataccggtggtccagcaagacgtgtggccgaacctcgccgggcgcaacaccatgttcggtggtgaagaccttgccgagctcgtgctgaggggagcgcttgaagaaagtgacaaaaccgggcatgatccgcagttcgcggctgtgctgtcgggcgagaagaagggtttcctggtcgcgctgacccgtgcacggcgaatcatgatcagcgcggtatggaacgacagcatgagcccctcggactttcttttcgggtatctgccggaatactatccgcgcaaccggcaacaggcgcctttcaccacagtgggggcgcatacaggatccgccgaatatgatctggccggattggacgccgacccacgtgggttggtcagcgccgcccgcgcggttctggccactgctcaaccgcagcaggctgccgcaaaggacgccgcggttgcgttgacactcctgtcggagcatggtgtgcgcgccgcaaatccgcagagctgggcgttcgtggaatcgccggcccaatcggatagcgcgtcatctggcggtgcgtcatctggcggtgcctcatctgacagtgcctcatccgacagtgcctcatccgacagtgcctcatccgacagtgcctcatccgacagcgcgtcatctggcggtgtacagtctgacggtatccaaacggggaaaggcaagacggatgcgcaggccgcacccatggtcaccctgtctccatcggcggtcgacagcctatgggcatgtccggtgtgctggatgctggagaaccggttcgccggtcctcgccccagctccgtggccaccagcttcggaaccctcatccatgcggttgcgcagcaaggcagcgaggaagggctggaccatctttcccacaatgcccagacgttggccacactgggcttggactccacggccggcacggaacgccgcatcgaggctgtcacggcacggcttaatgccatctatcagagcaaacgccccgatccgaatgccatagccgacacccggaaccgctatgaggccacccgtaaggacgagtccgcggcagatgccctgcgcaacatcgccgattactttgtgcgcagcgacgccgatccggaaacgtatcttggcaagaactccagcaacttcagcattggcgcattggccggtgccgaatgcgaacgggagtttgccgcacgattcgatgtgcgtgacatactcgacgcatacaatgccgtgcccggcatgcacccgatcgatcggaacatgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatctgcagctcgtgtgctatcagcttggcctcgtgttccccgaagacgggccgcgcggtgccaaggcacttgccgcaatgccgcatatcagccaaagcgcgctgttccatgtcgggcagaatgcggcaccagccagaagctacgccccggaaggtgccttccagccgccgctgttcactgatggttcgttgaatgccgaaccgttcacgccacgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcaggtcggccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaattggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagatgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgtctgccggatacaagccattcccgctgtccgtcaccaggcgaaacagccgtatagtgctcgaagccgccaataatctcacgctgccgttgcgctccaatccgtcgcgtccttccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgttggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacacggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacccgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccctgacgctccggtggatgtggaactgatgaccgtacaccagtccaaagggttggaatgggatgccgttgcggtagtggggcttaccgccgtcggattccccagcaatcagggcgaccatctcaagatcgtgctggacgagcaccatacgggaggcaccgagcaaggtcactggaccgcacccgaatatcatgagaccgccgactcctggctcaccaaccccaccgccgtacccgtgcctatgcgtgccgatgccggcattctgccgcgattcccccatgatgccgatgtggaagccgaccccatcgcatcgttggcggctttggatgatgtggagcttattgatgatgaagtgttcggctccatgcgcgaattcggcgatggcgtggaagaagtggatgcatccggctggtatttgacgcaggcggaggaatatgggcgccggctgcatgccgacgaacgtcgattgatgtatgtggcgcttacccgtgcgcgagaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaagccgccaatgccgggaagcccatgctgatctcggcgcaaggcgaagcgattgccactcccgaagggttctttatcggagagcatgccgcggcatacggtgacgccgtggtgggggaggcatggcagacgccgattacgcagacggatgccgctgtcggattgccgtggccggctaccctcagcgacgcagtgcatgaacagctgtcacgtggcatcgatgttatcgccgcagattcctcgtcacttgagcagcaccaagacgccggtccactgctgcaacgggcgcaattgctggtggacgacgccgatttgatggccgatgccgccagcggccagtcgcttgatgaggcagtcaaagccaaggcgcaacgcattctggccgtcggacgtcagaacgtgacaagcctgcaagcccgcgtaggtggcatgagcgaacgggaggagcgcctctactggcgtagcattatccgtccgattccacgaatatcgtctccggcggccgaagccggcacgcagttccatgcgtgggctgagcaattcatcaatgccggtaagccggatgaagcggtactggcatatgaagccgaatcaagtatgccgcatacaggtcaggatgcgggattcgtttcccgggaagccatgttggccgatttggccgaacgggagcggcaatgccgcaagccatccacacggcagcccgctgtcccacagcccacggctcaacaatccgcatccgccgtatccgccgcctccgccacttccataagtagcgacaatgccaccgagtccaagctggtggcgtggcagcgcagactggccgaatcatcgtgggccaagcgcatcccggcgtggacggagcgtgccattgtcgtggacgtgccgggcgtgggcctagtcaatggcaaactcgatgcggtattcatcggtggacttgacccgtccagcaccaccgcacgctttaccgtggtcgactggaaaaccggtcgtcggcccaccaagccagacgacatcacccgcaaacttgcccagctcgacatgtaccgactgctgctggcagcggtcgaaggtgtggaattggacagtatcgacgccactctctactatgtcagtgagcccgacgagggcttgcgcgagcttcacgcccgtgcgaaaaccaaacaggaaatccttaccgagttgagctccggcattcccgaacaatctgacaacgactgagcccaaaggctcatgacctgtacagcatcggacggccttcaccggtggagagaccttatgcatcgcaaggcatctccgacgatgaggacgactggccacgtaccggtccgcggttgaaacgcaccgcgtgacgttgctggggaaccgctaccctcggatggcacgtgtgggcgggcgcacgtgccggacaacgcaccagtaaggagttattgtgtccacgactcgcgcggtttcgaagtcgtctgctgcccactcgccctatcagcgcctgttcatgctgcccggagccaaggcgttctgcctgtccggtgcggtggcacgattgccgatttccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggtttgcgctcgccgtgcagatcgtggccatgctcgccttcgccttcgcggcgttggtgcgcgtgccgattccgctgttgttcgccctggccatcatcatgggtctgacgcagttctcattcggcgcattggtccgaacccgttggtcctatgcgttgcgcggtgtggaagatggcgaacagctgctcaacacggcctacgccatggaagccgccattgacgagatcgtctttattctggggccgattctggcggcttggctggccacctccgtgcatccggtatcccaactgttcgtgcccaccgtggcatgcggcatcggcggcaccatattcttctcgctgaaatccacccagccgccggtcatcgtggaacaggtcagcgtggccgcgcacgatgacggcagccccgctgcaagcgaagatgccgaccagctgaccctacgccagctcaaacgcagcggtgccaagcccaaaagcgtattgctctataccggcgtactgccgttgctcgccgtgttcatcgtgttcaatatgagcttcacgtccttcgacgtgtccatcaccgccaccatgaaatccatgggacttgagcccttcctcggtctgcaattggcgatgttcgcggtcggctcgtgcatcggcgcgctggtgttcggctctcgccaactcaaaggctcccattgggcgcatatggtgatgttcctgtcgctgctgaccgtcggctacgtgttcttccggctgtcaatggacaatctcatcctgctgggcgtcttcgaaattctctccggcctgaccgtctcgccgacgttcgccaccggcaacctcatcgtcaaggatctggtgccggcggaatccctgaccgaaggactgagctgggtaaccaccgcaggcacggtcggcacatcgattggctcgtccgtggccggtattgtgcttgacgcctccaaccctcatgtgggcatgatgctgccattcatcttcacgctggcgtccgtgccattggcgttggccggatgggccttggccaagcggcatgggtgaaacgggatcgggctacgaccgatggatggttggcggcttcgccggggtctctccctcagtccgcttcacggacagctcgaacgcaattaatgatggctttcagccaactgaattattgctcactgtcgttcgccctcacctaaaaacgcctccggcgttttcttcacggttcggctcatcagagggagctcgacttcacggttcggctcgtcagagggagcttgattctgtggacggggtattggcgtgagggcttggcggtgataggctgattgccgattggaaaacgtcccgggtacattgccgggcaggtacgggtagacagggaagaagacatgatcaaggtttcggtggtcggagcaaagggccgcatgggctcgcacgtggtcgaagcggtgaacaacgccgaggatacgcagctggcgctcgcattggatgccggcgacgacctgacccagatcaccaccgacaacaccgatgtggtcatcgaattcaccgtgccgcccgtcagcctgaacaacgtgctgaccctgatcggccaaggcgtggacgtggtggtcggcaccaccggctggaccgacgagaaactcgcccagatcaaatccgccatcgccaacggtccgaagcccgaaacccagaaggtcttcatcgcacctaacttcgcgatctccgccgtactggccgactactttgccaccaaggccgcgaaatacttcgaatccgccgaagtcatcgaactgcaccaccccaccaaggtggacgccccctccggcaccgccatccacaccgcccacggcatcgccgaagcgcgcaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaatgccggcgagcagctgaccattcgggccgacagcttcgaccgcaccagcttcatgcccggcgtcctgcttgccgtgcgcaagctcgccggcgacgctccggccggcctgaccatcggcctcgaccacttcctcgacctgtaatcgacccgcagtcgaccagtagttgcccccgcatttcaggcagggaagcgcgccgggacgcgcatcacggcattgccaccggctccggccataatgccacgcattcagcaacaatcaaggtacgtagtataagagtccacaatgggaagtacggtaaacactatgagcgagcatgacatgcaccttcttgattcagcacctttcggccgcattctgccggctatggtcaccccgatgaaatccgacggcagcgtcgatttcgccgccgcgcagaagctcgccaaatacctcgtcgccgatggcgcggatggtctggtggtcaatggcaccaccggcgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggtgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcggaacctacgaccgactggccgaacttgaacacgtcaaggctgtcaaggacgccaccggcgatcttgcagccgcagtggagaagcagcagcgcaccggcctcgcctggtattccggcgatgacggcctgttcctgccgttcctctccatcggtgccgtcggcatcatttcggtgattgcccacgtcgcctccaaccccatgcagcagcttgtccaggcattcgatcgcggcgatatcaccaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacgccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggtgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgcccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaagatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggttcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgaaaaccgccatctggtggccaacggcctgatcgccgtcaagaccggcgtggacccgcagaacgtggtcttggccgaagacggcgatgtggtcgacctgtaccacggcagggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggttcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaagacaaccgcatcgaactgaccgacctcaaggagaagaacgaggtcaccgtcgaagccaggtgccgttactccaacaccggcgagggcctgcaccgctcggtcgacccgtccgatggcaacatctacctgtactcccagttcgaggtgccggacgctcgccgcgtctacgccgtgttcgaccagcctgacctgaaggccaccttcgacttcaaggtgctcgctcccgccagctggatcgtcacctccaacatgccggttgccaccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggccgtaccgtgccaatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgcgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgccgaagccaccgaatggcatgacgcttgggccactttctgctccggcgagaagagctgggcgctgcgccaggatcagctgcccaccacgcacccgatcgtcgcgccgatcaacgacctcaacgacacttacgtcaactttgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggaaaagacctccggccgcgatctcaaggcctggagcgccaagtggctggaggaatccggcatcaacacgatcgccactggcctgaccgtaaacgcggacggcaccatcgccgaactgaagctcacccagagcgcgccggccgaacacccggtgctgcgcccgcatcgcctggccgtcggcttctacaacgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgccaagtacttcgagactgtagactgggtctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccttctggctcccctcgggcgcgaggggagctgtcgcctcaggcgactgaggggagtcgcttccgcgagaagctacgtccacattccaacataaaacccgcaaccaatcctcaacagcgtattctcgctcaaggccggcaatgtgccggtcgatgagcgacaaggatacggggaatgattgcgggcttttccataacttcattactgctgattctgttggccggaatcggcgcaggattcgtgggctatgcggtaggcgcatcgtcactggtctcatacccggccttgctcgcgttcggcattccgcctgtattggcaaacgcttctaacaccgtcggcgtggtcggcacgggcatcggtggcgtgatgggtgcgcgcaaagaactcaaaggccaagcggtacgctccattacgtatgtggtcatcggcgcattcggcggggtggccggtgcgtttctgttgctcaaactcgacccgagtgtctttgaatttgccgcaccagtgctgattttgctgagctcgctgatcatcgccatcaatccgcgcggccgcatgcaggccaagcaagccgccgcggatgccaccgcgcaactcaagcacatcgaagccactgaagccactgaagccactgaagccactgaagccactgaagccactgaagccgctgaagccactgaagccgccaagcgcgcaaccacccctaccgcacctcaccgcccgccggaacaactcgtgcagcccatgagtcaggattcctggtgggtatggctgggcgtagcggcggtcgccatctactccggctacttcggcgcgggcgccggtaccttggctctcgccgtgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggatgcttcatcggcgggtacatcgccccgtccatcacccgcaagattcccgcaaacatcatgcgcgccgccgccgtaatcgccggcatcattcttaccatcgatctggggctcaaaacctattgattcgtgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgctgccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggtcctagagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgactgcacgactggcgctcgacctgggcgacgccgccgtgcgtgtgctcggcgacgccggcacccaagacgatcagcctgaggggcgccgccgcgcgctcgtgggtcgtgacacccgtgtgtccggcgattttctggcttccgccctgtccgcgggcatggccgccggcggcttcgacgtgatcgacgcaggcatcatcccgaccccgggcatcgcgttcctgaccagcgtgctcaacgttgagatgggtgccgtgatttccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccaccgccaccaacctgtacatcgatcatctggtggccaccatcgctccgctgaacgatgacaaaacccagcccaagccgctcaagggactgaagatcgtggccgactgcgccaacggcgccacctccgtggtggctcccgaagccctgcgccgtgccggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgtctcgccgtggacgaagacggcaacatgatcaacggcgaccagatcatgggcattctggcccgcgccaagcagcgcgaaggcaagctcaaccacgacaccctcgtggtcaccgtgatgagcaacctcggtctgaagctcgccctgaaagatatgggcatcaagaccgtggaaaccgccgtgggcgatcgttacgtgcttgaggaaatgctcaagggcgattactcgctcggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaggccgcctccaccaacaagcgcatccaggatgccgtggcccgtgaggaggaactgctgggagacaccggccgtgtgctgctgcgcccctccggcaccgaaccgctcgtgcgcgtgatggccgaggccgccacccaagcctacgccgacgaagtctgcacccgcctcgccaagatcgtcgccgaagaactcgcgctgtagcacccttccctaaggaaaaaaacaatgtttggaaagaacgccaaagtcgacctcgaactcaaccgtgatgtcgaacaactcatcaaaaccggcggcaaggagaagctcctgcccatcgtgcaggccggcgaaccggtgttgcgccaacggacagtggcctataatggccagctttccaagcgtacgctcgccaaactcatcgatacgatgcacaccaccatgctggaggcacccggcgtggggctcgccgccacccagatcggcttggggctcgcgctcgccgtggtcgaagaccacgtgcgcgacgacgaggatgatccgcgcgaaatcgcggaattccccttccacgtgatcatcaacccgagctacaaacccaccagcgacaaaaccgcctcgttctacgagggctgcctgagcttcgacggataccaagctgtgcgcaagcgttggctcgacatcaccgccgaatgggatgatgaagacggcaaacaccacagcgagccgctgcacggctggcccgcacgcatcttccagcacgaaaccgatcatttgagcggcgagttgtatatcgatcgcgccgaaatccgttcgctgaccaccaacgagaacctcgaggactactggtgcgaagacccggtgcccaccgaggccgctgaagagctcggtttcgcactatgaccgaccgtgcatggttcgacgccgccaagggagacattccccaatgggcggcgtccatgcccaaggacgccgatggcaccaccatcgactgggactgggtgcgttctctggacctggcgcatggcgtcggcacaataccggaatccaccccacagtccatccacgacgcattgaaggccgactacgccacacgcgagcatctggaatcaatcatcgcccaatgcaacagcacattcatgaccgattacgatcgattcatcggctcctatcgtctgcctcgcgcgctcgcctacgccaatcgtcggctcaacgacaacatcaacacgctgttgcatctgggcgaacagcaacacctatgggtggtcagtcgcgaacggcgggggaggactaccgttgccgtgctcaggccgtactccggcagccgcccatcgaacgatgaccaaggcatgctgaatctgagcggtgaaaccggtgacgcatctgccggaaacactgctgccgaaaacagcgatgtcaagttccccacaacagtcgccttggacgatatccaagaccgtacggcggcgattcttgacgcacgcgccgaacgacgtaaggcccagcgcttccagaagcgtgcgggcgatgcggcgatggcccgcgccaatctctccggcgcgacttcgccgggtggtgccgctctgccgggtggtgccgccgcgtctggcaacgctaccggacaccatcccaagcccgactggcgcgacgcctacctgcccggccgcgacgtggacgcggtgatgggcatcgacatcgaaaccaccggcatcgatccggcacgtgactacatcatcgacgtcggcttcgagttcatgaacatggccagtccgcgcccggccggcgaacccgagacatacgcctatgagcagggctattacgccgccggcgacgcctacggccagtcccgcctcgcttttggcgtgccgccggaaaacgcggcgctcggcaacgccctcatcgccaaactcaccggcatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacttgggccttgaggattcgcacatcatgctggtggccatgaaacaccatctggcggcgctgaaagcgcaaaggaaagggccgtgggggtccaccggcagggcgggcgtcggcggcaagtcctgcggtcgtaagcggtgagtacactattggtctcgtgagtaactatcaggacagccgacagcagcgtgagaaccgccgccgcaccatcgtgcgtgtggtgtgcgtggtcatagctgtggccatgctcggctccctgatcatcccggcgatttacgcggggctttgacgttgccttcgcatattcgtgcccgcagttgaacacgtctgatgcgagggattcgtgaggtcgcccggccggctatcggcaaggcaggcccggaaccttctgacagcatggattgcaggcggatgcgcgtgtggcgcggcaatgcccgccaacgccagaggaatgtgcgaaggctgtcaacaaggacgtgacttcccaaagaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgaccaggactctctggacgaggcgcaaagcgaaatcggcgagatccagaaggatctcgaccagatggagatccagaccctgcttgacggcgaatacgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggccggcatcaagtccgccaccttccaggtggacgccccctacgcttacggccgactgtccgtggaaggcggcacccaccgtctggtgcgcatctccccgttcgacaaccagggccgccgccagaccagcttcgccgccgtggaagtggtgccgctggtcgaggccaccgatcacatcgacattccggatacggacatccgcgtggacacctactgctcctccggccccggcggccagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgacatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaaacagcattatggcactgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaagaggccaccaacggcgagattcgcgtggccggcaacgatctgcggcgcatcaccaaccgtcaagtgccgcagtaccgccgttcgctgggcttcgtgttccaggattacaagctgctcaataacaaaaccgtatgggagaacgtggcgttcgcccttgaggtgatcggcacacggcggtccaccatcaaatcgttggtgcccaaggtgctgaataccgtggggctcaccggcaaggaaaagaactatccgcatgagctctccggtggcgagcagcagcgtgtggccatcgcccgcgcctacgtgaaccacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctacgattccgccctgttcttcccggatgccgaagtcgaagccaagtccgacaccgcccatcatgtgctggcggcggcgaccaaggccatcgagggcagtgacgagccgtccgaaggcatcgcccgtctggccaactccgtgcattccggccgcaccggccgctatggcgagacgttcgcgccgctggaagacacgctgacctggggcaagggcattccgttggatgagcaggccgccgccctggaaagcacccaggcgttcgacccgttcaaggacgagtccgccgcgaccgccgcggttgccgatacgtccgtgtcatccgccgccgagccaccggccccgccggagccgcccgcaccgccggaaccgcccgcaccgccggccaacgagcagtccgccgccgagcagcctgctgacgagcagtccgccgacgagcagtccgccgcagaccaaacatccgacgatcaacccgctgagggcgcgaaggagtaagggggatcatcatgcgagcacgattcattctgtccgaaacgtgggccaacctcacccgtaacctgtcgatgctgctgtcgctgacgctggtcaccttcatctcattcctgttcatcggcgcttcggtgcttactcaggcgcagatcaccaaagccaagggcgactggtacgacaaggtcgaggtcgtggtgtggctatgtcccgacggcaccagccagtccgcgaactgtgcttccggcaaatcgccctcagccaatgagatcacggcactgcagaaaaccattcgcgatgaactcaacgacgtggtctccaacatcgactatgtcagcaagcaggatttctacgacaacaccttcaccaagcagtacccgaacggtgaattccaaggccgtacgctgaccgcggacgatatgcaggactccctctggctcaagctcaaggaccccaccaaatatcaggtggtctccgaagtgctctctggcaaggagggtgtggaagacgttaccgatcagcgccagatcttcgacccggtgttcgccgtgctcaaccgagccacggcggttacggctgtgctcgccggcgtgatggtggtggtcgccatcctgctgaccggaaccaccattcgtatgtccgccgcatccagacgaaccgaaaccgaaatcatgaggtacgtgggtgcctcgaactggacgattcgtctgccgttcattctggagggcgccatcgcctcgctgatcggctcggtgctctcgtgcctgatgctttcggctatcgtcaacgtgttcgtcaccggctggctggcgaaatccgttacatggattccttatgtgaatcagctcacggtactggtgatatcgccgttcctggttgtgggcgcgatactgctgtccatcatcgcttcaaccatctcgttgcggcgttatttgagggcgtaacgcgaccggcttacccgcgagaaatgtgatgacatcatgtgcaagcctctcaggttcgcatgttatggtattggcttaagtgagcgaaaggactattcacatatgacgaacgtacgtgtgatcaagcccgcactggcggcactggtggccgccgcagcctgtgtgggaggtctggcgttcagctcggcacagcctgcccaggcagacacctattccgacctgatcaatgcgcagaaccagcacgccgcgtcggtacagcgcgaggccgaactcaagcagcagctggccggtgccagccaggacctggcgaataaggtacttgagctggacgatctgaccaacaacaagattgtcgccgcgcaggccaaggtcacacaggccaacgaggatgccgccaccgctcaggacgaggccgatgccgcatccggacgtctttccgccgcgcagaaagacaaggagacgcttgaggagcagatcaagcagaccggcaaggactacgatgacgcgcacgccgccgtggcccagctggcccgtgacgagatgcacggctcgaatgcttccgacgtgatgagcgtggtgacgggtgccaccagcacacaggacttcgtcaactccatgcagtcccgggacgcgttgtcccgcaacgaggcgaatgcggcttcctccgccgcgacctcactgagcacgtcgaagaaccgtggcgagcgcttggcggccatcgaaaagcagatcgctgtgctcaagacccagtccgatgagaaggccgcttccgcacagaccgccgccgaaaccgcgcaaagcgaacgtgacgctttggacaagctacgccaggagggtgagacgcggcgcaacgaactgtcctccatggtcgacagtctggattcccaatccgccaagcaggcggcccagaccgtactgatcgcctcccaggtcgattcctacaatcgtcagttccagaaggagcagcaggacgccgccaaccgggtggataccggtaaccagggcggcacgccgtccactccggtgacccccgctccggcgcccgctccggctccggcgccggctccggctcccgctcccgcccccgcccccagcgtcggcggccaaggcacgtcgaacggcgactatggcaacgcctatgccgccggccagtgcacgtactgggcgtatgaacgtcgcaggcagatgggcatcggcacgccgtcctatctgggcaatggcggcttctggtggcgcagcgcccccgcgtacggcctgcgcgtggaccacacgccgcaggtcggcgccgcactctccttcctgcccggccaggatggcgccgacggcacctatggccatgttgccgtagtcgaagccgtgtatggcgacggcacattccagatctccgaaatgaactggggtggtccgtggaacatgcactaccgcaccttgaccaatttgggtcagtactggttcgtccactgaccggttggttcggccgatatatgcggttgaagggttcctcttgaagaggaacccttttcgtattcgaggccggtccgtgatatcgtcggatgttgcgttgctacccacgagttgctacccacgagttgctactcacgagttattgcccacgaaaggaggagacatgcccaaggaaaccggtgagaaactcatcgtccagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgtggcgagatgtggctggagggcgcgaacatccccgaatacctgaacggcacatggaacaaccatgcgcccaagcgcaagcgcaagctgctgctgcaccgattgcagatcaccaagctcgcccgcggcatcgaggccaagggatacacgattgtgccgctgagcctgtacttcaaggacggtcgcgtcaaggcggagatcgcactggcccgaggcaagaaggaattcgacaaacgccaggccctgcgcgaagagcaggacaagcgtgaagccctacgcgccatgcgctacgccaacatgcgccactagtcccgccccttggctcccctccggaggggagccaagagtaggatgtccacgttgtgggccatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccgtggcggcctgtggcacgactgacggcaccgacaccgcatccaagagcggcgattcatccaaggactcgtccagcacttcgattcaaggcttcgacaccagcagcatccagaaggacgacgagattgccgcactgctgcccgattccgtggccggcgacggcacgctgaccgtcggcaccgatacttcctatgccccggccgagttcctggccgaggacggcaagaccccggtcggctttgatgtcgacctgtccaaggcgctggccgcagtgttcggactgaaggaaaacaccgtctcctccacgttcgattcgattatcccgtccgtcggctccaagtacgacatcggcatctcctccttcaccgtgaccaaggaacgcatggaggctgtggacttcgtgacctacttcaaggccggttccacgttcgtggtgcagaagggcaacccgaacaaggtcgactcctcgaacctgtgcggcgtgaaggtggctgtgcagaccggtaccactcaggaagaggaagtcaacaaggccaacgagcagtgcaaggcggacggtaaggatgccatcgacatccagtcctccaagctgcagaccgatgtgactaccgccgtggcttccggtaaggctgatatcttctacgccgatacgccggttgccggctacgccatcaagcagaccggtgatacgctcgaggccctcggcgaggacgttggtgtgacccctgaggccgtggccgtcaagaagggcgattccaagaccgccgaggccgtacagaaggccatccagaagctgatggatgatggcacgtacaagaagatcctcgacacgtggggcgtctcttccggcgccgtcgacaaggccgagatcaacccgtccgtcgagtagtttcggttactatgaagactcccgttgccctgcggcgggagtctttttgtatatgtatgcactgtagtgtataaatatgcttaaccgttgatcgttgccgttgaagcggcgtaagagagaagaagaaacgattatgcagtccaccaaactgaagtccattatggccattgcactgagctcggccatgctgttcgccaccgccgcttgcggcacctccgacaaggccgatgccggtacggattccgccaagggctccgatgccgccaccatcaccagctacgatgtcagctccgtggagaaggatgacaccatcgccgcactgctgcctgaatccgtgaccaaggacggcaagctcaccatcggcaccaacccctcctacgccccggccgaattcctcgacgccgacggcaagacccagatcggctacgacatggatctcgcccgcgccatgggcaacatcttcggtctcgagaccgaaatcgtctcctccaacttcgatacgatcattccggccatcggctccaagtacgatctgggcatcgccgccttcaccatcaccaaggagcgcatggaatccgtcgacttcgtctcctacttcaccgcaggcatgggctatgcagtggccacaggcaaccccaagaacgtcgacgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccatcgcccagaccgatggtcagctggaacagctcggcaaggacttcgatgaagtgccgaacgccatcgccatcaagaagggcgattcccagaccgccgaagccgtgcagaaggccatgcaaaagctcatggacgacggcacctacaccaagatcctccagcactggggcgtcgaatccggcgcactggacaaggccgaaatcaacccggccgtcgaatagtcgacaagctgtcgcgaaaattcgaatggggcgcactgtttgtaacacagtcgccccattcgtgcactaaggttcaatgctagttgcaacttgcagttcaggctgcccaacacatccaaggaaccagattatggcgaagaaagaagtcgacggtgaggggctgaacatccccaatcgcatcaaggcgctgccggtcaagcgccccggcccgattgtggccgcagtgatcgtggtactgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattcttgccatcatgcgcaaatccatcaatccggtgctgcgcggcgtcagctggttcttcatctggttcttccgcggcacgcctgtgtacacgcagctcattttctggggtctgttcgccgtgctgattcccaagatcagcctcggcattccgttcacctcggtggagttctggagcatcgactccaacgtggtggtcaccgcattcaacgccgcatggattggtctggccctgaacgaggccgcctacctgtccgaaatcgtgcgtgccggccttgaagccgtggaccccggccagaccgaggcggccaaggcgctgggcatgaaccgcacgctcatcatgcgccgcatcgtgctgccgcaggccatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgcctcgaggcgcacttcggcaagggcttcgatgcccgaccggtgggcaccaagggcaagcagacgccattgccgggtaagaccgacggtgaaccgaaggatgacgtggacaagctcaaccagaccacatttgtcggattgaatgcataaggcgggagcgcgattatgactacgaatgacatcaccagtgttgccccggtcgtgcgcaaggcggctgacggttccgtgattcctgctgtcgaggccgtgcaggtgcacaaggcgtttgggccgctgcatgtgctcaagggcatcgatctaaccgttatgcccggtactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgctctcgcctcggcatggtgttccagcgcttcaacctgttcccgcacatgaccgcgctggaaaacgtgatggaagccccgatccacgtgcagcaccagtccaagaaagccgcctgtgacctggccgtggccgagcttcagcgcgtcggtctgggcgatcgcatggactattacccctcccagctgtcgggtggtcagcagcagcgcgtggccattgcccgtgctctggccatgaagccggagatcatgctcttcgatgagccgacctcagcccttgaccccgaactggtgggcgaggtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcctacagcacgtgctgtaggaaggctgttatattacctcagcactgtcgtgcttcggcgtcgcctacggggagcccactgggctccccgctttacggctccgcctacagcacgtgctgtaggaaggctcgttgttgcagctccaaaagcgtacgctgatgaactcagcgtacgcttttcacgaaggggcatgttccaatcctgcaaaggcggcgggttggattcgctttgcgcaataatcgtccgctaggctggtgagccatgtgtggaatcgttggatacgcgggaaatattgaaacggcatgcggcaagcctttggaggtttgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgcaagccgatgccgctcgccacggtgggcatcggccacacgcgctgggccaccaatggcgagccgagcgacgtgaatgcccacccgcacaccagcatggacggcaaggtggccatcatccataacggcatcatcgaaaacgcctctcagctgcgtctcgacctgcaagccgaaggctaccgattcgcctccgccaccgacactgaggtggccgctaagctgctcggcaagatcgtggacaagattatcgcggacgaaggcaagccagacttgttcaaggctgtgcgccgtatggcccgcatgcttgaaggcgcgttcaccattctggccaccgactgccgccagccggacatcgtggtcggagcccgccatgattcgccactggtcgtgggccttgacgagggggagaacttcctcggttccgacgtcgccgcattcgtggcctacaccaagcgcgccatggaagtcgaccaggatcaggccgtatgcgtgtccgccgacaaggtcatcgtcgccgatttcaacggcaacgtggtcgaaaacccgaagacctacaccgtggattgggatgcttcggccgccgaaaagggcggctgggattcctttatggacaaggagattcacgaagaccctgccgcagtgcagcgcaccctgcttggccgcttcgacacgaatggcgacatcacccttgatgaagtgcgtatcgacgaacacgacttcaagtccatcgacaaaatcatcgtcgtggcctgtggcaccgccagctacgccggccaggtagccaaatacgccatcgaacactgggtgcgtatccccgtggaaatcgaactcgcgcacgaattccgttaccgtgacccgattctgaccccgcgtacgctcgtggtggccatttctcagtccggcgaaaccatggatacgctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgttcgtggcgcagattaccgccgcctacctgctgggcctgtatctggcgcaggtcaagggcgcgatgttccgcgatgagattcatcagatgctcgactccctgaaagacatgccgcgcaagattcagtgggtgctcgacacccagcccaagaccatccaggcggccgccgagcgcatggtgaacgccaactccttcttgttcctcggccgccacgtgggctacccggtggcgcttgagggcgcgttgaagctcaaggaaatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccacgcggcatgtggtatcggcagaccgcgctgatccgattgcgtgagcggctgggggagccggacatcacgccagcgcaccgattggaccgcatgaccgccggcgtattggtgttcgtgcgggattcggcctgccgcggcgcgtatcagatgctgttccagaaccggcaggccgtcaagatctatgaatgcctggcaccctgccggccgatcagcggcccgcgattcggcacgatcatgcaggtcgaaccgccacgcccgttcccattgctgcgccgatcgcacatcaccaaggaacacggcacgatggccgcattcgaggaaccgggtttggccaacgccgaaaccctcatcgagcgcggcgacctctgtttccctcccgctggcgggaggtggcgcgaagcgccggagggtggtccccatccgggaaatcaccccatctgccgctacacactccacccgcgcaccggcaaaacccaccaattgcgcgtccacatgaattcgctcggcctgcccatcgtgggcgacgacttctacccgcgcatccagacacgcccctacgacgatttcagccagccgctgcaattagtggcgcgtgtgctacgattcaccgatccaataacaggcgagaagcgcgaattcgtttcccgtgtgccgcttaagatctgatttcttaggggggatggcgagaccaatccccgcccgtccgaatcactgtccctttcgactggccatccagctcattgcatcgtcgtacaccatcatgatgcgcttgcgatagctatcgatgaattcctgcgcaccaatgctcgcgataacgtcgtgagcgggttgcacggtgctgtcgaatgcctccggcagcctatccaccaaggtgtggaatcgtaaaatcacggattcctcatctaatcccatccgctgtgcgaatcgttccagatgtttgcggcgcaatcgaagaagatctcggcgtccgccgatgttcatcgccaaagtggcatttatgatctgcttgccatgccccaaataagggaacaccgaagcaaggtcatagagcggggcaagccgcacggacgcgccatcgagcaatagcgagtagttcttggcgtggctgtctgttgccccgacgagataactggcgaggatgccgtcggtgaaggctcggatattgctttcggcctgaccgggcagaccgtgcttgcgcaacatttccgcatatgcattggacgttgggccgttgtgttcctcgtatttcagcgatgagggaatgcccagcgcttgggtaaagtcttcttggtgcagggccgtcaccgtaccattggcggacactatacggtcataccgctcgctgatgatggctgggaccccatcaaagatgtgaaaagaggtgtgggccacgggtattcccatcgcctccacaatgcgcatggtgatgtgttcgttgaatgcttggtgtggaagggtcggtatgccgggcttgatgatatgagtcgtccgcgcgattccagtggtggagaaccatgatccattgcggttcctcagtgcgatcttgccctgctgtcccgcgaccgaccaatgctcgtctacgcttgcggactggatgcctgtgggggcggctgcgcgtagtcgattcgcgatctgcgaatcgctgattggaataagcgaatcgtcatctatgggcaagtgcgggtcggcggacagccgtaatgcgccggtggcatcgaatccgatggcttgcaacagatcaaatgcgcttgtcgatcgggcatgatgcaatcgcatggcttcatctcgggcctgaggggattccgggaccagggcctcaaggaaattacgcgggatgtcgcctgaatattcggctgcggtaatgggcatggaaagcgatattggtgtgggtgattgcgaccaacgataggaatcgtgatattggaaaataatgctgccatcgtttgttcttcgaaactggccgatgggtgtttcgccgagaaatgcattgagagtgttttcgctcatggtgtcaccattcatagagttcggcgggctgcggggttttgcggacatccagcgacaagccaagctcagtcagagcgctgagaatggtggagaatccgggattggggactcgggcgtgttcaaattcgatcagccagcgacgtgacacgcccagccgttgggccatgtcggtctgactgatgccctggcgttgcctttcatccttgataagccgcgcgtattcggcgatatccatgacaatcatgtgcaaaatatatcacagtatagtaaagtgtgcaatattctgcacatagttggaaatgtgcagaatattgcacaaccgagtcgattggtcggtgcggaattgcctatggatcactggcaggtgaatcactgacaggtaccagtggatgccagcacatgccgctcgtcagctgatgtcgcgcacggaaccgcgttcgatcagttccggcgggattacggttttgacgccgaccggtatcttctcgccttcgcattgacggcggaccatggagaaggcggtggcgccaatgtcgtcaaagcgcagcttcatggtcgtcaggttcaagcgcggaaccatatctaccagcgaatcatcgacgcccacgatgctgacatcctcgggcacgcgcttgcccgctgactgcaacccgagcattgcgccgtatgccatttggtcgttggcggcgtagatggccgtgcagtcggggtcgtgggccaacgccacgccggcctggtagcctgaatccgcgcaccaatcgccgatgtacatgctcggtacgcgtgctcccatttgttccaacgcttctcgccaaccgcgggcgcggctttcggcggcgcgcgaggtggacggtccggcaatgtggtagacggtcttgtgccccttgctcatcaggtaatcgacgatagcggtcgagcagccatactggtcggcgtcaacggtggggcagtggtcggcggcggattcgcagatgagcacgactggaaattctcgcggaggcttgtatccgacgaaatcggagatgcgttcctccagcactacgatgacaccatccaccggctgacgctgcatgcgatcgatggcggcggaaagcgtgcgttccgcaccgtggcgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatacccaaggcgttccattgcagcttcgacacgctggcgtgtttcgggtttcaccgcatcgctgccattcgccacgcgggacactgtctgtggcgaaacgccggcggctttcgctatgtcttgcatggacacctgtgttggcctcgacatttcaccctcgcttgactcattaatgtcggtgtttcgtttgcagcgcttatcttagggccgcttacggtaacgataacatcgttgtcttcgtgaccattgtagcagagtgactgagaaacccttaattcaacacggtactcaacacgattggacaatgttacaaatggtgttatgatgataacgcaaacattttggtcaaccttcgaaggagaggggttgggaatggcttcagccgatatcgcagctgcgcccgtgcattcgggcaaggctcgtgtgaataagcacaaggccgattggcgtggatggaaattcatgtggccttttgcggtggtgttcgtgttcgtgttcatcgtgccgatcgtgtacgccgtttatatttcgttcttcaagaagcagatgatcggcggcaccaagttcgtcggcttcgagaactacgcgcgcctgttgggtgatggccagttctggagcagtgttggtcgtgtggccctgttcacgtgcgtgcaggtgccgatcatgctgtgcctgtcggctttgatggccctggcgttggattcgatgaagctgcatggcacgaggttcttccgtatctcgacgttcctgccctacgcggtgccggcggtggtgtcgacgttgatctggggtttcgtgtatggcgcgaagtacggcctggtgggttcgttgaacgatttcctgggtacggacatcgacgtgctcgcccccagcgtgttgttggccagtatcgggaacatcgtgacgtgggagttcacgggctacaacatgctcatcttctacagctcgctgtcgaccatcccgcattccctgtacgaggcggccagcatcgacggcgcgtcggagtggcagatcgtgaagagcatcaagcttcccgaattgcgcggcagcctggcgatcacggtgatcttcagcatcatcggctcgttccagctgttcaacgagccgagcattttgcagaacatggttcctggtaatgcgatcacgacgtattacacgccgaacatgtacgcgtacaacctgagcttctccggcaaccagtcgaactacgcggccgcgttggcgatcgtgatggccgtgatcaccatggccatcgcctacatcgtccagttgaacagcctgaaggagcagatgaagtgacgatgaccgctgttcgtgttgaggaatcgatgatgatcgtgaaggagcgtatgtgatgagtgcagcaacgacttcggccgccggtcgcctgaccgacggcgagctcaaggcccgggagaaggccgccaggaaggcggagaaggcccgccagaagaggatcgccgccgacgaggccgccgaacgcaggcgcagcgcgaaggcggggttcgcgaacgtgaacaacccgaggcgttccacgttgttgaccgtcctgtgcgcggtcttcgccgtgtactgcctgttcccgttcgtctaccttttgatcaacgcgacgaagacgcaggccgacttcaccagtacgttcggcctgggcttcggcaagacgttcgccctgttcgacaacatcgcgaccgtgttcacataccaggacggcatcttcgggcgctggctgctcaacacgctcctgtacgtggtggtcggcgccggcggcgcgacactgctggccatcatgggcggctacgctctggccaagttccgcttcccggggcgcaaagcggtgttcgcggtcatcatcggcgcgatcagcgtgccgggcatcgctttggcggttccccagttcctcctgttcgccaaattgggcctgacgaacaccccgtgggccatgatcatcccgtcgctgatcagcccgttcggtttgtacctgatgtggatcttcagcgagcaggccgtgccccaggagctgctggaggcggcgcgcgtggacggcgcgtccgagttccgcacgttctggcagatttccttgcccctgttggctccgggcatcgttacgacggccctgttcacgatcgtggcgacgtggaacaactacttcctgccgttgatcatgctcaaggacgcggactggtacccgctgaccatcggcctgaaccagtggaaggaccaggcctcgaccgcgggcggccaggcgatccagaacctggtgatcacgggctccctgatcacgatcatccccctggtgatcgcgttcctgtgcctgcagaagtactggcagtccggactcgccgcaggcgccgtcaaggagtgatggagtcggctccgccgacgcggtgtcttcaccgcctcgcggcggggtctctccctccgtcccggctccgccgagacaaccttcctcatcagagggaggtaatagtgccaagccccccctctgacgagctgagccgttaggcaaacagccctgtgggctgtttattcccgcggacgcagattatcgataaaattcaataaaggagctgaatcatcatggaacgtaaagagttcaagtggccgcagccgcttgcgggcaacaagccccgcatctggtacggcggcgattacaaccccgaccaatggcctgaggaagtgtgggacgaagatgtagccctcatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgctgtcaacgacgcctggggcaccgccttctgggcgcagcgcatgaacaatttctccgagatcatcccgccgcgcttcatcggcgatggcaacttcatgaatccgggcaaactgcttgactggaagcgcttcagctccgacgccctgctcgacttttacaaggccgagcgcgacgccctgctcgagatcgcccccaagccgcagaccaccaacttcatggtctccgccggcggtaccggcatcgattacgacaagtggggttacgacgtggacttcgtgtccaacgatcactacttcacgcctggcgaagcccacttcgacgagctggcttactcggcctccctgtgcgacggcatcgcccgcaagaatccgtggttcctcatggagcactccagctccgccgtcaattggcgcccaatcaactatcgcgtcgaacccggcgaattggtgcgcgactccctagcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtgcgccattggaccgagccgctcgcgtggttccgcgcgctggcggacaacggtctcaccgccgacgtggtgccggttcgcggctcctgggacgagtacgaagccgtcgtgctgccgagcctgaccatcctgtccgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggcgtgcgcgttgaggaattcgccccgatgggaaacgacttccccggtgccatggaccaccttgacttggacaacggaaccgtggcgcacgatttcgccgacgtgatcacttccgtggccgataccgctcacgtggtcgcctccttcaaggcagataagtggaccggtttcgacggcgctcccgccatcaccgtcaacgacttcggcgacggcaaggccgcatacgttggtgcccgtctcggccgtgagggcttggccaagagcctgcccgcgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggtgaaccgttggtcgcctcgctggcccaggtcaacgagtccgagcgcacggccgccatccagcccaacggcgtactcgtcgtcaagctgtaaaaccgcgcatagcgcctaattactcaacggctctcttgctgctcatcgcagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggttattcccgatctgcggcaggtgtacttctccgaactcgccgaggatattctggccgaggcccggcaacatggctacggcgtcatcgtggaatccaccactaacaatcgtgcccgcgagctggaaagcatcgcatcgatgggcacgcacagcgcggacgggctcatcttaagccctctgatgatgacggttgacgatatcgcggctttggatggcgattacccgctcgtactgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcggcatcccctgtgatgacagtctgcttatcgaaacccaaggctgggggagcgccgacggtttggtcgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgttatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcaccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgccgagcggttgcggcgtgacggcttcgggcgcttcggcggtgttggtgcggtacggatcgtcctcatgcaacagttgcgccttgctgagcgcgagcgtgccgagaccgggcaggccgggcagcccggaaaggtcgatggtgagcgtgtgcggggtgttggcgtcgcggttgacggcaagcagcagaccggtgcgggcctgttcatcccacgtgactaccgcgtcgatggccggcacgtcgccatatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgtggagacttgggccatggctcgtggtgcaaaccctgcgcggcctccgccttccactggtcttcctgctcgttccacttgtccgaataccatacgccccattcgtcgaaggacagggcgatgtctttggtgccgttgttggcttctcgcgcctgatcggccgcgtccgagacggtggcgatgaacttggtcatgtcttcggaagaggccaggaagtcctgcatggaggcggcggtccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcacggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccggttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaatacttggaacaaaacgccaagtcccgtcgtttcccataacaaggaaggaaagaacgatgaagttcggcaagaagacaattgccctgattggtgctgtggccatgctctcctctgtagctgcctgcggttccacctctgccggggatagcggaagcaccggctcctctgataagaagatcgagctgaccgtgtggtcctgggattccacactgcctcgtacggtcaagggattcgaggccaagaacccgaacattaaggtgaaggtgaccaatgccggcaccaacaaggacgagtacaacgcactgtccaacgccatcgaggccggctccggtgctccggacatcgcccagatcgaatactacgcactgcccgaatacgtgattcgcggccacctcgagaacctctccgatctcggcgcctccgatttcaaggacttctacaccccgggcacgtggtcctcggtgagcatcaatgacggcgtctacgccctgccgatggattccggcccgatggcctggttctacaacaaggacgtcttcgacaaggccggcgtcgatccgacccaggtgcgcacgtgggacgacttctacgaggctgccaagaagattcgcgccgtggactcctacatcacctccgattccggtgacgccggcttcttcgactccatgacctggctggccggcgcgaccccgttcgagacctccaaggacggcgagaccgtgaccatcaacctgaccggtgacaagaacgtcaagaccttcaccgacttctggcagaagatgatcgacgaagacctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggtcatcgtgaagtccgacgacaaggccaaggtcgccgccgcctacaagttcatggaatacgcctgccacgacgccgagggcattaagacccgtgttgacggcggtgccttcccggccgacaacgacaccctcaagtccaacgacttcctcaacatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaggattacgccaagcagcagggctaccaggtgaagtaacggcaatcgcagcagacttcctcctgtggtttctgtagcgggaggttgcgataacaggatcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggccggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagccccgtgacgaatcccgtcacggggcttttaccgttttaagccccgcctagtacactcgtcaccatgcgagtgatcggacagcgaatcaaaagaatggcaaccatagcagtgactgccatcctttccgtatccctggcctcgtgcgggcaggccacggacgacaaccgtacggagatcagcgtatggagctgggaaccgagcatgggggaggtcatccgccgtttcgaaaaagccaatccggacatccgcgtgaaatggaccaatatctccggctacggcaatcttaataccgccattcaagacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctatggactgcccatggattcgggcccgatgggcttcttctacaacgaagacgtgttccgccaagccggcgtggacgccaccaagatcaagacttgggatgactattacgaggccgccgaaaagctcaaggagatcggcgcgtatatcgccgccgactcgggcgacggcagtttctatgacgcgatggtctggctcgccggtggtcagccgttccacacgtcggccgacggcaaaaccgtgaccatcgatttggatgaggatgccggcacccaacggttcaccgaattctggcagaaaatgatcgatgaggggcttgttgacaccacctccgccacatggtcggatcggtggaaaagcagagtgggcaccggcaccatcgcctccgtgttctctggggcttggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcttatcgtttcgtggactttgtggcgcatgacgcccaaggcattagcgcgcgtgtggatggcggtgctttcccggccgattatgccaccctgaattccgctgattttttggataaaaccacgattaccaatgaccggggcattgaaatcccgtatttcggcgggcagaagttcaaccgtgtactgtcggaggccgccgaggatgtgtcggtcggataccagtatctgccattcgaagtgtatgcgcgcagtgacttcaaatcgacggtgggccaggcatacgagtggtccggcagtttccacgcctatcagcagcgacaggaagccattgagatgggcatgaaggacgaggaaggcaacccgctcgaaccgttggagaagcccggcaagaaagtcagtctctccgacggcctggcccaatggcagaaagacctccgagaatacggcttcaatcagggctttacgattaagtagggattcggggttgggtcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggtatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacgtcgaagacggcgcaaccacagatgcgagccttgcctcgcgcgcaaagaatccgaaaaaaagcggcccgaagtggtggctgatctcactgattgccgtcatcgtggcagtggcggtcgtcatcggcgtcacgctcgctttcggcggtaagaaagatgacaagtcggcttcgtccagcaaccaatatgccgacaccgtgaccatcggcctcaaactggcccccaccaatctggacatccgcaacaccgccggctccgcgcttgaccagatcctgatcggcaacgtatacgaaggcatcgtggcacgtgactccaagaaccaggtcgctcccgccatcgcctccagctgggagacgtccaaggacggcctgacctacaccttccacctcaataagaacatgaccttcttcaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggacgccaagtatgacctgaagacgcaggccgtcggctccggcccctacaccgttgccaagttcgtggaaaacagctcgatcacgctgaaggccaatgagaagtactggggcaagaacaaggccaagacgcccaccgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgccaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccatcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggttttcgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttggcctgctcatcgccttggccatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgacgtgtttccctcgcaagggttcccgctggatggctggggcgcacccggttcggcgatatcagcgttggtattgccggctgtatcggtcggcatcatcgtgggagcatcgcttatgcgatacacgcgcgcggccttaggggatttagccagttccggctacatcgatatggcatgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgctccaccgcgtgctcgacccgcgtctgaaaaccgctaccgccattacggaggtgaccgcatgagcaatgttcgtcgtgcgacgactggtggtcgacgggctgccttcgtcatcgtcctgcactccatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcgcgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcgtcccgctcgtcatatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggctgaaaatcacgattggcggcaaaccaatcgtctctgatgcggatatgaccattgccgacggtgaacgagttggcttgatcggttcttcaggctccggaaaatctatgattgccaaggcgatgctggggttgctgcccctgaccgctgtgactaatgggtcgattgatatgggcggcacggaaattatcggagcttccgaacgtgcgcttgccgacctgcgcggccggtatgtgggtgcggtgttccagaatccggctgcctcactgaacccggtgatgaccgtggcgcagcagatcgccttgccattgcggttgcactatgatctgaccaaggccgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacacccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcagtggctgaaccgctgagtctgcaacggcgtgacctgaacaacaccgatatcgacgagcgagtggccgcggctctgaccatggcaggccttgaaccggcagacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccgaggccgccggcgacacgcgcttgtcgcgggttgtgctatggtgtgagacatgcagattatctcatgttgttgtcgctaaccgacgcccctgggcgagcggtcagtgacgcataacttgagatagagcattcgaatcgcggcaaatctgtcgcatgaattttcatgaaatcgatggcacgagcgtaaccgtgtaacgcgcgagccgtggttaacatgaaaaactgattcacttttcggattcaccgtacagtgagcgggaatactcgattttcaaaccaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacatcccgcaggcggccggcgtcaaagccaccatcgccgtcaaagtcgaatacttcaaccccggcggttcctccaaggaccgcatcgccgagcgcatcatcgacgccgccgaacagtccggccagctgaagcccggcggcgtgatcgtcgagcccacctcgggcaacaccggcgtcggcctggccctggtcgcccagcagcgcggctaccgcacgattttcaccctgccggacaaggtttccgaatccaagcgcgcggtgctgcgcgcctacggtgccgaagtcatcgtcacaccgaccgacgccggcccggacgacccgcgctcctactaccaggtcgccgaacgactggccaacacgattcccggcggcttccgcccgaaccagtacgacaacccgaacggcccgctgagccactactacaccaccggccccgagatctgggaggctacggaccacaaggtcacgcacttcgtggccggcattggcaccggcggcaccatctccggcaccggcaagtacctcaaggaagcctccaacggcgcggtcaaggtcatcggctccgacccggaaggctccatctactccgcttcctcacgcgacgaagtccaccagtacgacatcgagggcgcgggggaggacttctaccccaaggctttcgaccggaacatcaccgacgacatcgtgcgcgtatccgacgccgaagcctttgaaatgacccgccgtctggccggcgaggaggcgttgctggtcggcggctcgtccggcatggccgtggccagcgccatcaagtacgcgcttgccaatgatttggacgagaaccagattgtggtggtgctcgcccctgattccggccgcagttatctggagaagatcttcaatgacgactggatgcgtgccaacggctacggcgacatcgtggaacgcaccagcaagccctccctcgccgagcagtaccttaacggaactccctctgatgagggagctgcggatggactccataactagctatcaaaagaatcaataccaacatccgcgctaactaaccgcacctgttttaccttcgaatacggaacaatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggtggcacctaccgcctgctctccaaggtgttcgtgccgtggggtgtgggcctcgacgtggtggacatcaccgatctgaaagccgtggaaaccgcattggcctccaagcactaccagtatgtgtgggtcgagaccccgtccaacccgctgctcaacatcaccgacatcgcggccaccgccgaagttgcccacaagtacggcaccaaggtcgcggtcgacaacaccttcgcctcgcccgcccttcagcacccgctggccgatggcgccgatgtggtggtctactccaccaccaagtacatcggcggccactccgacgtggtcggcggtgccgtggtggtcaacgacgaggagacccgtgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggtgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaacctggtgcgtatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaatggtcggggattttccgttatcgattaaacatattgaatcagctggcgttgccgccctgccatccagtggcatccgcaccagccgggcgcaacgcctgaccggaagtcggtgtggtgccatcaacgaccacacgagtgccgatggtggcaaagtcgtacatccacttggcgtcggccacctgcatgttgatgcagccgtgcgagcctgggataccctgctgcacatagatggggtgctcgccccacatgtatgcaggaacaccgtgcagggcctcgccgccgttatagtaggaaatccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatctgccgtatcgaagttatgaggcacctcgacctgcttgacatcatatgggctgtctttcacagccacagtggaatcagtggactggttctgctcgatggcggtagccagacgttcgggggcgtccccggcaccagtcacttcaataccatccacaccgagtgtcttatcggcgccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccacccgccttattcaccgtgggcttgaggaatgaggcaatggtatcggccgggatggtgacgctcttgttcacgccgttgtccacggtcagtttgaggccaagcttggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccggacccttgccatcctgacccgcggtgtaatcgaactgcttggtgctcttgttgtagacaacggtggcaatctgcgctcggtcggcctcatcgaccaggccggcggtgacgaattgttcggcagtctctttgtccctggtggcggtcagagcgatatgcggctgatcgaaaatattgagcttggccacgtcgccggtcttcgcgttcaacagcgcatctacggttttatccgtgtcgacggtgacgccaaggtccttcagcgaggctttgacgctgttgccttcggcggtgaacgtcactgtggtgttattcagctgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccatgacatgttcacccacataggctgtattgtcggcatggttattggtgtcattgtcgctttgctgtggcgtggcggtacctgtggccgcggatgcgaacagcccatcggcggccacaggctgcagcaccgccgtctcctggtcgtcaggagaggagaaggaaaatgtatcgttggccataaaatgccccgtcttagttctctcaaagcggcatatcgtgtgatatgccgggaatagcgttcctcgacgcataataatacggaagggctacgtacatcgttacgaggtattccgttatacgatgaaatccatccgcggtcggcctacactggtcgtttatggcagcacatcaggcggcgctggaggcgctcacacgatacttcggctatgactcgtttaggcccggacagcaaggaattgtcgaggctttgcttgccggacacgatgtcttgggcgtgatgcccaccggcgcaggcaagtccgtgtgctaccagattcccgccgcgctcagcccgggtgtgactctggtcgtatctcccttgatttccctgatgcgcgaccaggtcgatgcgctgaacgacctcggtctgccggccgcgttcatcaacaccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgtcgggacatcgtgggactgctgggattgcggaatccggccgtcaccgtcaccggattcgaccggccgaacctgtattttgatgtggtcaaactggagaccaaatacaaggccgcatgggtggcgcggtatgtggccgaccatccggacgaatccggcatcgtctactgcgccacccgcaagaccaccgaagcgctcgccgacacgctgaaccagatggggcatccggccgttgcctaccatggcggcatgtcgccggacgcgcgtgaggcggcccagcgcgacttcatcaccgacaaggtgccggtggtcgtggccaccaacgctttcggcatgggcatcgataagtccaacgtgcgttacgtcatccaccacaatctgcccgaatccattgaggcctactatcaggaggccggccgcgcgggccgtgacggcgagcccagccgatgcacgctgctgtggaatgagtcagacatcgtcacccggcgtcggttgctggataacgattatgagaacgaacgattgactcccgaagagcaggaaatcgttcgccagtccaagcgccggctgctggacggtatggtcggctactgccgcaccaccgactgcctgcaccggtatatgacccggtatttcggtcaggaattgtcgccgaatgctggttccacggcgggtgaagacattgcggcggactcttcgcagtccggcaaatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaggctcgcgtgcgcgacgtgttgagccagatggccacggacgggtacctgtcaatcgccgaagggcgtatgccaatcgtcatgttcggtgcgcgggcggccgaaaccgccgctcccgacttccactatgagatcaaacgggtggaacgcaagtcggaggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaaaccatcgcctcgttcaatgccgggagtgcgtcataacaatctcctatagcgaaccgcggagtatttgcgggcgttcttgggctggcgcgactacgatgactgttcgatgcttcatgaccgaacactcggcaagtagaaaggcaacagcatggcagaagacaaggccgaaaagcccgtcgtcgaatcattccagcttgatcacaccaaggtcaaggcgccgtacgtgcgttacatcgacaccgaaacgggccctcacggcgacgtgatctccaattacgatctgcgcctgactcagccgaacgagcaggccatccccaccggcggcctgcacaccatcgaacacaccatcgccgtgctgctgcgtgaacgcattcccggctacatcgactgctcgccgttcggctgccgcaccggcttccacctgctgacctggggcacccactccaccgaggatgtggccaaggcgttgaaggaatcgttggagttcatcgcatacaaggccacatgggatgacgtgcccgccaccaccgagaagagctgcggcaactatcgcgaccacagcctgttcaccgccaaggaatgggccaagctgatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcctggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggtcgccaacggcaaccccacccagtggggcaacgaatttccgcgtgaatcggtgattgaggacgacatcgccaaccagcgtacgatgctgctggtcgacacctgcaatggccacgaacgcattctggcccagttcgccctgtgcccgggcaaggatccgacctacgccaaaatcgacggcgcctggctggacaacgacacctatgtgaccatccaccgcatcgccgcatccggtctggtgcgccacgcggcccgcgactgcatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgccggctgatgtgctcgtttctgcaccgtcatcggtttctgacggtagaatcagtgtgtgagaagaacacgttgggtcgggggcgtcgtggcggtgcttgcggctgtcatgctgtcgtcgtgcggcggcgtccagtcgaatcccggggtaacacaccgttgccaatccattcaccgcgcaggtgaatggagaagacatggcgatgcctgtcggccgatggagccccatcggccgacaggcatcgaggaagtcaccgtggccggcggaacgcgcggtcgccgattggggcgaatggcttgtgtggttcgctttggtaccagtaggcgaccgtggccacgtcgtcctgtcgttcgaagttgccggcttcctcggtgccgatctgctgccattcgacgcgcaggtctcgctcgaagtagatcgggtcggggatgtgccaacggtataggccgcgggtcacgggggtggcagtgtcccagtaggcgctttcgcgtccggcgaggttctgcgagtagaacgggaagccgaggtatgggccggtgaaggtgcgctcgtgcatgcggccgtgttcgtcgaattcggcgaagctccaggcgccgccgaagtagtcctcggcgccggtgctgcaccaggtggggtatttgccgtcgccgtcgatgtagaacttgaattcgccttcgccccaccagcggctttcgagcgcggtgagcgccaagtaggtgccgacgtaggtgccgtgtccttcgacgccatcgagcaccacgtagtcgtgggcgagttcggtgacgcgttggcggcgccactgcgcgtggaagcgcatcgtgtcggccggcagccggtcgtattcggtgtagtcgatttggtagaagaacgcgggcacgtcctcgttgtggtcgttgcgcagcacgatgcgcgcgtgttcgaacggcatggcgaagtagcagttgaagccccggttcgggttgaccatgacgggaattgagttgatggtgcaggactgggcgtgtccgcagcagaagaagtcgccgatcgggcattgcaccgagggggagtcctcgccgtcccagtagaattccaggatcaggttgcgtagcacgtcggggccggtgggggaggtgcggtcggttaccgtcatccagatgtgacgaatcacgccggggccctcgacgtccatcaatgtcaccgattccccggacctcaccgtgctgatgcaggggcttcccttgcgggaggggcccaacgcgctggccgccatggccgcgcggcccttgccgccgtccgggttttcggcgttgatgcagcgggtgcggccgggggccctcatggccacggcatccaaggcgccttgtccgagccccggcgcggggttcgctgtggtgaatgcgtcgagcatgatgcttacttcctttcctgtcgcaggcccggcccgccacggcgttttgtctggggcgggctgggctgctggggggtgttatttcacggcaccggcggtgatgccctgggagagcttgcgctggggtagtgtcctatatcttgcgcactttggtcttcgtccgtccctgcggcgatgatcagttcgcttcccgtacggtctcaccgagtcttgacatgtcgaggtagcggcgcgtcgaccactcgttcgacgtgacatagcgcacgcgtgcgcagacgagcatcaacgcgctgcgtccgtcggggaagctgccgaccacgcgcgtgcgccgtctgacctcgcggttgcgggggtgaccctggcgaggacgttgcgttcgaagcggaccatgcaccgctggtagcgggcatcgcgttcaaggtctcctcgacgctttttctgaccatccggtccagggtggtctccgacatggcctcatatcgcaaaaaccgtacgctgaaagtaactcagcgtacggttttcacgaaagcagccatcggctatcggtcagccgatagacctcagtcctcagtcgcagcgaccttggtgtcagccccggccttctgctcaaggccgagcttggagcgcttgcggctgtagccgaagtacacgatcaggcccagaccgaaccagatggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtgcggtacttctcgtgcacgtggccgaagaacttcgggaacaggccgtcacggctcatggcgtagcagatacgggactggccgtacagctgtacgagcatcaccgtggtcatgccgatgagggcgcctaggttcacgatcaccgcgagccagttcatgccggtctccagaatcacgccggccactggggcgtcgatgtacttggcgaactccttgtagggcaccacgccggtcatgatcatggtcatgacgatgtagagcacggtggaaacggccagggacagcaggatgccgcgcggcagcgtcttgttcgggttgatggtctcctcggcggaggaggacacggcgtcgaatccgatgaagctgaagaacacgatggatgcggccggcacaatgccgtacggctgggtggagccgggctggaaggtgtagatgccgtacggggagaacggctgccagttggacggcttgacataccacacggcgcacacgatgaacagcacgatgatggcgagcttgatgagcaccatcacgtcattggtgcgcttggtctggttgatgccgatggacagcacccacgtgatgatcagcacgatgacgaaaccgggcaggttgaagtaggtggtgacgtccgggttggtgccgtaggcggcggtcagttcgaccggcaaatgcaggccgaagccttccagcagcttgttgaagtagcccgaccagccggcggacacggtggccgcctgcagggcgtactccagaatcaggtcccagccgatgacgaaggcgatgagctcgccgaacgccagataggcataggagtaggccgagccggaaaccggcgccatggcggcgaactcggcgtagcacaggccggcaaaaccgcagcagacggcggccagcaggaacgatacggacaaggccgggccggcggtcagcgcgcccttaccggtgagcacgaagataccagtgccgatgatcgcgccgatgccgagcatcgtcagatcgaaggtgcgcatcgtgcgcttcaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcagtttccgagaaaccgcatatcggtcattagtgtacgactgccgggcgaaaacaaacgattgtgaccacacgtcacattcctgcgcaacaataggtgcctatgagcatgaacgcagcacccgaaatcgcattctcgtccgagcagggcaaggccaactatgcggccgcccgccgccaataccccgcacaggccatcgtgaacctcaaaaccatgcgcgacaacatggcccacctgatctccgtggtcggcggcccgaactccggcacggcggtgatgggcgtggtcaaggccgacgcatacggccacggactgctgcccgccgcactggccgcgctcgccggcggcgcgacatggctcggcaccgcgcaatcgcatgaagcactgctgctgcgcaaactcggcatcggccccgaccgttgccgcattctgacttgggtctacaacggcaccgaagtgccattcgatgagctgatcgctgccgatatcgacgtatcggtcggctccctgcccggcatcgatgccgtggccgccgccgcacgcaagctcggcaagcccgcccgcgtacacgtcaaggtcgattccggcttcggtcgcaacggtttcacgccggccggattcgacgccgcgctcgccaaactcgtgccgctcgccaaagagggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaagctcgaccccgccacgctgctataaggtgcattaccgccatacggtggcaccccgtaatcccttcttcccgaatatgtaccactgacatgtgctgagcgtcacatattcgggaaatcggccccaatctcccgaatatgtgccgttgagttgacgtcagtggcacatattcgggaagtcgggattactgcggccgatatgtgtgcctatgcttggaatatggaaacgactttggatggggaacaggtgctgagcgatgagggctacagcgccttcgacgaggagcggtgggcacccgagccgcccaaatccaagtcgcgcacggctttcgaacgcgatcgcgcgcgactgattcattcgtccgctttgcggcgtttgggcgcgaaaagccagattctgattgccggtaccgacgatttcgcccgcacccgactgacgcatacgctggaagtcgcccagatcggtcgccaaatcggcgcattgctcggctgtgatccggacgtggtcgactgcgcctgtctggcccatgaccttggtcacccgccgttcgggcacaacggggagcgtgcgctcgccgacatcgccggcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccaacaccccaagggggagcggtcgaagaagttctgcgtctacccggatgatgagccggtgttccgctggctcaaaatcggcgcgccccaggccgccaagcccatggaatgccagatcatggacctttcggatgatgtcgcctactccgtgcatgatgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcacagctcaagaacattacgtccgatttgatcggtcgcttctgctggtcggtggaaaccgccacgcgcgacacgtatgggcccgggccgttgacccggtattccgcgaacatcgtgattcccgaggacacgaattacgagatcgtggcgttgaagggcatcgccgtgtacttcgtcatggcgcctcgcgagcgcgagccattccatcaggaggagctcaagatcgtatcggatttggtcgatgtgcttatggccgattcgccgctcccatccgacgctttggaaagccagttcctggccgattggaatgaatccaccaatgacaacgagcgcctgcgcgtcgccatcgatcaggtcgcaagcctgaccgacaactccgccctggccctgcactccatcttgtgctgagggcgtgttgggcgggcgcttccctcagtctcgctgcgcgagccagctcccctcgggtgaggggagctgtcgctgtaggcgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgtccctcgctcggcgtgtggcactgcttcggctgcggcttgggtggcgacgtattcaaatacgtcgaacaatccgaaaacatcgacttccgcgaagccgtggaactgctcgccgacaagtaccatatcgagctgcactacgagaacagcggcaacggcccggcgcgcgagaacaccggctccaagcgcacgcgactgctggaagcctgcgaggaagcccagcgcttcttcgtctcccagatcttgaccaaggaagcactgcccgcccgcaagctgcttggcggccgcaacttctcccaagctgattgcgaacgtttcggctgcggctacgcgccgcaaggctgggataatctcgtgcgtcacttggccaacaaaggcttcacacaaaaggaaatcctcgacgccggtctggcccgtcaaggccagcgtggcatctacgattatttccgcggccgcgtgacgtggcccatccgcgattcgaccggccgcacgctcggcttcggcgcgcgcaaactatacgaagacgatcagatcgccgccaaatacatcaacacgccggacacgcagctctaccgcaaaacccaggtgctctacggcatcgatttggccaaatccgccatcgtcaagaagcgacaggtggtgatcgtcgaaggctatacggacgtgatggccatgcacttggccggtatcgacaccgccattgctacgtgtggtaccgcattcggcgccgagcacgccaagatcgtgcgccgcctgatcgccgacgattcgctgggcgcggtccagctggtcgggccgttgaaggtcaaggaccagccgttgagctcgcgcatcgtgttcacgttcgacggtgacgccgccggccagaaagccgcgctgcacgctttcggcctcgattcggccttcctctcccaaaccttcgtggccgtggccgacgacaatctcgacccgtgcgacctgcgcatcgagcgaggcaacgaagcagtgcgttcgctgatcgcccgcgccaaaccgttgtatgacttcgtgatcgacgccgccatcagccggttcgacctgacctacacgcccggccaggtcggtgcgatgaaagccgtggccccgctggtggcgcagattcgcgaccgctccctatgggacgcttacgcgcgcaaatccgcaggccgtatcggcgtggaccttgaggtaatgcgccgcgaggtgatgaacgcgcgccggcagatgcacgtgcgcgatgaggacgcctacgcgcccaaacgtcgattcgagcgtgacgagccgcgtgtggaacccggcaccaacccatacgccaatccggccacgcgcaaggcgttggagcgccgtgacgccgccgaacaggcgtacttcaagatcgacgacgccgtattcatcgccgaacagcagttcatggccgtgctgattcaggtgccgcgcgccatcgaccgcaccatgttcgggcagctgaccatcgaccatttcatgactccggtgttccgcactttgttccaagcgattgcggcagctggcggactgccatccgacgataccccgcaggggctgtggatgcacaacctcaccaaggccggcggaccgatgctcaatcaggtgatcaacgagctggccgtcatgccgttgccactgcctggcgacgacaccggtagcggtgcgcagccggtgcaggccaacgtgtcgggaggaggtgttggcgtgaatggcggtgccgccgcagtacagctgcgtcctgccacgccggaggagcagcgctacgccactgagcttctcacccgattgttggacatgggcttcatgcgccagatcggtttggccaaacgccgcatggcccaactgccggatggcgaggagaaaatcaccctcctcggccaaatcacccgtatggagactgctcgcaaagatctccaagcccaaatctatggcaacaccgttggctagtaatctctccctctgacgagggaggttactggccgcagtcgggcggggcgagagaagcgacgtcagatatatcgcgcagcatcgatgtcacatcaactattcgtttgatattaactttttaatgacaaacgataaattatggtataatgcaagtatgagttgcttggtttgcgcaatgaagcggaggctcaatcatggcaacgacaaagaaactatccttcggtttggataaggccggtggcgcggccttgatcctggcccgcatcggtgccgcgctcctatggatcatcgcagcgctcgcggccgtggtgtgggtggtattcctcatttccccgcgctcgttcgccgcgaacttcggcagtgtcgacctgaatgtcggcggcgcgttcaccctcagcatcaagggcgacttgttggactactcctataatctgcagaacttccacgacggtcccgtcaacatggtagctaccatctccaccggtctggcgagaatggtggtctacgctctactggccttggcgttctccgaaatggccgcactgtgcaaggatttgacggtgtggcttgcagacggcagggatgccacgcctttccaaggcatggtgtccgaccggttgaacagggctggctggtatctgattgtcgcgccgattgtgggtctggtgaacttcatcgtatgtttcctggctggcacgggcggcaactggggcttatggatgagcggcatgatggtgatgattggcattatcctgttgctgattgcgcgcatcttcgattatggcatgggtctgcaacgggaagtcgacggtctgctgtgagggggaagagcgccgtaggcccgcgtggcgccggtccgaacagggccggtccgaacaccgagggcccgaatgaggacagcctgaacatcgttgattcgagcgagaccggcctgaatacggctgactcaaactccaccggtccggccggcataggccatatcgtcctgcgcctcgaccgcatcatggtcgagcgaggccgctcactcaactggctggccgatcaggtgggcatcaccaacgtgaacctttccaaaatcaaaaacaatcgcgtttccgccatccgcttttccgccctcgccgccatctgtgcggcattggattgccagcccggcgacattcttgaatatgtggatggcatttcgggcgatgcggacgatgcgaatagcaagtaatcgcacgcatgccaactcttctcctcctggcctgtgattgattgacaatcagggattacatgccaaatgggagagataaacatgtggaggttggattggatgggtgcagaagttgcgaattggccccatccaaattggactggtttgggtggggccaatccactccgttcaataatgaagcgcgataccaagcagcgtcgaacgaagggaaactcatgacgcagaatcgtgcggaactcaaccgtaatttggcccagatgctcaagggcggcgtgatcatggacgtcaccacgcccgagcaggcgaagatcgctcaggacgctggtgcctgcgcggtgatggcgctcgagcgcatccccgccgacatccgtgccgccggcggcgtttcccgcatgagcgacccggccatgatcaagggcatccaggaagccgtgtccattccggttatggccaaggtgcgtatcggacacatcgccgaggcccgcattctgcaggccatcgaaatcgattacatcgacgaatccgaggtgctttccccggccgacgacgtgtaccacatcgacaagaaccagttcgatgtgccgtttgtgtgcggtgcgaagaacctgggcgaggcgctgcgccgcatcgccgagggtgcagccatgattcgcaccaagggcgagcccggcaccggcgacgtgattcaggccgtgcgccacatgcgcaccatgaacaagcagatccgcgaacttgtcggcctgcgcgacgacgaggtctacgaggccgccaagcagctggccgtgccctacgatctggccaagtacgtgcacgacaacggccgtctgcccgtcgtgaacttcgccgccggtggtgtggccaccccggccgacgccgccctgatgatggaactcggtgccgaaggcgtgttcgtgggctccggtatcttcaagtccggcgatccggccaagcgcgccgccgccatcgtcaaggccaccgccaactggcaggacgccgatctgctcgccaagctgtccgaaaacctaggcgaagccatggtcggtatcaacgaggacgagattcagaccatcatggccgctcgcggagagtgacgggagtcgaagccggagaggacaacatggttgtagctgttgaatacatttccaaagaagaatccgcagacgccgaaaccgccacgcacggcgtgaccggtattctggccgtgcagggcgcgttcgccgaacatgcggcggtgctcgacaaactcggcgccccgtggaagctgttgcgcgcggccgaggatttcgatgaatccatcgaccgggtcatcctgcctggcggtgaatccaccacgcaaggcaaactcctgcgttccaccggcctgttcgagccgatcgccgcccacatcaaggccggcaaaccggtgcttggcacctgcgctggcatgattctgctggccaagaagctcgacaatgatgagaacgtctacttcggcgcgctcgacgctgtagtgcgccgcaatgcttacggtcgtcagctcggcagcttccaagccatcgctgatttcggccaagccgacgacccacagcgcatcgcggactttccgctggtgttcatccgtggaccctacgtggtgtcggtcggccccgaggctacggtcgaaaccgaagtcgatggtcacgtggtgggcctgcgccaaggcaacatcctcgccaccgccttccatcccgaactcacggacgacgtccgcatccacgagctcttcctgtcgctgtagccgattcgtctgccgttagactggtattcgaccgacgaatcaaggagacgatctgccatgcagttcacgctgaaccggcgcagcacggtgccgatgtaccggcagctggctgctgagctgcgtgaacagattgtctccggcgcaatggctgagggctatcgtctgccgcctgaacgcgagttggcctcacgcctcgaggtcaatcgcaccacggtattacaggcctatcagcaactcaaagatgagggactcatcgcctccaaagtaggcaaaggcacgttcgtgctgccgttgcagcatattgagactgcccggattcctgtagtgagacatgagccgattgacgaggagccgaaaccgagcgttgtgcggccgccgtggtcggtgttgttctccgactattccaaccgattcacctaccacgacattgcctcggccgagcgggcgcaacgcggcgataccatcatcgactttgccaccggctcgcctaatccggcggatattcccgacgatttgttgcgttcagtgagcattgaagcgtttgagtcgcgcgaattcgacggtcagccagaatcgcctatcgaaggattcgatgaactccgcgcattacttgccgagcatatgagcacacgcggcgtgcagtgcgatgtacgaaacgtgatggtgctttccggttccgagcaaggcatcgatcttatcgtgcgtgcattcgtcaatcctggcgactgcgtgctggtcgaacaatccacgttcttcccggcattgcagaccttccgctcggcggatgcgcgcatcatcggcgttccagtggacgagcacggtatgcgtacagacctgttggacggctattgcgcgcgattccggcccaagctcatctacaccgtcccgacgttccaaaaccccaccggtaccacgctgccgcccgaacgacgcagcgaactcatcgacgtggcgcggcgctatcagtgtctgatcgtggaagacgatgcttacggcgatttgtggtacggcggggaatcgtccgacgcacatcgccccataccgcttaagggcatggagaatgcgggatacgtgatgtatttgtcgacgttctcgaaaaccgtcacttcgggcctgcgcacgggatgggttgtggccgacccgcatgtgattaaccggctggcggctctgcggcgcatggtcgaccagcatacgagcacgtcatcgcagcgcatctgcctggaactgcttaaagaaggccgcgtcgccgaacatttgcgcggtttgattaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccacatccgtctcaactttgtgcgcccggatgctgctgacattgataccggcattcgaatcattggcgagacgatagcacagatgtagccaagtgactggctcattgcggttgtcgagtttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgcttgtcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccggccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgctggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactatgttccattggtatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggttgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcaggacgctgcctgcggaacagattgataaacataccgcacactccttcatcgttggccggcggtcttctggccgccgtggattccatcctgccctcctgcgcttgtattcgctatgggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggttttcgccgtcggactggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccggattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcgggggagtggtaagaatgttcgtcgacgataatcgcgtcaccggtggcggaatcatgtgccccggaatcggttgcggccaacgctcgcgcatggtcccagctgcgtttcatcgtcggctggaaggggaacagtccggcgctcatcacacacagcatatccgggtatcgttcgtgaatggcctcgctgatcatgtcaaacttggccacgtagtcagccccgaagttttcgttgcccacgccgatcatgtccaggccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtgggcagcggcttggccttgaggtcctcgcacaggcagaaatattcgtagaagccgatctgatagctctgcgaatagctggaaccatccggcatcttgaacgaccacatcgaatactgttggcgtcgcgcggccagggagccgacggtatccttccagcgatactcattgccgggcgtcacaccttcgacgatgcagccgccggggaatcgcagaaacgctggatgcaacgcctgaatggtttccaccagatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatggcgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccgaggctggcggcggaacagttgatgaaatcccagaaacgcagggaatcggcctgtgtacgccatcgttcggcgccggccatacgccacgtgtgatggtcgagatagacgccgtcaaaactgtagttgttcaccatgttggcgttcagcccgccatccgcaccatggttgatgtcctcgaagaacacgccgtacagccgcccgcttgtgtgatgggtggggcttcccacgctaatccgcaccatggttttgattgtagagggaatggagcggaaaggtaaacggaagagttcgctcaccgttcatgttgcggtcaatccaagtcgactgttcgccggtatacagccggtaccctcgaaacaggaatggaaaatacggacgactaggagcgcggctgtgcaatcctcggtgggaatacgtgagcgcatcgaccacgtgtatccgtcgctgcgtccggcggagcgcgccgtggcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccggctatggccggttctccaccgcgctcgacgaatccggtcgcatgattcgcgaccgcgtattcgagaactgagctgctgctttatcgcgccttgggctgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagtaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcgggggcattaccggcatcggcagagacggatgcagccatgttggtcacaaccgggctttcccaatccttgccttcactggcaaaacgaccctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctggataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggagaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtactcaaacgagtcgggctcggccatcgtctcagccattacccgcgccagatgtcgggaggccaacagcagcgcgtcggcatcgcccgggcgtttgtgaccaagcccgaggtggtgttcgccgatgagccgaccggcaaccttgactctaaaaccaaaaccgaggtcatgacgatgatctgtgcattcgcccatgacttcaaccagaccatcgtgctggtcacacacgatccgcagatggcttcatacgccgaccgcatcgtcaccttgctcgatggccgcatcaccagcgatcggctcaacaccgacctttcccgcccaactgttccgtccacgccgtccgccccaaccacaccaactacaccgtccacgccgtccgcccatagaacccaaggaactgaccgatgaagcacctctcccaccacaccatcgccatcatcgtcgcgttgctctccacgctgtcactggcacttgccgtcatctcccttccgcatcaggcgtacgcggtcgacggcacagacggcacaagcggcacgaacagtacgtctcagggaagcgacggcgattccgcgccgatcgccggaccggtgcccaacatcatcatcaccaacttcgcgtatggaggtgattccgtggccgccggatccaaattcaatctcgacttcaccttccagaacaaggggcaggtggcggtgacgaacatggtcgtcaccgtggacggcggcgagagcttcgccatcgcgggaggcacgaacacgttctacgtcgacgcgctgtgggccggttacgccatgacgcaaagcgtgccgatgcaggcgctcgcctccgcgaaaagcggtgcccagtccgtgaccgtgaacttccgatacgagtatgtggacgccagcgcccgctcctcaagccagtctgacgtcaagatttccgtgccgatcagtcagcctgaccggttcgaaatcagtgatcccgtagtgcccgaccaggtgatcgccggccaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgccttcacaccgcacgcgtcaggcgagctgaagaccacgctcaaagtcacgtacgaggattccgacggacagaccaagaccaaggaattcccgctcaccatacccgtaaccgatatgcagccgatggatgattccggcatggccgatccgaacatggaacagaacgccaatcagggattgccggtgctggtgtatgtggtcatcgtcgtgatcgccgtggtcattatcgtggtgattgtgctgctggtgcgtcgccggcgcaagcagaaggccaagaagaacgatattgatgaggactgggatgattggtccgaaggcaaggatgataagaccgataccggcgtgacggatggtgctgcggcagacaccgctcctatcacaccagtcaccccagcctcatcagtcgcaccagccggctcatcccacaaggcctgaaaggcccgaccatgcgattcggcgacatactgcggctctgcagacaaaacctatggcggcgtaaatcccgtacgattctgaccgtgctgggcgttatcgtcggctgctgctcgatcgtgctcatggtctctttgggtcagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagcaggcgcgggcggccgttacatctatgattacgtgcagatcatgggcatcgacatgacccagctcgaccagatgggctacaagctcgtcggtggcgagaaaccggtcaaaaaagaccaggtgcttgccggcgaatggttcgcctatgggttcatggacaccctgaagaacggcgaacaacgcaccagcacacgtggcgatcagtattcctcatgcacgtttaaccaggccaccggccagtgcgaggaagatcaggacgaagatccgttcttcgacccgctcaccacgcaaattagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctataatcaggtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgtctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgtcagaatcgcctcgcccggcactcgaatcaccaccggaccagcaggggcgtccgccgaaccggccggcgcggtagcccatgccagatcagccagatagtcgcgagccgaagtcggcaccagcatcgtagcccctggaatattggagaacatcgtcacgtcatacgcgccggaatgcgtattgtccgaaccggacaggccgcccagaaaatcaagtaccgtgactcgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtctacataatgtgcgcccgcgcgctctcggaactcatgggtgatgccgttcgagcccggcgtggcgggggagatgaccacgagtcccggctcggcggcgaaacgcggttcgagtgcggccatcgccattttgccgtaatgcttgcgcggatcgtccggcttgccgattgcggcatccggattctgccaatgcgaggcctcgcactggccctcatgcggttcatgatcggacaggttgcagtgatccgaatgccacggctcgctgtgcagcacgttgctcgtggggcgcacgccggtgtcggagactgccggatccagctcatggacgttaccggccgaggccgaggatgcgccggccacgtgaccggcgccgtcatatcccgcgcccttcagcgtatgaatatggaccaccaccggatgatcgatatcgcgcacttcctcgaaagctgcgaccagcgcggaaacatcgttgccggcctccacataccgataatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgcggcgaatcgaatacgcggtgcagggccaccgtggcctccaccatgcccagattggagccgatatgaccgccgtgttggtggccatatgccagcagcgtggtgcgaatctcacggcagagttcggcgagctcgttgggggcaagggccttgacatcggccgggctggcaatgcggctcagcagatgggagtcgtcgccatgggaaggggtaatgctcgggggtatgtcgtgaaggcgtgcggtcctctcggcagcgccggagacggcgaaggaatcgcttgaatcaaatccgtttcctgacgcgctgcgcataccctcgaatctcccttcgctagtctttccgaagttgaatgctaacgcccggcattgtccgaggtccacatgacgaagcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgccgatccgcttgccgcgttggcagtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgttggcattctggacgaggacatccccggcaagcatgggctcaaggccggcagcgaagtggtgctgtacacgttcgtcggcaccgatggcgcgggcgtggccccgggcgagcgccgcacgatcctctccgagaaataccccggcacgatggccgagaagacttccgtgccgtccgccaacgtgttcgccaagcccgcaagcctcaccacggctgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaggtgttcgtcacctcacgcgacgcggacaagcgctccaaggcgctgaaacttggcgcgaacgccgcgctggagatcggtgcccgcctgccgcgcaaggtcgatgcggtgatcgaatccgtgggcgcggccacatggggccattcggtgcggtcggtgcgtcccggcggcaccatcgccatctgcggcgccaccaccggcgaccagcccggtgcggagctcacgcgactgttcttccaggacattcgcgtgcagggctgcaccatgggttcgcgcgaggatttcgcccggctgctgcgcttcgtggagcacgccgacctgcatccggtgatcgattccgtggtcagcgggctggacgccgcccccgaggcgttcgccagaatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcggtggtcatgggatcggccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtaatcggcgtgcccgtgcgctcccacgccctgtccggctgggattcgctgctgtccatcgtgcagatgcctggcggcatcccggtggccaccaccgccgtcggcaactccggtgccaccaacgccggcctgctcgccgtgcagatgctctccgccttcgagcccgaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcccctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggccacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactactgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtacggcgtgctcttcgttatcttcgacatcattgtcgtgacggcgctcgaagtgggcgtttcgtccagctccacccgtgtgcagctgtccagtccgatcgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaatgaactggatgcgctggataagcccgtcaccgtggtgttctatggcgaccacttgccgggcatctactcgtccgccagcgaggatgacaacaactccttggccctgcacctgaccgattacttcatctggtcgaataaggcttccagctcccaaggcaataaggcaagcgatgcagcctactcctcgccgaacttcttcgtggcgcaggccgccgatcacatgaacgccaaggtcagcccgtatctggcgttcctgaccgaaatgcattccaagatcgccgccatggaaccgcctgtggtcaacaagatccaaggctgggatcgtatccccgaaggccagaacatctatcttgatcagaacggcaacccgatgtccaccgatgacttcgacaaggaaaccaagcagttgcttgccgactacaagctcatccaatacgacatcaccgccggcaaaaactacctcaaagacacggactttatgacgctgccgtaaagcagacagcctagtaggctgtctgtaggcagcgtgcgatccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggtgaagcacagttcgtgcgcaatcgtctgagcctttggaccgcccggcatcccaaagcgatgcattggatgttgcagccggctgccggatggacgattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaagaaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgattgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccgaaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacaccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggatgccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcttcgataacgaccttggcaccggcggagccgaagcgatggtcgatgaagatgtcttcaagcgcacgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggcggtgatggagccgagcacgtaggcgggctcgttgttgtcggcgagcagcttcagcgcctcgtccttacgagcggggtcgatggccagcaccatgccgatgcccatgttgaagatgttgtacatctccttatgatcgatgttgccggccttctccagcacgtcgaagatcgggagcacgggccaggtgccgagctcgatttcggcggccaagccgtccggaatcatgcgcgggatgttctcgatgaagccgccgccggtgatgtgggccacgcccttgactacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttattggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagtggattggtggtgagctattcggcatccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcgatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtccgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagagctgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacataggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgcaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggtggaattggatgcggtggactggccggaaccgcaggctgcggtgaacgacagagccaggatgctgacggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacatcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcgcctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgctcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgtcgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagttggcaccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtctttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcaaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggctgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcggcgaaaagctatcaagggccggtgaccatcgaccgatttgggcgcaaggtgcccaagagcgcggtcgggtcgattggtttgggtgatttcacctcgtcgtcggcacgtattcgtgaggctatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacggggcccaatcgtatggatccgattccaccagcgaaaaagatggagagcatgatatccagcgtgcgctgctggatgtgaaacgtaaattcggccgcaacgccgtcatcaaagccatggacatggaagacggtgccaccggtcaggaccgcaaccgtcagatcggaggccatcgcgcatgaccctgcaagagacccgtgcgtacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgcccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccaaaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagtgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcacgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcgaattcggcgacgtgcgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggccctctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgctggcccgacgcatcgattggtggattgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggagctacgaaaaaacctccctctgatgagggaggtggcatcgcgaagcgatgacggagggagagattagcgaagggttttacaacaactcaataagctgatcgacctcttcatgcgtggtggcccagctggtgcagatgcgcatcacggtatgcgtgtcgtcggccttctcggtaaagccgagcttgacctcgcgctccagacggtcgatagtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcagtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttagtggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgggcgtttcgcgagggcggttttgctataattggtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttccctttttgcgacgcattcccgggaatattgcgttgggagaatagttgggtgtgtgttttgcgacgcattggaatattgcgttgggaggagaggaaaagtacgggggcgcaggaggtccccaaaccagtgagttgtggctcggcgcgtcgttgtccggaggaatcgtaatatagatattcgtgtgtgccaacagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtttacaccaccaccccgaagaagccgaactcggctctgcgtaaggttgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgatttctcccgcgcccgtcgtgagaagaccatggctgagcgtctcgccaacgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacattatcgatacccctggccacgtggacttcacggccgaggtggagcgctccctgcgtgtgctcgatggtgccgttgccgtgttcgacggcaaggaaggcgtggagccgcagtccgaaaccgtgtggcgtcaggctgacaagtacggcgttccgcgtatctgcttcatcaacaagatggacaagctgggcgcgaacttctactactccgtcgacaccatcaaggagaagctgggtgctactccgatcgtgatgcagctgccgattggttccgagaacgacttcactggcgttgtcgacctggttgagatgcaggcttacgtgtggaacggcaccgaggagctcggcgccaagtacgacaccactgaaatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgtggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagttcctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgcttttcaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcccaagctaattgaaatattcgtgcatcatacagcgtacagttaaaccatgttccctctgctcgaaaccctggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggctgtgcagctcggcgtggtggaaaagccgatcgtgaacgattcggtggaccgcgtcaccctgtgcgaggaccggctggtgttggcgggggaacctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggcagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctcgctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgtggcgcccacaccttgattcggcttcacatccgctccattgtttgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgattccatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagatcgattgtcgtttaatggaacatgaggataacgggccctaatcgctcggtgccggaaacaaggagttgtgaatatgtctgaaaccatgaaagccgcgattttcgtggagcctggcaagatggccgtggaagaggtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgtccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgcaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacggccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatggggctttggtgcaaaatgccgcatttcaaaatggggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgccgtcgttggccgtgatgatactggagaccatgaaactcaggcggcggcagccaagggcgaagtcgagaaagaggtgacggcgtgacacttgaacagaggtcagatagcgcggcggcaggccacgaggcatgtgaccagccgatcaggagcctggaaatcctcaaccaatgcgttccgctgttcgagacgctgaaggatccgaaccggcagcagttgctggtgcaattggtgtgccatgggccgcagacggtgggggagctggccgaatcgtcggcactgtcccgcacggccgtgtcccatcacatcaaactgctggaacaagccggattcatcgaaatcagcaaagacgccacccgccgcatttgctcggtgcgtgcggatcgatggctgccgctgctcgatgaactgtcttccgccctgaaagccgaccttgcggcggcggagcagtgccgagcatgagcgacgatcaacggccgcaggcgattgaggtgcgcggtgcgcgcgtgcataacctcaagaacatcgacatcgacattccgctgggcgaactggtgggcgtggccggcgtctccggttcgggcaaaagctctctggcgctcggcgtgctgtatgcggaaggttcgcggcgctacttggaagcgctgtccacgtacacgcgccgtcgactgactcaagccagccgcgcccaggtggacgaagtgctgcatgtgccggccgcgctggccctgcaccagcggcccactgtgcccggcatccgttcgacgttcggcacgatgaccgaattgctcaacagcctgcgactcctgttttcccgcgtcgcctcgcacgtgtgcccgcattgcggggcgcgcaatgaaccgacgctgaacgtggcggccggcctgcccatcacctgtgctggctgcggcaaggaattccacgcgcccggcgccgaattgctcgccttcaactcggccggcgcctgcccgacctgctccggcaccggcatcgtgcgcgaagtaaaccgcgcggccctggtcccggacgagtcgaaaagcatcgacgacggcgcggtgctgccatggggttcgctcatgtgggacctcatgaaacaggtgtgcggcgcgatgggcgtgcgcaccaacgtgccgttcaacgaactcacacccgaagaacgcgacatcgtattcaacgggccggccgtcaaaaagcatattctttacaagccgaagaaaggcgacgatttcgccgaactcgacttcacctacttcaacgccgtgtacacggtggagaacgcgctcgccaaagccaaggacgagaagggcctgaagcgtgtggtccggttcctcaaggaaggcccatgcgccgactgcggcggcacacgactgagcgtcgccgcccgggccccgcatgtgcgcgggctgaacttggccgaagccggcgcgatgaccttggacgcggcggcggattgggtgcgcggagtgccggaatccctgcccgccgacatgcggccgatggccgccaacatttgcgaatcgttcttggatgtggcccgacggctgctcgatctgggcctcggctatctggcgcttgaccgcgccggcgccacgctttcgaccggcgaacgccagcgtgtgcagctcgcccgggccgtgcgcaaccgcaccatcggcgtgctgtatgtgctcgacgagccatccatcggtcttcatccctcgaacgtggacgggctgctcggcgtgatgcacgacttggtggcggacggcaattccgtggtggtcgtggaccatgatgtgcgtgtactcaaagcgtgtgaccatcttatcgaaatggggccggttgccggtgccgaaggcgggcatgtgatcgcgcaaggcacggtcggcgaggtggcggcgaaccccagtagtcgcattgcgccgttcctatccgaccaggtgagtgcgcgtatacgtgaacgtgtggccgaatcgcaagtgttcagccttggccacatccgcatgacaaccagtcagctgcatacggtcaaaccgttggacgttgatatcccgcgcggccggctcgtggcggtgaccggcgtctccggctccggcaaaaccacgatggtactcgaatcgctgattcccgcactcaaagcgcaggcggcgggggagctgttgccggaacacgtgcgcgagcttgagaccgagggcatccgtcgtgcgaatctcatcgatgccacgccgatcggcgcgaacgtgcgttctaccgtggccacttatgccgatattcacgacgaattgcggcgcgcctttgcccgatgtgaggcggctaagacgggcggctggaaggccggcgatttctcatacaataccggccgactgcgttgccctacgtgcgacggcaccggttcgatctcgctcgacgtgcagttcctgccggatgtgaccatcgaatgcccggattgctgcggctcccggtacgcgcccgaagctgatgcgattcggcgtgcggttaagggagaatctcgcctttcgttgagtttgccccaactcatggcaatgagtgtggaccaggctctggccgtgaccagcgacctcaagaaggttcacgcacgtctgaccatcctgcacgatctgggtctcggctacctgacgctcggcgaaccgaccccggcgctttcgggcggcgaagcccagcggctgaaactcgccagcgaaatgggcaaggcccagttgaacgcggtattcgtgttcgacgagccgaccatcggcctccatccgctcgacgttcgcgtgctgctgggcgtgttcgaccggctcgtggtgagcggcgcgaccgtcgtggtcatcgaacatgacctcgacgtgatcgccaatgcggattggattatcgatatgggtccgggcggcggcgaaagcggcggacgcatcgtcgccaccggaacgccggaacaggtcgcggccaatccgaacagcatcaccgggcggtatctgcgctgacttgtatggcggtcacgcgcctttgcataggaccctgcgcgagtaggatagccgtccatggtgcagattcatggcattagacgcgcaagcgcggacgcgaaatatcggcagatgaccgggcagccggtcaaaccgctgatcctcaaactatgcctgccggccgtcatttccaatctggtgactactgcatacaacctgactgatacctttttcatcggccagctcggcaccgcgcagtccggtgctatcggcatcgcgttctccatcatgaccgtgatgcaggcgctcggcttcttcttcggcaacggcgcgggcaactcgatgagccgcgaactcggcaagcagaacaatgatcgcgcctcccgactactggccgtgggctttgcgggcgcggtgatctccggtctggtgattgccacaatcggactgctgaccctgcggccacttgtcgtcatgctgggctcgacctcgacgattgccccatacgccgtgcaatacctgacgccgttgttggtcgccgcaccctgtgtatgcggttcgttcgcactcaacggactgctgcgataccaagggcaatcgacgttcggcatgatcgggctggtttcgggcgcattgctgaatttcctgctcgcgccgttgtttatcttcgtgctgcacctcggaatttttggtgccggcctggccaccgccatctgccagacggtgagcttcacgattctgaccacgatgagccgcaaattcggcgtgatgaaactgtccctgcgcaattgcaaaccggatatgctgctcatgcgcgaagtggccggcggcggcctgccttcgctgatccgccaaggcgccggctcgatctccgtgacctgcgtgaacatcgccgccaatccattcggcgacgcggccatcgccggcatggccatcgtgatgcgcatcatgttgggcgccaattcggtgatcgtgggtctcggccaaggctttcagccggtgtgcggctacaactacggggccggcctgttcgcgcgagtcaaagaagggtactggttctgcgtgcggctcgccacctgcgtgctcgtggcgttggcggcactgctgtggattttcgcgccgcaactggtcgagattttccgctccgacccggccgtggtcgcggtgggcgtggccgcgctgcatattcaatgctgcacggtgattctcaacggcttcaacatgatgggcaatatgatgacccagaccatgggccgcaccggtatcgcctcattcctggccttgtgccggcaaggcctgttcctggcaccgatcgtactgattctgccgatgatgttcggcgtgcttggtgtggaaatggcgcaatcggtgtccgacgtgctgacattcctggtcaccatcccgttcatgcggcgaatcctgcacgaattgcggtagatgtcatcaagattttcgacttccagaccaggtggaccgagcatatctcgctgaatctctgtagtttttccttaccgttgcgttcattaggtcgattatgcgttcattaggtcggtgccctgcttagcatgagataatgagcattggaatgaagccattcttgaaggcagtgttcatcacaagtgacctaatgaacgcataatcgacctaataaatgaatggcggatggctaatacggagcctgaatgcagaatatgaaacgtatgaaagccaaccaggcacacaagtggcctgtgccggagcgcatcgaattgctgtaccgcaccatggctgacgcactcggcccgaccggatggtggccggcggagaccacgttcgagattatggtgggcgcggtgctgacgcagaatacggcgtggagcaatgtggatcgttcgcttgcggcgttgaaagcggaggatgtgctcgaaccccatgcgctggtggccatggagccggagcgtttgcaggaactgattcgaccgtcaggcttttatgtcaacaaatccaagaccgtacagtcgctgagttggtggtatgtggagcgttgcggagcctcacctgagggcgcggcagatattcccgatgccgaattacgggccgagttgcttggattatttggtattggcggcgagacggccgacgatctgatgctgtacgtgttctcgcgccgcacattcgtggccgatacctacgcgcggcggctgttcgccttcctcggatttgatgtgccagccggctatctggcattccacaaggcctattcgcccgtggtgctggatgcgagcctcagcgtcaaggatttgcaggaattccatgggctcattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccttgactggctgcgctcgatgctgggtgtcgaaaacgagtctgtgacagaatagttcgaccgacacaatcgccaaaacgccgaacaggagccaatgatgaccgaagacaagccgatcgccaagccgattatcgatgatgcgacgcgcgagaaaatggcgcttatgttctccggcgaggtctacctgccggatgatgtggacggctttttgatctgcaggccgcccagcgtgatctccagctcgaactcaacgccacaccgctgaccaacccgaagcgccgtaccgaactcatgcaggcgttcttcggcgcggcgggggagggtctgtacctcgaatgcccggtgtatgcgaactggggctgcaatacctattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccggggtcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtggtggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcagacggcgttggacggcatgtgctcgttgctgctcaacgtgctcatccccgtgcttgtgttttcgaacgccgtcgatggtgcggaccgcgcgcagcttgcctctaactggggcgtgatgctgctgaccgccgtgatgtacgcgctgctcatcctggtgttctggctggtcgccgaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccaaacgctgctctggacgtacggcgtatggctgtgcgagccggtcgacgaaacgactggcggcaacgcgattggcgcgcgaggtgcggtcgtgaacggttcggtgaacggcgccggttcggtgggcaatgctggttcggcgagcaatgccgcaaacggtggttctccggccatcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttgggcggcctgttcgcgctgaccaagtggtggggcgtcctcaaacgctacgaactctatgctggcctagtcgccaagatgatcgcattcccgctcgccttctacgcgctactgaccgcgctgaccggcgcattgccgcaactgccgatcacccatgacatggtgctgatgatcacggtcatcgccggactgccgaccatgaccaccatcgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccggggcctccggcgcttggaatttcatcgacgccgccaacgactccaatccgaggcggccgtgccgtatttcaaggagatattcgattacgcgcgcacgctcgattcgcagcatcgcccgctgacctacaccaatctgctgatggccgccggaggcaaagacaagtgccatcagttcgcggatgtcatctgcctgaaccggtattacggctggtatgtgcaagatgggtatcagctcatcggagccaagaaggccttcatcaacgagatgaaccaatggatgaacaccgaacccaacaagccgtttctgttcaccgaatacggtgcggacaccgatgccggtgtgcacaagctgccgagcatgcaatggagtgaagagtaccaatgcgagtacctcaccatgcagcacgaagtgttcgacatgttcgaggcagtggtgggcgagcaggtatggaacctctgcgacttccaaaccggtgaaggtatcatgcgcgtcgacggcaacaagaaggacgtcttcactcgcgaccgtcagcccaaagccgccgcctatgtactcaaggagcgttgggagactaagtagcggcccgcccctggaatattccaggagcaacacacatcgcataacacacaacgcaacatacaaaaaagaacctcgtgaaacgaatttcacgaggttctttctagttacgctgaatgactcccattagactcccacgagggaagagcaatgggaattccaacgtggctaagctctcaaactcagatgtggaagtagagctcgtactcgagcggggtcggggccaggcgagcctggtcgatctcgtcgcgcttgaggccaatccaggtctcgatcaggtcgtcggtgaacacgtcgccggcggtgaggaagtcgtggtcctcttccagggcgtccatagcctcggccagggagcttggcacctgcttgatgccagcgtgctcttccggcggcagctcgtagagatccttgtcgaccggctccggaggctcgatgtggttcaggatgccgtccaggccagccatcagctgagcggagaaggccaggaacgggttgcaggacggatccggagcgcggaactcgatgcgcttggcggccggggaggtgccggccagcggaatacggatggcggcagaacggttacgagcggagtacaccaggttgaccggagcctcgaagcccgggaccagacggtggtaggagttcagggacgggttggtgaaggccagcacggaggaggagtgcttgatcagaccgccgatgtaccagcgagccagatcggacagaccagcgtagcccttctcgtcgtagaacagcggcttgccgtccttccacagggactggtggcagtgcataccagtgccgttgtcgtcggcgatcggcttcggcatgaaggtcgcagccttgccggccagagcggcggtctcgtggacgacgtacttgtacttcatcaggtcatcgcctgcgtgctgcagggtgttgaagcggtagttgatctcctgctggccagcgccggcgacctcgtggtgggaacgctcgaggatcaggccgaccttctgcaggttggcgaccatatcgtcgcgcagatcctgggtgtggtcaatcggcggaaccgggaagtagcccttcttgacgcgattcttgaaaccgatgttcggggtgccgtcttcctcaacgtcaacgccggagttccacggagcttcgatggagtcgacctcgtagaaggagcgctgcatggagttctcgaaacgcaccttgtcgaagatgaagaactcggcctcaggagcgaaggaggcggtgtcggcaatgccggtggacttcaggtaggcctcggccttgccggcgacctgacgcgggtcgcgggagtacggctcgtcggtcagcgggtcgacgatggagaaggccacgtcaagggtcttgtgcttgcggaacgggtcaacgaaagaggtctcaacgtccgggaccagcttcatgtcggactcgttgatggcctggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcgacgtcttccttggacttgagttcggtcacgggaccgctcctttcgtatgaaatataacggtatccatcgtaaaatcgcgcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtgggtattgacaggtgatgtaggtggatgtatgtggacgcgattatgagacatatgacgaagccccggaaccgattgaacggattccggggcttctgtgcgatttggttgtgtgctgccgatcagcgaccgcgcatcgcgcggcgggagatcttctgcgggcggttcggatccatgcccttggggatggcatagcccttcttggcctgcagcgtgcgaagacgatcgttcagcgtttccatctcggccttggtcagcaggaagcgacggcgcggatgaatcttggcgatcagtgcgttcttgtggtgcgtgggctcatagctcttggacttgatcaccgtgctacgcagcttggtcagcggcacctgcttggggccgtggcccacggcgatgcggtacaccggaatggaggagccggcggtgacgcccttgatatcgcgttcctgacgatccatcgccttcatgacgcgaccgtattcgccttcgccgatcaggtagatgccgttcatcgaagtgccgcgccagatggcatccttggtcttcgggtcgatccacaccggttcctgcgggaagtcaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactagacaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgcgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcacgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttaccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacatgtgccgcctacggtggcgtcacgctcgacgagtgccactttcatgccgagttcggcggcgcgcaaggccgtggaatagccgccggggccggccccgatgatgaccagatcaaactgttcgctcatgattgcctccttggtgcatataagtatggctcccacgctagggagccatatgcggctatcgccgccacttcgcctaaaaacagtccactggactgttttctttacggctcagcccctcaacgaggggagccagagtatatatggacaatcagtccgccggccagtgaccgcgcttcgggtaacgcggcttgggaagcctccaacgacgcatctgaatcgaacggctccaagcgtaggagaaggagcgggagcccttggacacggactgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggagacgatcagaatcgcgaaggccaccgggatgaaccattcgccaaggttgaaacgggcatccacataatcacggatgtagatacgccaaggcaggcgttccgccttgggcatgtggttgatatcgcccttctgcatcgcctcgtactcggcgttctccttctcacgcagacgggctttggcggccttggcgctggccttgcggtccaccggaaccagcggacggataccggcggcctgagcctgcttcatcttcggggtaggacggccttttttctcagaaggatcggcggtcttcttcggggcctgctcaacgggaacttgggcctcttcttttttcctaaacggattccatgtcatgctttgaggttacggtgacgttcagacacttgtatactggcgcagccattgcaatgacgccgcttacacacatataaaggaggaccatcatggcaacgctcaccgctgacgagattcgttcgcgcgtcgaaaccgattggaaccgcatcgtcaaggtgctggccgaaaaggttgcgctgcagtcgatttccgccaagggcatcaccgccgaacatatgaagcgctccgctgaattcgtggcagacgaactgcgcctcgtgggtgtggatgccaaggtggtccaggcttccaatgccgacggcactccgggcgcatgggaggtcatcggctcgcatatcgtttctccggacgcccccaccgtgctgctctacgcccatcacgacgtgcagcctgttccggacccggccgagtggaacaccgacccgttcgtggccaccgaaatcgacggccgtctttacggccgtggctccgccgatgacggcggcggcatcgccatccactccggtgcgctgaaggctttgggcgacgacctcaacgtcaatatcaaagtgttcatcgaaggcgaagaggagatgggctcgccaagcttcattcccttcatcgaggctcaccgcgacgaattcgccgccgacgtgattatcgtggccgattccggcaactggtcggcggacattccttctttgaccacctcgctgcgcggcaacacctgcgtggacgtgaccgtgcagggccttgagcacccggtgcactccggtcagtacggcggcccgattcttgactccaacacgttggccgccatgctcatcgcttccatgtacgacgagaacggcgatctggccgtgcccggcgtggccgcggaagagccaatcggcggtttgcaacgcgaccttgacgaaaccaccgtgcgcgaggattccggcgtggtggccggttacgagttcgccggcaccggttcgctggcctcacgcctgtggaccaagccgtccgtgaccgtgatcggcttcgacgcccacccggtcgagggatccttcaacgtgatcgccccggagacccgcttccgtctgtcgctgcgcaccgcgcccacccagcgccctgaagaagcgcaggaagcactggctgcattcctcgaatcccacgcgccgttcggcgccaaggtcactgtcgaacgcggcgaaaacggcatgggctgggccatggacccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatatcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgttattttctggggctgggacattgtctgctccgccccgctggccctgtttgaaggcgtgacccccggtttcgagggtctgctcaacggattctggctgttcgccggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgccaccggcgctctggaacgctttgaatccggccgcagcaaggcgcgcgtctgatgcaggttaatccggctgcggtagaggccagcggctggggatggcggcacgccacgcgtaaggacttcgcgttgcgtgccgtcgatttcaccatccggccaggtgaacgtgtgttgctgctcggtgcttcgggggcgggcaaaagcacgatgatggccggtctcgcaggcgtacttggcggcgatgaggaaggcgagcaggagggctcgctcaccatcgatggcgtcgatgcgcgcgaggcgcgaggccgcgtgggactggtgcttcaggacccggactcgcagatcattcttgaacgactgggcgatgacgcggccttcggctgcgaaaacctcaacgtgccgcgcgaggagattcggcagcgagtgcgcgaatcattggatatggtgggactcggcggactcgaactggatcggtccacccgccatctgtccggcggtcagcgccaacgtctcgcgttggccggcgtgctggctatgaagcccggtctgctgttgttggacgaaccgaccgccaacctcgaccccgaaggcgtggtcgaagtgcatgacgcggtcaaaaaggtcatcgaggccaccgggcagaccatggttgtggtcgaacatcatatcgatgtatggctcgatctggtcgatcgcgtgatcgtgctcggccgacccgatgcaagttcgcccacgggcgcggtcattgccgacggcaagccggacgaggtgttcgccgagatgggcgacgtattggccgccggtggcgcgtgggtgccgggccgtgcgattcccgattactcgccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgtgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgctgttgctgtgcgttccgatgttcatcagtctggatgtggtatccgcgtccacggcgctcggcatcgaattcgtgctgctgtggattggtggcgtggctccgtggaccgtatgccgtaagacctggccggtatggatcgccgtcgccggcagttttatctccgtgtttctctacggccgcacctcgggagagatcctgtggcagggcggctggattgtgatcagcgagggatccgttaatctggccatcgccacggctatcagggtggcggccattgccgtacccggcgtgattctggccctgggcctcgatcccactgatttggcggacggtttggttgagattctgcacttctcaccgcgattcgtatacggcgggttggctggattgcgcatgtttacgctgctgcaggaagattggcgcgcactcggcttgtcccagcgttcgcgcggccttggcgacggtaacgccatcgcccgtgccctctcccaggcgttcggactgctggtgctctccatccggcgcgccaccaaacttgccaccgccatggaagcgcgcggcttcggctccagcgccccacgctcccaagcccgtatctcgcgtctgaagcctatcgactggatcttctacgtcatctgtctggctgtcccgctggcctccataggcgtagccatcggcaccgggaattggcacttcgcctttcaaggtgtctgaaaggcgacagactggcacagtgcctttcaaggtgtctgaaaggcttacgatgcctccgccagcgggagcgagccacgactgacgtaatgacccggcagtagggtagtggctatgcccatcaacgcccagattcttgataatccgaaatccgaccgcgttcgccgcatcgccgatctgacccgcaccaaaggccgcgaacgttcgggccgttttcttatcgaaggcccgcaatccgtgcgcgaggccgtcacttggcggccggacgtggtgcaggacctctatgtggaggtttcgcaggcgttggaacatccgcgtatcatctcctccacgttggagaagatcgtcgaaacctcgcaggatgccacgatttatgtgcactactgcaccggcgacgtgatgcgccgcatcagtccggacgcccagggcatcgtggccgtcggcaatgccgagtccatgcacgccggtgccgatgacgtcgaacttggcaagaacggccggggcccgcagatcgccgccttctggcaggtgcgcgacccgggcaacgccggcaccgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgacgaccataatatgggcgtctgggccgccgacgtatacggcaccgaagaatgcaagccggaaagcctgcccgcagtactggcggacaaggcggcggtcgaggctccgaaagccgtgctgttcggcaatgaggcgcgtggcttggaaccggacatcctcacacgctgcggccgcatcgtctccatcccgctgtacggcaaggccgaatcgctgaaccttggcacctcggccgcggtgatgttgatgtcgctgtctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgtcgaccagaagaaggaagccggcaagctcatgggcaagctgcgcgccgacttcggccgtgcctatggccccaaggaggtcgagctcaaggaagccgccgagaaggccgcactcgccgctgaaaccgtggacatgacgctgccggtgaaccgcaagcctctgggcgcccgtcacccgctgcccaagctgatggaagacgtcgaggacttcttcatctccatgggctggcagatctcctccggtccggaaatcgaagccgaatggtacaacttcgactccctgaacttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggcgtgccgctgtacatcgcgtcccccggccgtgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcaccgagccgagcgccgagctcgacctgtggttccccgacaagaagggcggccccggctggctcgagtggggcggctgcggcatggtgaacccgaacgtgctgaagtccgccggcatcgacccggatgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaaggaccttgtcaaggtgggtcttgaggaagaggagattcactcctcccaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgagccgcgcaagacctacggccacatctccaacggcatgtgcgcctccgaacgtgagctgggtctgggcgacaaccacaatggcatcattctgctgcgtcagtacggcttctccgaggctgaatatgaggctctgaagcctggtcaggacgccatgcacctgctgcacctcgaccagcctctgcttgagatcaacatcaccccggaccgtggctacacgctgtcctaccgtggcgtggcccgcgaataccaccactccaccggtgccgcctacaccgatccggccgtggcactgaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgattcgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagatctgcttatcaccgattcgccgaacggcgaacgcggctcgcgcatcctcggtcttgccggtgtgatgggcggcctgtatggcgaagtgaccgctgacaccaagaacattcttctggaggcagcgcacttcgatcaggtgaccatcgcccgttcggcccgtcgccacaagattccatccgaggcctcccgccgcttcgaacgtggcgtcgacaccgcgctgcagcccgccgccacccagatggccgccgagctcatggccaagtacggcaatggcgagcccagcgaacacccgaacgacgtgaacaacacgccgcgcgccaaggtcatccacttcaaggcctccgaagtggcccgcgtggccggcctcgacgtggacatcaaccgcatctccgacatcctgaccgacattggctgcacggtggccggcggcggcaacggcgagttcgccgtaaccgcgccgagctggcgtccggacttgaacgagccgtgcgacctggtcgaggaaatcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggcgacgacgattacaaggccttcggcttcgacccggaagccaccaagaaggtcagcgtcgagatcgccaacccgctctacggcgaccgtccgtacctgcgtcgcgagattctgccgaccctggccaccaccgtgcagcgcaacatccgccgcggcatcgaaaacgtgtccctgtatgagctcggccacgtctacctgtgggatccgaacgcgcccgccatcccggcactgcccggcggcgtgcgccccaccgacgaacagctcgccgcgcttgacgccggtctgcccgaacagcccgaccatgtggccggcatcctgaccggtctggccgaggacgatggctggatgggcggcaagcgcccggtcgactggtccgacgccgtcgaggccgtgcgccgcatcgccggccgtatcggtgccgcaatcgaactcgaccagcccgccgccgccgatgtgcccgtccaatggcaccccggccgcgtcgcccgcgtcatggtgggcgacgtcttcaccggctgggttggtgaactgcacccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcgccgagcaagacgctgtccgccgaagacagcgacgccatccgcaaggccatcgtggctgaggccgccgaaatcggcgcccagctgcgcgcctgacccaaccgatcatccgaatcgaggagcgccatgagccaaccggagcaggacaagccgaaatacgggcagtaccagcagcctgaatatggtgctatgtctggccaatacgggccgaattacaacccgtatatttatggcgctcccgagccggataccaagaaggattccgccgcagccgctggcatcaacggtggcgcggcgcaatcccagcaggccggccagccgtacggccagcagacgccgtggcccggcaatcagcaggcgggcggctggccgtatgctcaaggcggccaacagtccggtccgggcgcatatccgggcgggtacccgggcatgcaggggcagtcgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcaccttccatatgaaaggcttcggtttggctgtggccgccgtggtgatcaacgtgctgtacaccatcgccgtcatttggatggccttcaatggctatgacgccatgagcctctaccaggaagccctccagcaactcaccggcggcaccggctcctcctccgactccatctccgcataagtagcgttcacataccaacacacccactgcataaatatgcaatagtctgcataatcgcgtatactcatccgaagaaacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgtcgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgtctcgaagagcaggccgcttgggatgagttctacggcggcgatttctatgagcattggacctacggcatgcccgagctcatcaccggcaaagccgcggacggctcatacacccgccagcgcgcggcgcttcctggtgccaagcgcatcgcaggccctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgagatcctgcagaacttcgcccacgcggccggcaagagcgcggccgaagccagcgaattcacgctcggcttcacgccgattctcgcccccatgtcccgaggcatcctcgccaccgtgtccgcccgcatgacggacaaggccaaggcactgagcgatgaggagattcgcgccgtatggtccaaggcctatgaaggtcaggacttcatggtgctgctgcccgagggcacactgcccgccaccggcaacatcatcggatccaacgcagcccacctgcaggtcgtcgccgaccgcaaggccggccgcatctacgcttttgccgccatagacaacctcaaccgtggcaccgccggacaagcggtccaatcactgaacatcgcactcggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcaccaccgcggaaacggtcgccggtctcatcggcgccgaaccgaatgatgtggctgtctgctccaccggtctcatcggtgaactgctgccgttggacaacgtgctggctggtgccaagagtgcccatgaggctcttgccgccaccgccgaagccggtgccgacgcctcccacgccatcatgaccaccgacaccaagccgaagacggtcgaactgaccggctccaacggctggaagatcggcggcatggtcaagggctcgggcatgattgccccgcagctggccaccatgctgtgcgtcatcaccaccgatgcggtcgtctccgccggccagatgcaggccgcactcgccgtggccgccgaacattcgttcaaccgcatcgacgtggacggctgcatgtccaccaacgacacggtcctgctgctcgcctccggtgcctccggcgtcgaaccggacaaggacgaattcaacaagctggtgcgtgaggcctgcgtctccctgtcccgccagatcatcggcgacggcgaaggtgcctcccacgacattcgcatcactgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccgcctgaagtcgcgccttacgattcgaacaaggtgaccgtggacgtcaacggcgtgcgcatctgcgagaacggcggcgccggccgcgaccgcagcgaggtcgacatgaccccgcgcgaagtccacatcgacatcgacctgaacaccggctcggacgccgaggccaccgtctggaccgacgacctcacccacgaatacgtccacatcaacgccgactacgaaagctgacaaacagcccagtgggctgtttgtagcagccggcagcgatagcgtcgccggcgtcgcatataacgcaaacagcccagtgggctgtttgtagcagccggcagcgatagcgtcgccggcgtcgcagaaaagagaaaaattggctacagaattgaagggacctgggttccatttcgacgtgcacaccgatttgcgcgccgatcagaaggcagaagtgcttattgaagcgctgccttggctggaggagttcgccggccagcgtatcgtcgtcaaatacggcggcaatgccatggtcgatgaccatctgaagcagtgcttcgccgaagacatggtcttcctgcgtcaggtgggcctgcatccgatcgtcgtgcacggcggcggcccgcagatctcccacatgctcaaggccctcggcatcaaatccgaattcaagggcggcctgagggtcaccacccccgaggccatggacgtggtgcgcatggtcctgaccggcaaggtgtcacgcgaactggtcggcctgatcaacgcgcacggcccgctggccgtaggcctgtccggtgaagacggcggcctgttctcggccatgcagcgcaggcccatcatcaatggcaagcccaccgatatcggcttggtcggcgatgtggtttccgtcgatgcctcggcagtcgaggatctggtggccgccggtcgtatcccggtcgtctcttccgtggctccgaacgaagaagatgccactgaagtgctcaacgtgaacgccgattccgccgccgccgctttggctgccgctgtgggcgcacgcaagcttgttatcttgaccgatgtggatggtctgtacgccgattggccggacaagaattctctgattggccggatcggtgtggaaaacctgcgcgatatgctgccggacctggaatccggtatgcgacccaagatggaggcctgtgtcagggccatcgacggtggcgtgccccaagcccatatcatcgacgggcgcaagccgcattcgattttgaatgagatattcacctccgcaggcatcggtaccatggttatgcccgatgaaggactggaaatgaggagctcttatggctactgagcatgaggaaaaactaggtacggaagacagcaagtggctgggagagtactctcaggtccacatgaatgtgttcggtacgccgttgcgcgtcatggatcacggccaaggtgcccacatctgggatgttgacggtaacgaatacctcgatttcctggcaggcatcgccgtcaattccctcggatacgcccaccccaagtgggtcaaagcggttgccgatcaggctgccaaggtggctcatatcagcaactatttcgcgtccgagccgcaaattgagctggcatccaaactggtcaagctggctggtgcacctgaaggctccaaagtctacttcggcaactccggtgctgaaggcaatgaagctgccctcaagcttgccaagctgtatggccgcaccttgcctggtgccctgccttccatcggcggcaagcccgcacgcattctcgcaatgactcacggcttccatggccgtacgatgggtgcgctgtccgccacatggaaacccggtatccgcaagccgtatgatccgctggtgccgaacatcgaattcgtgcgcgccggcgacaaggtcgccctgcacgacgcttttgcacagaccggtctcggccgctatggcaagggtccggtggctgctgtgattctggaacttatccagggcgaagccggcgtgcagccgttgggcgccgattacgtcaagttcgtgcgcgaactgtgcgatatcaaccacgcgctgctcatcatcgatgaagtacagaccggtatcggacgtaccggcaagtggttcgcattccagcgtgacgatctgtccggcggcgtgacgccggatatggtgactttcgccaagggcgtggcaggcggattcccgatgggcggcatgatcgctttcggcgagaaacttgcggctctgttcactcctggttcccacggctccacctttgccggcaatccgctgggtgcggctgcgggactcgccactcttgacgtgattgaagacgagaatctggtgaccaacgccgaagctcgcggcaaacagctgcgcgatggcattatggccaccggtaatccgctgttcgtttccgtacgcggccgtggtttgctggacgccgtcgagctcaagcatccctgctcccacgcggtgatgaactactgcctcgaacacgggctcatcgtcaacgcggtggctcccaatgcgctgcgtttcgcaccgccgctgattgtaaccgctcaagacgtggatcaggcacttgccatcctcaaggatgtgcctacggacctgcccgacgactgatttctcgccgtcactgccgacccaccgatccaaggagatcatcatgaccccagaacttcgccacatgctgcgtgacgacgacctcaaccatgaggagcagaagcaggtgctcgaacttgccatcaagttccaccatgaccgcttctacaagcagccgttcgccggcccgcaggccgtcgccgtactgttcgacaagccatccacccgcacccgttccagcttctccatcggcgttgccgagcttggcggctacccactggtcatcgacaagtccggctcccagctgggccgtggcgagcccgtggccgataccgctcgtgtgctcgaccgcatggcttacggcgtggtgtggcgcaccttcggccaggaccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccccacggctacctgccccgcccggacatcgtggccgacgccaagcgcgtcgcggccgagaccggcggctccatcctggtcaccaccgatgccaaggaagcggtgaaggacgccgactgcgtgttcaccgacacctgggtctccatgggcgaggaagccgaatacgccatccgctccaaaccgttctgggattaccaggtcaacaccgaacttatggcattggccaagccggatgcgctcttccagcactgcctgcccgcctaccgcggcaaggaagtcaccgctgaagtgatcgacggcccgcagtccgtggtgtgggatgaggccgagaaccgtctgcacgcacagaaagcgttgctgacttggttgaccggcaaggcccgtggagacgaaagcctgctcgcatgagtgaaaccggtccgtccctgcagcgccctgccaccagggcggcgcggctgagtgccatagaacaggcgctcgccacgcatatcatcacctcgcaatcacagctgtccaaaatccttatcgacgagggcattgcggtgactcaggcgaccctgagccgcgatcttgacgagatgcatgcggtgaagacccggctgaaggacggcacggtggcctacacggtgggccgcagcgtcgttgcttcggaaggtgaggatgtaggggagcgcggtgaggcacagatgtcccgcgtgctgaacggactggtcacctcggtggccgccgccggaaatctggttgtggtgcacacgccttccggtgccgcacaatacgtggcctcggtgattgacaagcagccgatcgaaggcgtgctgggcaccatcgccggagacgacaccgtcatggtgatttgcaccaatgacgacaccgccgtctcccgctccgactggctactaagcctcgcttccaaataaccaacacgccgtgcataaatatacagtcctctgtatatacttgcatcagtttgtttttcagaccttgaatgaaagggaaccaatggcagataacaagcgcattgttctggcctactccggcggtcttgacacctccgtcgccatctcgtatctgaaggagcgcaccggcaaggacgtcgtggccgtgtccctcgacgtcggccagggcggcgaaagcctcgagaccatcaagcagcgcgcccttgcctgcggtgccgttgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggcgccgacaccatctcccacggttgcaccggcaagggcaacgaccaggttcgtttcgaggtctccatcgcctccatcgacccgacgctgaaggccatcagcccgattcgcgacctgtccctgacccgcgacgtcgagatcgcgttcgccaaggagcacaagctgccgatcacccagaccgagaagtccccgtactccatcgaccagaatgtgtggggccgcgccattgagaccggcttcctcgaggatccgtggaacggcccgaccaaggactgctactcctacaccgacgacccggccttcccgccggtcgaagatgaagtcgtcatcgagttcaaggaaggtgtgccggtcaagatcgacggacgtgacgtcaccccgttgcaggccatcgaagagatgaaccgccgcgccggagcccagggcatcggccgcatcgacctcatcgaggaccgcctggtcggcatcaagtcccgcgagctgtacgaggctccgggtgccgtggctctgatcaccgctcaccaggaactcgaaaactgctgcctcgaacgcgaacagcaccgcatcaagcgcgacatcgacaagcgctggggcgagctggtttacgatgcgcagtggttctccccggcaacccagtcgctcaacgccttcatcgaagacacccagaagtacgtgtccggtgagattcgcatggtcctgcacggtggccgcgccgtggtgaccggccgtcgttccgactcctcgctgtacgactacaagctcgccacctacgattccggcgataccttcgaccagaggtcctccaacggcttcatcgacatctatggcctgccgtcccgcgtggccgcagcccgcgacgtcaagttcggcaacggcatcgaggtcccgaagaacaccgtcgagtaattcttactcagtcgcccccgctgcgaggctgtcggcatagctgactgggagtggtctttgaaaggactgtcctcagtcacactccatgtgacagccctcgccagcgggggcaactgtatgtttgaacacattgctacgcttaaacacagctattttcacttttcaaggagccttcatgactgagaacaacgaacatctggccctgtggggtggtcgctttacgtccggtccgtcgccggaactggcccgactgtccaagtccacgcagttcgactggcgcttggccgacgacgatatcgccggttcccgcgcccacgcccgtgctctcggccgtgcgggacttttgaccgccgacgagctgcagcgcatggaggatgcgctcgacacgctccagcgtcatgtggatgacggctccttcgcccccatcgaagacgatgaggacgaggccaccgccctcgaacgcggactgatcgacattgccggcgacgaactcggcggcaagctcagggccggccgttcccgcaacgaccagatcgcctgcctgattcgtatgtggctgcgccgccactcccgtgcgattgccggactcctgcttgacctcgtcaacgccctggtcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctctccgtacggctccggcgcactggccggcaacacgctcggcctcgacccggaggccgtggcgcgtgagctcggcttctcccgcgtgaccgacaactccatcgacggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggtctgctggccaccctgaagggcctgcccaccgcctacgctcgcgacctgcaggaggacaaggaggccgtgttcgaccaggtcgatacgctcgaagtgctgctgcccgccttcaccggcatggtcaagaccatgcacttcgacagcgagcggcttgaagaggaagccccgaccggcttcgcgctggccaccgacatcgccgaatggcttgtcaagaacggtgtgccgttccgccatgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatagagctccctcgtcagagggagctctattttgctgttgtcactgcaacggcatacactgagaaatcgtaacgaacgggagccgtgaggctgagaggaagtcgccagacttcgaccggggaacttgacgcgggtcatgccgccgtaaggaatcgttgttgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctgccagtggaagacaagccgctgaccctgggcggtcacgagttccagtcgcgattcattctgggctccggccgctacgacctgaacctcatcaaggccacggtcgaacatgcaggcacgcaaatcgtcaccatggcactgcgccgcgcgcagaccaccgagaacagcgtgctcgactacattcccgaaggcatcacgttgctgcccaacacctccggtgcgcgcaacgccgaggaagccgtgcgtatcgcccgactggcacgcgaagtgtgccacaccgacttcgtcaaggtcgaaatcgaacacgagaccaagtacctcctgccggacaacgccgaaaccatccgagccaccgaaatgctggccaaggaaggcttcgtggtcatgccctacatgttcccggacccgattgccgcacgccagctggaggaggccggtgccgccgccgttatgccgctcggttcgctgatcggctccaacatgggcctgcgcatgcgtgacttcatcgagatcatcatcgccaatgcgcatgtgccggtcatcatcgatgccggcatcggacgcccgagtcaggcatgcgacgccatggagatgggtgcggatgcggtgatggcgtacacggccgttgcctctgctggcaatatcccgctgatggctgaggcgttcaagcacgccatcgatgctggtcgtgcggcgtatctgtccggtctgggcaaggtgaccgagggacaggccgtgccgtccagtccgactacgggatatttgcactgacacttttattagctcccctctctgaggggagctggccgcgtagcggactgaggggagctggaaacatggagaaaacatggcattgactgatgaacaggtggagaggtacgcgcgccatctgattttgaaggggctgggcgtcaaagggcagaagcggttgttggcctccagcgtgctcatcattggagcgggcgggcttggctctccggccgccctgtatctggcggcggccggcgtcggccatatcggactggtggacggcgatgtggtggatatgagcaatctgcaacgtcagatcatccataccactgcacgtgtcggagcgcccaaagtggaatccgcggccacggccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtacatccatgccggcgtggtcggattcgccggtcaggtgatgaccgtcattcccggcgaaggcccctgctaccgctgcatcttccgcgacatgcccgccgccggtgagattccgacctgcaaggaagccggcgtgctgggcgcggtggtcggtgtgatcggcagtctggaggcgactgaggccgtcaagctgattgccggcgtgggggagccgctcgtggctcgtatgctcactgtggatgccctgaccatgaacatccgccgtgtgccgttgccgaaccatgtgcccgactgcccggtgtgcggtgagcagccgaccattactgctattgatccggccaactatattcagccggcttgcgcgatttagagctatgtggcacccctccttgaggggagccaagatcggaacgagaggggaagaacatgcctattgctttgcgtaatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggttacgatgtagcaagcctcgatggcggttttcagggttatctcgactatcttgaaacccaccacgattaacggttcccgttgtcgttcttttggatgagtgtgcacggacatacgtgtgccctacaatcggtcacggtattactcgatggattcttgaatatcgtcgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgttcggcactgtcgccatgttctgcgaaacttgactgtgcccaattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctgatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgacgcttccggtgcgctgttcggccgcggtggcaacctcgaagacatcgacgaggaaacgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggcctcggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcggctaccgttcccacgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgacgccgaggctgacgattccgccgaatccgccgactccgactccaccgaacccgaaaccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggcatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtacgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctggatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggatatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggtgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttagggggttagccttggatgaagtggtcgatctgatcctgcttgcccatgaggatgagttcgtcgttgcgatgcatgaccagttccttggagccgtactggaactccttgcctggggccttgaggcccaccacggtcacgccgtacttgtcatgtacttgtacgtcctcgatgctgcggcctaccgcgtacaggggcgtgtggaccttgacgacggtgtacggcccgtcgatttcgatgtaatccagataattgccggccaccagatggcccacgcgcttgccggcatcggtctccgcgttgatgatgtggcgggcgccgatgcgctgcagaatgcgcgcatgctcctgggacacggacttggcccacaggtcggaaacgccggcgtccagcaggttgccggtgatgatcaccgaagcctcgatgctgtcgccgatggccacgacggccgtgtcgaactgggaggcgtcgatctgctcgatggccagcacatcggtcatatcggcctgaatggtgggcagatgcgcggaccaacgggccacaagctccgggttcttgtccactgcgagcacatcctgacccatctggtcgagggtggcggccacggacccgccgaaacggcccagtccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccacccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcgcgcctttgacctcggaaagcttcgtggtgcccagctcgttcgcggtgagcatacgctgggagaccttgagtctgcgggaagcgccaagagccaccatcgaggcgaaggtcatgacgcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggttagaataatgagcagtgcgaccgaatcgacaggaggatgccatggccaagcgcaacgcggtggtggtgacgcataccaggctcaggcagaccggaaccgtagtgggcgaggcggtgagccagctgcgagtggccggtttcgaagtcaccatcatcgacaacaccgaggcccccgatttcggcgtgcagccgccgtgcgtatcggacgacaccgaaatcgtcgtggtcctgggcggcgacggcacgatactgcgcgccgccgaactcgtccactgcacccaggtgccgattctcggcgtgaacatggggcatgtcggcttcctggccgaattcgaaagcttccagatcgacgaggcgatccgccgggtctccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccactcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccgactctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgccggcgtcgctggtaccgagcccgacaagccgggcgaacgtgacggcaaggcaggggcctgatgctcgaagaactcgatatccgcaatctggggccgattcgagaagccaccattgcgccggccgcaggcatgaccgccatcaccggtgagaccggcgccggcaaatccatgctgctctccgcgatccgactggtttccggtggggccgccgaatcctcgcgcgtctcgtccggggcggacgaggcttgggcccaggcgattttcgcgctctcggatgatgccgtcgcatctgaacattccggcgacaccaacgatgccggtgacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggccgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaaccgacccgcagccgggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttcgctgagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcacccgtcggtggggccccaccttggccgacgtgctcgcttggcgggacaaggcggcgttcgatctggaggatctggatgcctcgccggaaaaggtcgccgaactcgaatccgaacggcagacgctgtacgatgcggccctcgccgccgccgacgtgctgagcgccgcgcgcgtggctgccgctgccgacttgggtgcgcgcgtcactgaagaactcggctcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcagcggcgaaacccgcgtccatgaaatcgcccgcatgctctccggcagcgaatccgaagcctccctggaccacgcccgagaactcctatccaattctcggcttacgctcccgctggcgggagctggcgccgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtgccgcccgactacatgaccaaagtttccgccatgcaattccgccagatcgccgaatacaccatcgcacgcttcggccttacagacacgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaagcgcctgggtgctgcaccggccgactgcacagtgttcgaagacctgctggtcggcatgaagtcggccaaatcagtcggcatgaaggtctgggccatgcacgacgactcctccgcctccgactggcccgaaatctgccacctagccgacggtgtcctcttcgacttccacgacgccccgcgcgtgctgtgataaaaaagttacgcccccgctggcggggctgtcggcggaacggcgttgttcggcataggtacccctttccgaggccattgtaggcacggcccatgtttcgacactgtatgttggcgaggtgtttgttcaccgtttaactgttatgtaacacaccttgacagttaagcagaacagttatactgtgttgtataacagctaaacagctggggtgctagtcaaccgcaaccgaaaggggcatagatgaaactgatcatctcatccgtgtccggtgagcccatctacgagcaaatcaaaacccaaatccgttcggcggtgctcggcggcgagctgaaggcgggcgaggccctgccttccctgagaaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcgaaacccagattcgcgaaagcctggccgaggcaagccggggcgccaaagccgccggcattccgctggacgcattgggccacatgctcgaagaggaataccgcaaggaataacctcaagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccggttcgattcacgtgctcggcctcgacaacgtcgccgacgaggagcccgtcaaggaacaactcggcgtggtattcgattccagctacctgtatgaacagtggcaagtcaagaacgttgaacgtatcgtcgcgccactgtattcatcatgggacggtggatgctatcgcaagtatctgggtactttcggtcttggtgacgcacagaacggcaagaaacatatcaaggatctttcccgcggtatgcagatgaagttgatgctcgccatcgcattgagccatgatgccaagctgctgattctcgacgagccgaccagcggactcgatgtgcttgcccgcgacgaactcatggatatcctgcatgcctacattgaggatggcgaacattcggtactgttcagcacccatatcactgccgacctcgaacgtgctgctgacttcattacctacatcaccgatggccgtctctactacaccggtccgaaagacgagtttgaggaatcgttccgcctgattaagggcggtccagacgaactggcacaactgcctgcggacgtggtgctgggctcacatatgtatgccaccggattcgatgcgctggtccggtcagacaggctttatgctgttgcgtcggtggtttcggggcttgccgttgaatcggcttccattgatgacatcattcgcttgaccaatgcccatgattccaatcgtgacttgagcgggaggtgagcggtcatgggggcaatactgagggtgccgcggtctcggcaacatgcattgaccactgcattgcgcgtcgatatggcctacctgtgcgtcggcgtacagactgtgttctcgttgttgttggtaccgttgttctccgccatctttcaaggtgaagtttatggtgatggtttcggctatcgcatgggtgtcatcatgacggtattcacctgcgccatgtgggtgctcaccatggctgttgctgacctgcagaacggatatcggcttcgtggcattattccgtcttcaaggaagaaccaggtggccgcgcgatatgtggttggattggtgatttccgtattgtcggtagcgatgattgtgttgattgacgggttgcaagtgctggtcaatccggattggtcattcgcgggcaatctgtgggcggcgccgttgggaggtttctgcaccgcgctgatgatcgcgcttatcgtgcccacgggttatctgtggaccaaactaggcggtcttcaagtcacgatgatggtgatttatgtcgttgtattggctggatccatactgctatctattttgcctgcttcggtgaccagaggattggcccatgccgcgaatgccatcatcgcgcaacgattgtggctggttattgcggtattgacaacgacggttgtggcatatggaatctcgtatgtaattgcctctcgcatatttgcttcaagggagtggtgacgatgagctggaaatccgtagtaaagcaatgtcgattcgattgtgtcgggacgggtctgttcagcgtggcgaatatggtgtttctgctggttttcccggtgctgtctatcgtggtatcgctggtgatgatatcgacccatgtcgatgaacacgttgccagtggtctgatgggcggactcggaggtctggcatcggtgatggcatatatgagtgcattggggcctgccgcatccgaggaatctgcaggacacagtgccatgcgagggctgattcctgtttcacgcaccgcgcaagttgtaggtcggtacctctttctgttggtggttggcctgctctgggctctggatgtggtgatatgcggtggcatcttcattgtctttggcgatatagcagatatggggtggattggtgccttggcatcaggtgcctccatcttcgctttggctatcattcttgggtcggtgctgctggcctgtgcataccggttcaccttccgcaagatgatgatggcctttggcgcggtcatggttggcttgtatgccgtcattgcgctgctggctcgattgcctgttgactggcaatggctattgctgaatattgccgatttcctgacgatctggtggcatacggcgcttgttctcgccgtgttgtgtctgctcgcattttttggctccatgctgatagccatccgcatctaccgagccaaagaactctagccgcgcatttgtctgaccacgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgctggcgtcgcggcgggtgggcctgcggtccataagattgtctcgaatcggctccataccgagcgtcagcgcgggtgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccatcgaacatcatgccggattccagattggcacggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcccttggcaaacacggtaatgccgtcgccatcgcgcaccacagtggtcatgctcttggtctccgacgagaacggatacgtgtggagcaccgtcgcgcgctcgcggcgaatccggtagtcgagtccggccttgtgcgcggcggccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggcgcgttgtacgcctcgatcacggtcatgcggttctgggtcaatgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatacagcatgttcgtgcggtcggccaccggggtcttcggatcggtgaacacggcgtcggcggctttggcactcggcacgctttcgccggtgagcgcggattcgtcggcggtcagatcgttcgattcgatgaggcgcgcatcggccggcagcttgtcgccggtgctgatctgcagcacatcgccgatggtgatgtctcgctgcgacaccagcgtgacctcgccgtcgcgcaccatggtgacggtcgtgtcgtcattgatgtcgttcagcgcttcgaatgccttggcactgcggccctccatcaccacggtgatggtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttggcaatgcgggaaagcatcgattccggcttcggcttggtgaaggcgttggggccgtactggttcaggttgtgcgcggcctgttcgctggtcaggccttgatgtgcatcggtgcccagcgtgctgatgactgctggcgcattctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaccgatacatgctggtaaagcatgtatcggttgggaattgtcagttagtgccgtcagcggactatcacagcgcctgggcggccttctccacgtagtcctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcttgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcatcgacccggagatcatccgccagcgcacgttcgacggtgccaagatccttgccgaacgactactggccgacgacgtcaaggccaacggcatcttcgtgctgaccggcggcaccgatgtgcatctggtgatggtcgacctacgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacctgcggcttcggaccgaaggaatacgaggaggtggccgacatcatcggcaccgcgctcgccgccggcccgtccgccgacgtgaccgcgctgaaggcccgcgtcgacaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggcccggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccgctctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttcctcgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatccccgggaagacaatcccaccgccggcgaaatcgaagaggaaaccgaatcagccgatgacgccgctggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgtttttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcatcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgcttaacgcttcggcagacatcgaatccgaaatcaccacgcccgtgtacttcagggcgttgcgaatatgaccgtcgataatcgtagaagaaaacaccgccggattattcgggtcgatggattgatacgtggccaacgacatcatcaccatcgcaggatcggtcttggtgatcgcctggtcaaaggcacctgcctcggccccgcccaacgtggtggtcgtatccagaatgccttcggtggtgaagtcggtattgccgcttaccgcgcccaacccaggataatgtttgaccgccgcgccgacctgagcgtctcgcaaaccttcaataacggcgatgccatgttcggcgttgccggccgcatccaatccgaaatcacgatccagcgcgccaatcggagcatttgaggcacgatcgcccaccaccgtgccgagcaccggtgccaaatcgacatttatgccagcagcagctaattgcgaaccccacgtgcctgccgattgacgcaatgcgtcagcggacattgtgccctgctcaacggcactgggcattgtgtcgaaaccggtaccagtcagatgctgcacctgaccaccctcctgatcggtggcgatgatgagacgattgccggccggcgcatatccttggagttgcgcggtcgcggtcttgaccgtatcggcgccggtattccaattgccaatgagaatggccgagccaatgtgctcatcggcgattgttgaagccaacgaggagggatcggaaccggcaagcaacggcaccatcactaactgtcccacacgttcctcaagtgtcatggcggataccgcacgttgggcttgtgcggccggttcgttcttcttcggggaaggaacgtcggcgcgtggtaacgcacttgtctgggaggtctggggagtggtggtgttgccgtttgatgtggatttggcgaaccatccgacatgccatccgtaggctgccacgccggccaacaccactgccaaagcacatattgtcgccacgattggagtgctcctgtgccgaagttggcgtgtggcgtgtgctgagggacgcatatgttgtggccgttggctgttcataccggcaagcgtagaacggagcgtagaacagaacgctgcctcattctgtgctcagggcataacctacctcccgccctttcgataggcttgagttatgtcttttaacgatcctttctcaatactgttcggcaatggcggcgattcacgacgcaacaatgcgaacaatgacgatccgatcatcctcgatgtcgaggccgatggggacggtccggcccgcaacaccaacgccggcccctccgggtcatcccgccctccacgtggcccggccaatccgcgtatcacccgtaagccagcgtccggtggctcaggaggcagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccttgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggctctcagttcaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcactcatgtgctgatgggtggtatccgcattactatgccggttaacggacgcggcctgttctccatcaccaagcgttgccgtcgccagcttggcatctggctgatgctcaacatgttcgcttgggcagtgcgccagatgatcggcgtcttcgaccagctcaccgtgcagggttcacgcatcaccggtgcctcctacaccgccgtgcatgccaacatccccgtcaccttcatcatggccgcgctgaccgccatcctcggcgtggtgctgggcatctggctcatgcgttcccacacgctcgaaggccaggcgtccatcggcgtgcgcgcctccgccgcgctcaaggcctggcgtgtgccggtgacctccattgccgtcgtggtcgtggtgggtcttgtgctcaccgtggcatggccggtgctgttgcagcgcttccgcgtcaacccgaacgcacaggagatggaatccacctacattcagcgcaatatcgacgccacccgcgccgcctacggtcttgacaagctcaagaccgagcaatacaaggtaaccgacaagggcgagcagggcgctctggccaaggagggcgacaccaccgcgcagattcgtctgctcgacccgcaggtcgtcagccccacattcaaacagctgcagcagtccaagcagtactacaccttcgccgacactttggcagtcgacaagtacgagatcgacggcgtttcccaagacaccgtgattgccgcccgcgagcttgacctggccggcaacgacaaccgcaattgggtcaatgaccacaccgtgtacacccacggttacggcgtggtggccgcttacggtaacaaggtgaccgccgacggccagcctgaattcttcgaatccggcatccccactcagggcaagctcactgaatccgaaaagtatgagcctcgcatctacttctcgccgaacaccaccgaatactcgatcgttggcgcaccggagggcacgcaggcttgggagttcgactacccgaccggttcggaaggcgccctgaccacgttcaagggcgacggcggcccctcggttggcaacctgttctcccgtattctctacgcaatccgcttcggctccgatcagattctcttctccgaccgtgtgaccagcgaatcgcagattctttacgatcgttcccccaaggagcgcgtggccaaggtggcgccgtacctgacgcttgacggccgtgtgtatccggccgtggtcgatggccgcgtcaagtggatcgtcgacggctacaccacctctgatgcctacccatactcgcagatgaccgacctcggctccgccaccaaggattccaccaccgtctcttccgcaacggtctcatccttgggctcgcagaaggccaactacatccgcaactcggtcaaggccaccgtggacgcctacgacggttccgtggatctgtacgtatgggatcaatccgacccggtaatcaaggcatgggagaagatcttccccggccagtaccaccagctctccgatatctccggcgacctgatgagccacatgcgctacccggaaagcctgttcaaggtgcagcgcgagctgctctccaagtaccacgtgacctccgccaaccagtactactccggcgaggacttctggcagacgccggtcgacccgaccgaatcccagtcccagcaggaccaggacatcctgcagccgccgtactacctgaccttgcagaccggtggcaccaaggaaccggtgttctcgctgagctccacctacattccggctggccagtccacccgtgagatcctcaccggcttcctgtcggtcgactcggatgccggcaatgagaagggcaagataggctcaaactacggcaccatccgattgcaggagctgcccaaggattcgaacgtaccgggccccggccaggcgcagaacaacttcaacgccaacgccgacgtgtccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggtaggatttgcggatacgttggatgaggccttggatcaggtgttcggtggtgattccggcgcggccgcaggcgatgccgagaacgtgtccggtgacggatcgtctggtgaccagtcgtccggcatatccggtgaccaatctggttccgataccaatggtggccagtccggcaccacggacggcaagtcggattccggctcgtcttccgaccgtagccccgaactccagcaggcgctgaacgatgccgcccaagccatgaaggacagccagtccgccatgaagaacggcgactggaccgcctacggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacgtccaagccatcgccgacatctacaacgcctcagtgatggccggcggtgcgaccgccgacctcaccccgcgcaccttcgatcaacgccgcgcctgggtcgaatcccatacgccgccctacggcgtttttgttgtggaatcggaagacggttcaatcattggcttcggtgcgctctccgtgttctatgaccgcgcaggatatgacggtgtcaccgatttggcctattacatcgatccggcatggcaaggcaggggagtaggcacgttcatgcttgacaggctgctcaccgaggcgctggcccgccacatgcgcaaggcctgcggcatcattttcgccgataacgccggctccattgccctcatgcaccgcttcggcttcacccaattcggactcatgcccgccgctgccaccgactccaccggcaccatgcgggacatgtcctactggtatttggacctgtagccttgcagtaagtcatttcagtcaagaaaagtgtgaggatgccggagcaaacgagcttgacggcggcgttgagtacaatcttgacggttggatccggccgggcatgggccagtgcgcgaggcgaacgcgcgcatgacgtacggaacgtacagaacgtgcatacgggaataaaggaagacggacgaggagcggattatggcatcggatttctggctgattgcgggactgggcaaccccggcaaaaaatatgaggacacgcggcacaacatgggcttcatgaccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggcaggcatcctgtctgagctggaacaggacaagaccttcctgaagctcgccgccggcgacatcgaggcttcggacgacgtcgacaactccgtcctggccggcatccccgaaggcttgcgcccggctttggccgccgccatcgggcagggtgtgaccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgcgatcctcctgagcgacccggagaaactgcgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgaacatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcaccatcggcaccggcgccaacaaaaccactcgcgaatacctggtcatcgaatatgcgccttccaagcgcggcgccccggcggacaaactgttcatccccaccgaccagctcgaccaggtcagcaaatatatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgagaccatcgaggggctggaaaccggcacggtggacgtggtcatcggcacgcacaagctgctgaacccgaaaatcaagttcaaggatctgggactcgtcatcatcgatgaggagcagcgtttcggcgtggaacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagatccacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcctgtacgacccgtccaagccgatgaccgagcagtcccatgaccggctcgccaccatcgcgcagaacacggcgctcggctccggtttcgatgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagagaacgtcgagccggtggccgtgtccatcgacctgcccatcgaagcgtcgattccgatcgagtacatcgattcggacaagctgcgtctggaagcgtaccgcaagctcgcctccgtccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgcccggtcacccaccagctcatcgtccccaccccgttcaccggctccctgggccaaggccccatgagctccgaccaggtagtcctctggaccaaccagttacttgatgatttggcatggaccccgtcgtcaagcaaacggcagagccgtttgtagacggggtgcgaggcggcagtcgagccagctatggctcaccgggcaacctccggtgagccatattcatattcatgccgtcgtttgtgacgatgattcaccccagacggaatcgttccggctgtccagcgagcgggattaagtgactgctatgagcgaaacgactacgaaccgcacgaaccagagcgcgaccacggcaacacttgccggctatgagattccccgcctcggcatgggcacgatggcgctcgccatcgaggggcgcccctccaaccgtgatcaggcgatcgagaccatccatgccgcgctcgatgccggagtccgttatttggacacggcttggtcttattatctgcccagcgcacccggaaccggcgagccggaggatatgggctatggcgaatatctggtccgcgatgctctgcactcgtggcatgggccgagagaacaggtgctcgtggccaccaaaaccggttggctgcgtacgcttgacggcagcggcaactacggctggcaggccgatgcccgacccgaaaccatgatcgccaatgccaaggaatccgccagccgcctcggtgtcgacacgctcgatttgctctactcgcactgcaatgatccgcaggtgccgtacgaagaccagatgggcgcactcaagcagctcgtggacgaaggtgtggccaaagctgtcggcatctccagaatcgacaacgcggacatcgaaaccgcccgcaatattttgggcgatcgtctcgtggccgtccagaaccagttctccccggtccaccgcgaccctgaacacacgttggaaacctgcgaaaagctcggtttggcttttgtctgctggtcgccactcggcggattcctcgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgagatcggctacctcaatggcaaggacgttgactgagcgatttcgtccgtactgccttgcaatcaggcggcacactggcattgtgagcgctaacgctaaattttgggcgtgttgttcacaacgtccacaaatcgcactactcttaagaatgtcattcaagatacacaaccgttttaaggagtagttgtggcagtaattgaaagcgtgtacgcgcgtcagattctcgattcccgcggcaacccgaccgttcaggtcgttctggacaccgaagacggcgcccagggcctgggcctggtcccgtccggcgcctccaccggtgaggccgaggcttgggagcgtcgcgatggcgacaagtccgtctacggcggcaagggtgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcctgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcactgagaccctcgacgccatcgagctggccaccgccaacggctacacctccatggtttcccaccgctccggcgagaccccggacaccaccatctccgacctggctgttgctaagaacacccgccagatcaagaccggtgccccggcccgtggcgagcgagttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacgagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgattgcccaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggctccgatagcgaatcccagaaaacggaagattccagtagcagcaacaaaaaagtcctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaatccgatcagaacacccaacagaatacccaacagaacacaggggagggaacccaacagtgaccatcgatatcgccgccaaggccaaggcccttgtcgataccgtgcttgccgagcccgccaacgatcatgacatcgacctggtgcagcgtcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggccttggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccagtccttggttatggggccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcgacggcgtcagtgcgcccactacccaggttcagggcgcgttttccatgaacatcggttccgtgcgcatgaccgaacgtcatctgaccaatgatccgccgacccagacacagatcgatgaggccgttgtggacgtcgatgaacatatcgatgaggccttccgcaccgtggacgcaggcaaggcccgtaccatcattggcgtgtccggcacggtgaccacgatgaccgccttggccatgggattgaaggaatacgatcacaccgtggtcgacgggcatcggctgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttatactagaaaagttggcctccgtggcgaaatggtatacgcagtcgacttaaaatcgatcgcttcggcttgtgggttcgagtcccaccggaggcaccttgaaatcggcctgtggccgatgccgtttttgcggctgtgccgtggtctctccccagtcggcttcgccgacagcccccctcgtcagaggggggctcgcagctcactatgtggagagcttataaggccgaaacaaaaggccgttaggctatgtggcgttgtgacgatgtacctgatgaaacgaggaatccacatggcttcacgctggaccgatgtcgaacgagtcgaacaaggcgcactgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcatgacgcgcgcggccatcatcgcacaaggcgaaagcgattccgggcgctgggctgggatacgatatcgtgatggtatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctctatggttctctggcgctgaccggtctcggccacggcaccgatcgtgctgcgatggctgggctcgaaggcaatctgccggccaccgtggataccgaccacatgatgcacatccgcgagatctgcgcgttggatgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacaagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgaccgccggtgccatcggatacctgttcaaacgcaacgcctcaatttccggtgcggaagtcggttgccagggcgaagtcggctcggcctgttcgatggcggcggccggacttgccgcagtcgtaggcggcacgccggaacaggtggaaaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggtggacttgccgtcaatgtcgtcgaatgctgattgacatgtccggtattcaccagcatgatgaccggaattgacgtatacggccagcgtgtcgtatgaaggactaccgccgattcgccgatggtgctaaggtagggcgcattgtgtctttgaaggaggactaatgacagatcagatgcctcaggtgaacgccgaatttggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagtttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgactgtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaacggttccagcgcaaacgaaaccggggtatacgtgccggcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggccgtccgtgcacgtcgagacgaatcttgcgttccacttccgcaggggcaatgccctcgattttcagcgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagttgacgatacgcttcttacgctgccgtaacctacgttagcgtaacttttatgcttgtcaataccgactcgcacgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgtcgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttctctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcaggttgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcgtcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccaccgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacaccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcatcagggcatcgtgtccgcgccatagcacacagttccataaaaatgatgtaatgacacgagaaagaatttgacaaaaacgaaattgcatgtgtgtaatttagtccgtatgaaaagctcaataggcaaggagaatcgcatgtggggtgtggtcgacgattcagccgaagagccatggcatgaattgtggggactattccgacctgatggcgatgtatcttggcagcacaaggcgttgtgcgcgcaaaccgatccggaggcgttcttcccggaaaaggggggctcgacccgtgatgccaagcgtgtgtgcgccaaatgcgaagtgcgtgaacaatgcctgaaatgggccatcgaccatgatgagcgattcggtatttggggcggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggagtcgtcatcatcgccgacgcgaccgggcgcgccggttcgaggataaccacttcgttcgaggtcatcccctcgccatcggggccggtgatggaggtgccgcagtccaagcatgtgaccattcacatcgtttcggccaagggcgcgcgttccttcggcgatgcggtcagccgggcgttggatcgtgccgatctggatgacgctccccgcgcattgtggttgctccatgatgattcccgcccctcggatgcctcatgccttgaacgattgcttgaggcgtggcgcaatacgccgggcgccagcgtgctcgggtgcaaacagtgtgattgggaaggatcccacctgcatgatgtcggtatgtatgcaggccgacacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtggccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcgggcaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtttgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcgggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcgcgacaaatggtggtacgttcgtggtccgaacttgatttcgataatgtctgctccaacgccaaggtgttcggtttcgatttggacaacacgctggccagctcaaaacagccgatgaggcccgcgatgatcgaacggttctgtgcgctgctcgaccatacggtggtggccctgatctcagggggcggcatggcggtggtcacctcacaggtgctggatgtactcaccccgaatgccaggcgcggcaatctgcatgtcatgcctgcctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctctgggacagttcgcacccgtagcggccaaacaggcatgggatcgcgataacacgaagaaacaggcgctggtcgaagcggtcaaggccgatctgccgcacatgcgggtcagggccggcggctacaccagtgtggatgtcagcgaatgcggcatcgataaggcctatgccgtgcgcaagctgacgcagacacttggcatacaggccgatgaaatggtgttcgtgggcgatcgcatgacgcctacgggtaatgactatcccgcggttgaggccggtgcgatcggtgttcgtgtggagaatccgcaagacacggtacaactgctggatgcactgcttgcgcgattcgatactccagcttgatggtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgtcgggccttgttcgcacaatgccgggagcgggatacagacggtggtggcggagcccgtatatggtccgcatcgatttaccagggagcggcgcgtcgtgccattctcgactggaaggaccacgacgataccgagcttgacggccctttcggccgcatcatggtgtcgctgctgaacaagacgccaatatcatcatcatgcttggggcatcgcgtattggtggttccggtgccgtcatcgcgggcgtcaatgcgccgaagagggcgtgcccatacggcaccgttggccaaatcggtggcaggggcattgcgtgggtacggtgtcaatgcgcgaccatgcaatgccctgagctcctccaccaaggcacgctccgtgcagcagacctcttcggcacagcgtgcccgtcgtatcaccggtcatgtcagggtgaagcgtgatctcataggccatggcgacgcggtgcttctcattgatgacatcgtcaccacaggtgccaccgtgcggcaatgcgttcaggtgtttcagcaggccggcaccaaggtggtgggcgtgctggtattggcggatgctgtggtgcgacggtccgatgacgatatcaacgggtgaatgacatcggtgacgatgccccagatagcaggcgaagcgccgttgctcggcatgtaatcgggatatcgaggattctcggcgtgcaatatggtgatgccggcccgtgaaactagtcgtttgatggcgatttcatcgtccatgacagccgcaaccacatctccggggactggtgccaacgaacgatcgacaatcagcagatcgccgttatgaataccggcattgatcatggaatcgccggccatctgcatgacaaacagcgtggtgtcgtgcggcatggttcgtgacttggattgctgtgtcatgctgtgcctcccaccctgtattcgaacatctgttcgaatacagtatacggtaggacggcggacaatatcagcgttcggcgacgtgatatttaggcaggatgatttcgaaatcggcgcctcgcgtgtcatcgaccactttgacggtgccgccgtgcaattgggccgcccaacgtgcgatggacaggccaaggccggtgccgcccgactcggtgccgggacccgtcttgcctttgacaaagcgccggaagatatccgaacggtcggacggtgcaatctgggagccgaaattcaccacattggtcacgatggtgccttggctgtcatcctcatgggcatcgaccagcacggtggtgccgtcggccgaatgcttcagtgcgttggcgatgatgttggtgaacagctggcgcaggcggtcctgatcgccttccatcgagatgtcggccggcacggtgacgcggatgtcgtgggcgtggccgccatcggcgatttccaacggctcgatggtctcgtcaagaaagtcggcgaagttgaacttttcgatattcagactcgccgcaccggcctccatacggctcaaatccaacaggaaggcgatgaggtcggagagacgctgcgtttgggtgaggatgctctccagattggcgggagtgggctcggtgacgccgtcggccatgttctcgaccatcgcctgcaaagcggaaacgggcgtacgcagctcatggctcacattggctatcatgtcgcggcgcattttatcggcatgttcgagttcgccggccatctcgttgaacgagcgagccagctggccgacctcgtcatgacgatcctgatcgatatccacgcggaccgtgtaatcgccatccgccatggcttcggccacatcgcgcatctggcgtaagggagcggtgatgccgcgggagaagaaataggtgatgcccaaggccaccaccaaagtcagcggcatggcgatccaaccggaccagccgaatttcaggaggaaccagcacatggcaaacgcgatggcagtggcgataacgatcagtacgctgagttccagcttcagagaggagaacaaatcaaccggcttgacgcgaggtttcatcgcatcaagccgggattgctgttgttttttggatgccatcacgcggtcggcggctcgaaagcgtagcctacgccgtgcacggtgcggatggtatcggcgccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgctcgccgttcacggtgacgatgcgctgggccgggtctatgaccatcgaaccgaagtcgagcagcttctcgttctccgaattcttggcgatgaccttcgcacgctccacgcggcgcagcagcgccttgcagcgggcgatgagctcgcgcatggagaacggtttggtcatgtaatcatcggcgcccgctcccagaccgatgaccttgtcggcctcgtcatcacgtgcggtgaggatcagcaccggcaccggacgttcggcgacgatgcgtttggtggcctcaagaccatccatgaccggcagcatgatgtccatgatcaccagatcggggcgtagctgggacgcggcctggacggcggaagcgccgtccccggccacgcgagcggtccatccttcagcggtgatgcgctgggcgatggccgtggcgagtgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgcgaatgatattcgccctcgaccgcttcgaaggtgccgttgtggatgtcggagccgccgtacttggcgtcatcggtggtgaacacttcggtccacttgccgccggtgggcagcgccacctggtaatcgggccaggcttcaccggagaagttgaccaccacggccaaggtctcgcccttggtgccgatgcgcaggaagctcagcgtgttgtggtcggcatcgtcgctggtcagccactggaagccggccggatcgaagtcctggctccatagtgccggatgcgccttgtagaaggcgttgaggtcggcgaccatggtctggacctgacggtgctcctgccagttcaggcaatcccaatcgatggaggcgtcgtgatcccactcgccccactgggccagctcgttgcccatgaaggagagcttcttgcccgggtgagcccactgataggcgaacatcgaacgcacgccggccagcttctgccagccatcgcccggcatcttgccgtacagggagcccttgccgtacacgacttcgtcgtggctgatgggcaatacgtagtgttcggagtaggcgtacaccatggagaaggtgatttcgttgtggtgccacttgcggttgatgggctcctcgtgcagatactcgagggtgtcgtgcatccatcccatgttccacttcataccgaagccgatgccgccggcggaggtgggggcggtgatgcccggccatgcggtggactcctcggcgatcatcatgacgccggggttgttcttgtacgcggtggcggtggcctccttgaggaagtcgatggcctccaggttttcgcgtccgccgtagatgttcggacgccaatggccgggttcgcggctgtagtcgaggtagagcatggagctgacggcatccacgcgcagcgcatcgacatgcaggtcctcgagccagaacagggcgttggccaccaggaagttgcgtacttcgcggcgtccgaagttgaacacataggtgccccattcggggtgttcgccgcgcagcgggtccgggtcctcgtacagcggggtgccgtcgaagcggccgagtgcgaaggcatccttcgggaagtgggcgggcacccagtccatgatcacgccgatgccggcctgatggaactgatcgaccaggtaacggaagtcgtcgggggagccgaggcgggaatccaccgcatagtagccggtgacctgatagccccaggagccggagaacgggtgctgtgccagtggcatgaactccacgtgggtgaagccttcctgcttgacatagtccacgagctgcttggccaggtcgcggtaggtcagtccctgcttccagctgccggcgtgcacctcatagatggagaccgggccatcatgcgggttggtggtgcggcggtgctgcatccaggcgtcatcgttccactcgtaggtggattcggtgacgatggaggcggtgttcggcggaacctcgtgctgacgctccatcgggtcagccttcatctcccacgtgtaattggcgttcaggatctggaacttgtaggtctcgcccgcgccgatgccggggatgaagatctcccacacgccggaggagccgagctcgcgcatggcatgacgacggccatcccaggcgttgaagttaccgaccacgcgcacggcatgggcgttcggggcccacacggagaacgcggtgcctaccacctgttcgccgggcgtgccgtccacgccgcccatcggatcgtcatagcgcagcacatgcgcgccaagcgcctcccagagcttctcgtgacggccctcgccgaacagataggtgtccatgtcgccgactgtgggcatataacggtatgggtcgtcctcaatgagcactgcgccgctttcccactcggtcctgacgcggtagtcgggaatcgtgggctgcttcttggtgccggaagccggcacggtggtcacgaacacgccgttgtattcgtgggtcatcgggtattcgccatcctgggtgaggatggtcacggacttggcaagcggacgcagcacacggattgtggcggtgtcggcatgcttgccgatgccgagatgcccgccgagaactccgtggggattgtagaattcagcattgctcaccgcatcgaggtcgccttgggcgacaggcacggtgacggtatcttccttgatcttcgtttcttcagccatgacccaaagtctacgtgcgttggagtcgtaaacgctacattggcgcgtcgaaaatggcgaattcttgcccttttcggtgtgtcttcgtggttgtgagcgctctcataggggcggtccaggccgcatggcataattattcgagtttttgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggcgtgcgtgacatcgtctccgcatccgaagtggccaaggtattcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggggagaagcgtatgctcaccaaggcccgcgccattctgacttctgagatcgccttgtccgagaagatcgacgaggcggaagcccagcgtctgctcgacgtgaacctgggctacgagcccgctcaacccggtgacgacaagcatcacaccgccgagcccgaagaggccgcggccgatactttggctcgtgtcgaagccgagaagaagtccaagaagaagtgatttgattgttgaggccccggtcgtgtccttatgcgatacgccggggcttcgtgattcataatcgtttgctgccgttcgtctgggcagcgccatcgaaggggactgcatggggtctgcaggagtgttgatagggcagggttttgacgctcaccgttttgcgcctgccggctcaggccgtgaactgtggattgccgggctctactggccggcgtctgattcatgcagcgaggccgatgccgccaaatacgaggggatcgaaggcgattccgatggcgatgtggccgcgcacgctctgattgacgcgttgcttgccgccgcccgcttgggagacattggttcactgttcggtgtcggtgcggacgcgcatggtgccggaatgcatggcatcgatatgttgcaagaagttgtggcgcatctggcatccaacgggtatacgccggcatcggcctcggtggcgatcatcggcaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcgtcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgctcctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcgcagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggttggagtgggacttggtgaactcggacgcccatgtttccaacgatttctcgtccgcctgccatgccttgagccgcttctggaaggctttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcggccagcgagccccattgattgagggaggccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcttgcaccgggttcatcgtccagctgccgttgcccaagggcatcaacgagaacgcgatcatcgacatgatcgacccggccaaggatgccgacggcatgcacccgtacaacctcggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgttgccgcaatgggttcggccggattcgtgacgcccgacaaaatcaaggacggcgccgtgctggtcgacgtgggcgtcagccgcgtctacgacgaagaagccggtcgctaccgcatcaagggcgacgtggacaaggcctgctacgacaaggcctccgcctacacccccaaccccggaggcgtgggccccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgaaggcaccgtcatcgaagccgtcaagggcggcctcatcgtcgacatcggtctgcgtggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctccctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagtccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtgtaaagaaacccggtccgattgggccgggtttcttgtgtttttggagttatccgccaatgactcccctcagtctcgctacgcgagccggctcccctccctgaggggagctgtcggcgatagccggccgaggggagcgccagctatcatgggcaccatgatgcgaataggactgaccggcggcatcgccgcgggcaaaagtacggtggcggcgcaactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggcacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatccccgtctacgaggaactggccgtgcgcatcgaattcttcggcgacgagattgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccactttgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgcgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaacttgcggcccgtctgcgcgacgagatccgagacctcaaaaaagaactccgtcaaatgacggaagccaacaagtaaccaaattcccatacccgaggcgggcagtcaggggatgcgttgtcgaccgtaaagacttggcctgagcggcccggagcgtgtcgaacaacacatcccctgactgcctggcgatcagcgctaccggaacggccccaaaaccgtcacatacataagttagtgtagggaatcatggcagaaaccccactcgcatttgaaatcatcaccttcgtggtgctcgcgttgttctttatcgtcgacctgttcgtcatcgggcgtcgaccgcatgtgccctccaccaaggaatgcgtgcagcatatcgccttcttcgtggttatggcgctgatcttcggcggatgcatctggttcttcgccggctccaagcccgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggaggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggtaagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccgggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcacccaaaagtccgggtcatacggcatcacgatggcgcggggcgaattgttcgctccgcgctttttcgtattctcagcaccgtcgtctggcctcacgatgtagcgtgggcccgttgctccggcaagttcacgggactccgcattatcaggtgcaacattatgttgcacctgataacgagttgataatgaaattgcattaccagcctcgacatgttgtcgaggctgataattggattcgccaggaaccagatatgcggcgagtttatctgttgtcagcagtacgtaaaacggtattccaaagaagtctgcaacattagcaatatctgctggcatccaatcagcctttccgttgagttttctactcaaggaaggctgctttattttcaaggcagcggccaagatctcctgtttgggtttatagaaagccacaagcaatcgaatattgcctcgcgcaatgcgttggaattcttgtgcggcggcggtttgagtggattcaatattgttcatatacgtaattgtatacgaagtgatttgctttatagttgaaaatgcgtatatttatacacatgaagtataaagatgttgtgactgcgtatagaattgatgagcagaggaagcaaaataagctgacgcaggagtatcttgcccattatttgggtgttacccaggcgtcgatttcaagaaagttggcaggtaaggccccgttcacttcaccagaagtgaagtcttgtgcattattgctacacacttcaacggattacctgttaggtcttcaagaatctgcaagtcgggaggtcgtcgcatgagcgaaagagtgttgtggcttcggttgtgcgtgaccggtccgactcccgagtgcggggagattgtcggattgcgcatcgtcgacaggcaggcgcatcgcatggtgttcgacgcgttcttccaccccgtcagggaagacggctggaagagcgtgccggcaggaggggtgaacgtgaacctggcgaaccgtctgccgttgaacatctacgtggatgggatcgaatggatcctatccggtgcgacgctgctgcgcggcgagcatgtggaacgcgacatccgtttcctgcgcgccgccggcgtccgtatcgaggaccaggtcgtggagcgcagcgtcacggccgaacatcataagagacttgcgtcggggattgccgtccccacgcgcaccgggaaccgggcttgccggcccatcccggtgggatgaacaaccatcccttacccgaaacaaacccatccaccacccatctgcagcgaaaagagagaaccaggaatgccaaccctacaagcgcgtgcggcccacggcggccacagcggatcgacgcccctcggcgaccgcggaagcgacgtcgtggacgaacccatacgcgtcgtcacaggtcgcggcggcgagcacgatgccggacgagagccctgcgtcgaacagctcgccgtccgtgacccccgtggacagcatccaacgcagcccatccatgacggcgggatccgtgacattacggaacagaccatcggcgacggccatgcgataggccagccaggccagacgcgcccgccgcgcgagcaccgtttcgtcacgggccagcgcctcgtaccgaatcgcggctcggaccgtcacgatcggggagacatggagacgcaggggtatcgatgcgccctgcaggaacccggatatccggtccaccgtcatgagacggcgacggagaacgggaacgaagcccgcagtgttgtcttccatcatgcccgccgatcgattgtgtttggagacgatatccgttctaccgatacacatgcgtccggcatgatatcggccgcatgggatggtccgtgaaaaagagaatgcccgcacgcgaattgccgttcgcgtgcgggcgatggtcccatcctttacccatttgcactgccccttgccggacgaatccggctcgggcgagggaaccagtaaaagccaaccccaccaatcatcacatcagaaggagccggcaagaccgaccccgaccaatcgtcggaccagaaggagccaatcatgaccaattcttacatcaaccccacccagccgaacaccggcgaaccccgatattcacaggatgcccccgcatggcaggacgtggagatcgtcgacgtgcccgccgtggaggaaccgggaccggccgagggcgctcccgagccgatccgcatcatagacgagccggaccccggggaggccacggcaggcgacgcggtcatcgaatacacgcgcgaccacctacccgtcaacatgggcgtcgacacgaaccaaagcgacttcacccgcgaacaggccgaacagctcgtcggcgacatccaggaacagctctacgagaccgcgaaaagccagaaacgccttcacgacctgatcgcccaggcatacgacggacgcgcctggatcgccctcggataccccgcgggacagatcggctggaaccggatgtgccaggacaagttcaccgccgacgccgtccgcatgaccgtccagcaacgcaccaacctcatcctcagcttccaggacgacccgatcagcaacgtggccctcgccgccgcgctcggagtgagcgataggacggtcggccgcgcgctgaaaaagaacgcgaaatccccgaagggcgcctccgcgaagccgaagccggtcgtgggcacggacggcaaacgccacagcgtgccggagctcacgccggcggaacgcctcgaactcgacgcgaagatccatgacatgaacctgcccgtcgaggagggcggccagggcatgacccagcaggagatcgccgcgaagctcgacatggcgcaatccacgatctgcgcgagcatcaaacgcgagaccatgcggcgcatgagcgagggactcgaacccgcggcccccgcaccggtcgacgagaccggcgcgatcggcgtgctgcccgacaatactgcaatcgacctgggaggcgaccgtctcgccgcggacgacatgaacttcgtggaagcgttccgcaccgccgcgggagacgcgaacgccggactgacccgcctcgtggagctgatgagctccgaacgctggcagccaggcagcgagaccgtcgacgagatcgtcacccgcgccggccgcgacatcaagggcgtgctggccaacgtgggcccgttcatgcgcctcgtcgaccacgacctcgaggacatgtggcccgccgacgagaacgaccgcagccgcgaccaggacgaggtcaacggactgttcgaccagatcctgaccgtcgcgtcggaatgcgcctgacccgttagcagagaaggccggccatgagggccggccggagaggaaccggtatgaacgacaagaaaaccaaggaagtggacgggcgggagagcgtgagcatgctgcccggcgtgacggtgggcgtgatgatcgcggtcatcgcgttcgtgctgagcttcgacgcgttgaggctcgtgttcgtgtccagcggcatcaacccgctcctgtcatggggaggccccctgtgcgtggacggcacgatcctcctgtgcacgtgggcgacatggggattccgcaaaggccacatccgcggacgctggtacccgtgggccggactcgtgctgttcagcctgttcagcgtgacgggcaacgcgttgcacgcatggctcaacgccggcggcatgctccccacgtggggtgcgcccgcaatcatgagcatcccgcccatcgccctgctctactcgacgcatctgatcgtgatcatcgccggcgaccgccaggacaaactcgccaggaccaccggcaaggccgccggccccgatgacgggcacgccggacccgccgcagccacgccggaaacggccggcacggaaccggtccggacggaaaacccgcgggccatccccacgccgacggccggaccggagccgggcaaagccacggaacccgcgcccgccgacccgctggaccgctacctgttcgacccgccggcccaagcggaaaccgacgcgaatcggggaaagaaggaggatccggaggacatcccgttcgaccaggacctctcatggccctccgtgacgtccacgaccacgacgtccgcaaggcccacggagtccacaatccacatggtccgcatggaccaggcccatgcggaccaggcccatgcggaccaggaccttgcggaccaggaccgcatgggccggaaacccgagatggatcccaagggccagccgggcccggaggcagggggtcatgcgggccacgccgaacctgagcccgcggaatcccacgaaggggccatgtccggcccggaccgttcctccgacacgggatcggcccacgatgccggcccaaaagccggtgagccggcgcgcaaggcgacggccggcttcgaccccgacgaatggctcgcatgggccgacaggctgaaggccaacggcgagacggtcacctcgacccgggctgtggccgacggtctcgccccatccaccaccacggccaaacgacgcctgcacacgctgcgccgcgagcatcccggaaggttctgaccatgagggaaagcgatgaaccgttgacggacacattggtccgctgcctcgccgaccccacggacctgaaagccctcgaacggctcgagaacgacggggaccaagccggggccaggctcatgcgcgcccgcctcgccgaccaggccgcactccggctcgacgccgcgctggaggacaaccgggcgcgcgtgcgccggcagctgggccgcgactgggcatgggccacggacgaggtcatgagcgacctgacgatacgcaccatccgccgactcgactactggcaccgcaccaacacggaccgggcagagggaggggcgacgagcctggccgcgttcgtcaaccagctcaccggcaccgtggtcggcgaatggttcaaaacccaacggcccaaacaccgcacgggcatgacccagaccccggaacggcgcgcgggaaggctgaaaccacccacggacccggacgaccggacggcgtgggaacggtggcgccggcacgagcagaccctcgccgactccgacgtgatctgcgacgcatccgacatcttcgagggacgcgacggcgacggcgagagccccggatcgcccgccgcgggcgaccgggaaagctaccggcaatgggacggcgacacggcggacgccccattgccggtcagcgccggtgttttgcttcaatgtttgttcgacaggttcggcagtgtttttccgtagtgtgggctgatggttttccccggtgtcgtcatcgtttcccggtgatgtgataggcatcggtgccgccgcctgtatatt
